United States Patent 9,061,059 (MODIFIED POLYNUCLEOTIDES FOR TREATING PROTEIN DEFICIENCY) - sequence listing, part 42

SEQ ID NO: 76776 - DNA, 3015 bp, Artificial Sequence
  Description of Artificial Sequence: Synthetic coding sequence
atgcccgtggtgtggcccaccctgctggacctgagcagagacgagtgcaagagaatcctgagaaagctggagctggaggcctacgccggcgtgatcagcgccctgagagcccagggcgacctgaccaaggagaagaaggacctgctgggcgagctgagcaaggtgctgagcatcagcaccgagagacacagagccgaggtgagaagagccgtgaacgacgagagactgaccaccatcgcccacaacatgagcggccccaacagcagcagcgagtggagcatcgagggcagaagactggtgcccctgatgcccagactggtgccccagaccgccttcaccgtgaccgccaacgccgtggccaacgccgccatccagcacaacgccagcctgcccgtgcccgccgagaccggcagcaaggagggcgtgagctgcagcgacgaggacgagaagcccagaaagagaagaagaaccaacagcagcagcagcagccccgtggtgctgaaggaggtgcccaaggccgtggtgcccgtgagcaagaccatcaccgtgcccgtgagcggcagccccaagatgagcaacatcatgcagagcatcgccaacagcctgcccccccacatgagccccgtgaagatcaccttcaccaagcccagcacccagaccaccaacaccaccacccagaaggtgatcatcgtgaccaccagccccagcagcaccttcgtgcccaacatcctgagcaagagccacaactacgccgccgtgaccaagctggtgcccaccagcgtgatcgccagcaccacccagaagccccccgtggtgatcaccgccagccagagcagcctggtgagcaacagcagcagcggcagcagcagcagcacccccagccccatccccaacaccgtggccgtgaccgccgtggtgagcagcacccccagcgtggtgatgagcaccgtggcccagggcgtgagcaccagcgccatcaagatggccagcaccagactgcccagccccaagagcctggtgagcgcccccacccagatcctggcccagttccccaagcagcaccagcagagccccaagcagcagctgtaccaggtgcagcagcagacccagcagcaggtggcccagcccagccccgtgagccaccagcagcagccccagcagagccccctgccccccggcatcaagcccaccatccagatcaagcaggagagcggcgtgaagatcatcacccagcaggtgcagcccagcaagatcctgcccaagcccgtgaccgccatcctgaccgccaccagacccatcaccaagatgatcgtgacccagcccaagggcatcggcagcaccgtgcagcccgccgccaagatcatccccaccaagatcgtgtacggccagcagggcaagacccaggtgctgatcaagcccaagcccgtgaccttccaggccaccgtggtgagcgagcagaccagacagctggtgaccgagaccctgcagcaggccagcagagtggccgaggccggcaacagcagcatccaggagggcaaggaggagccccagaactacaccgacagcagcagcagcagcaccgagagcagccagagcagccaggtgagccacagaagccagccccagcagcccagccagccccagagaaccctgctgcagcacgtggcccagagccagaccgccacccagaccagcgtggtggtgaagagcatccccgccagcagccccggcgccatcacccacatcatgcagcaggccctgagcagccacaccgccttcaccaagcacagcgaggagctgggcaccgaggagggcgaggtggaggagatggacaccctggacccccagaccggcctgttctacagaagcgccctgacccagagccagagcgccaagcagcagaagctgagccagccccccctggagcagacccagctgcaggtgaagaccctgcagtgcttccagaccaagcagaagcagaccatccacctgcaggccgaccagctgcagcacaagctgccccagatgccccagctgagcatcagacaccagaagctgacccccctgcagcaggagcaggcccagcccaagcccgacgtgcagcacacccagcaccccatggtggccaaggacagacagctgcccaccctgatggcccagcccccccagaccgtggtgcaggtgctggccgtgaagaccacccagcagctgcccaagctgcagcaggcccccaaccagcccaagatctacgtgcagccccagaccccccagagccagatgagcctgcccgccagcagcgagaagcagaccgccagccaggtggagcagcccatcatcacccagggcagcagcgtgaccaagatcaccttcgagggcagacagccccccaccgtgaccaagatcaccggcggcagcagcgtgcccaagctgaccagccccgtgaccagcatcagccccatccaggccagcgagaagaccgccgtgagcgacatcctgaagatgagcctgatggaggcccagatcgacaccaacgtggagcacatgatcgtggacccccccaagaaggccctggccaccagcatgctgaccggcgaggccggcagcctgcccagcacccacatggtggtggccggcatggccaacagcaccccccagcagcagaagtgcagagagagctgcagcagccccagcaccgtgggcagcagcctgaccaccagaaagatcgacccccccgccgtgcccgccaccggccagttcatgagaatccagaacgtgggccagaagaaggccgaggagagccccgccgagatcatcatccaggccatcccccagtacgccatcccctgccacagcagcagcaacgtggtggtggagcccagcggcctgctggagctgaacaacttcaccagccagcagctggacgacgaggagaccgccatggagcaggacatcgacagcagcaccgaggacggcaccgagcccagccccagccagagcagcgccgagagaagctag

SEQ ID NO: 76777 - DNA, 3969 bp, Artificial Sequence; identical to SEQ ID NO: 76774
  Description of Artificial Sequence: Synthetic coding sequence

SEQ ID NO: 76778 - DNA, 624 bp, Artificial Sequence
  Description of Artificial Sequence: Synthetic coding sequence
atggccgtgttccacgacatgctgctgcagcccctgggcatgttcctgtgcctgagcctgcagctgagcagcgccaccttcatcagatacagcagcacctgcttcaccttcgacgagtactacaccatcaccctggacatcaaggccagcagccacatctacgagagcaacgccgtgtacagcgtgttcgtgcccgtgaacgacagcgtgtacgccgtggtgatgaagaccctggacgagaacagcgacagcgccggcctgtggcagagagccgacaagaactgctacagcaacagcacctactacgtgaaggaccagtacatgaccgtgctggaggcccagtggcaggcccccgagcccgagaacatcaccgaggtggagatccaggccttcaccgtgcagatcagagccctgcccatcctgagcaccctgaagctgagagagaagctgagcaccctggccctggccgccaagatcccccagagcagcgccttcaagcccttcttcatgatcacccccaagagcatcagactggagggcctggccaaccaggtgttcagcagccccatcaccgaggccatctacatcctgctggccttcctgaccagcaccctgctgttctag

SEQ ID NO: 76779 - DNA, 3708 bp, Artificial Sequence
  Description of Artificial Sequence: Synthetic coding sequence
atggaccacaccgccagccagaacgcccaggacctgatcggcatcccccacctgggcgtgagcggcagcagcaccaagtggcacagcgagctgagccccaccgagggcccccacagcgccggcagcagcacccccggcttcctgagccccatggccgagctgagccaccccagcccccccccccccgccctgggcagcctgctgcagctgcccgacggcagccccagctggagcatgctggaggtggccagcggccccgccagcacccagcagatcaaggccggcgtgcccggcagagtgcacaacggcgtgagcctgcccaccttcaagaacaccgagaccgccacccacgaggccgagccccccctgttccagaccgccgagagcggcgccatcgagatgaccagcagaaagctggccagcgccaccgccaacgacagcgccaaccccctgcacctgagcgccgcccccgagaacagcagaggccccgccctgagcgccgagcacaccagcagcctggtgcccagcctgcacatcaccaccctgggccaggagcaggccatcctgagcggcgccgtgcccgccagccccagcaccggcaccgccgacttccccagcatcctgaccttcctgcagcccaccgagaaccacgccagccccagccccgtgcccgagatgcccaccctgcccgccgagggcagcgacggcagcccccccgccaccagagacctgctgctgagcagcaaggtgcccaacctgctgagcaccagctggaccttccccagatggaagaaggacagcgtgaccgccatcctgggcaagaacgaggaggccaacgtgaccatccccctgcaggccttccccagaaaggaggtgctgagcctgcacaccgtgaacggcttcgtgagcgacttcagcaccggcagcgtgagcagccccatcatcaccgcccccagaaccaaccccctgcccagcggcccccccctgcccagcatcctgagcatccaggccacccagaccgtgttccccagcctgggcttcagcagcaccaagcccgaggcctacgccgccgccgtggaccacagcggcctgcccgccagcgccagcaagcaggtgagagccagccccagcagcatggacgtgtacgacagcctgaccatcggcgacatgaagaagcccgccaccaccgacgtgttctggagcagcctgagcgccgagaccggcagcctgagcaccgagagcatcatcagcggcctgcagcagcagaccaactacgacctgaacggccacaccatcagcaccaccagctgggagacccacctggcccccaccgccccccccaacggcctgaccagcgccgccgacgccatcaagagccaggacttcaaggacaccgccggccacagcgtgaccgccgagggcttcagcatccaggacctggtgctgggcaccagcatcgagcagcccgtgcagcagagcgacatgaccatggtgggcagccacatcgacctgtggcccaccagcaacaacaaccacagcagagacttccagaccgccgaggtggcctactacagccccaccaccagacacagcgtgagccacccccagctgcagctgcccaaccagcccgcccaccccctgctgctgaccagccccggccccaccagcaccggcagcctgcaggagatgctgagcgacggcaccgacaccggcagcgagatcagcagcgacatcaacagcagccccgagagaaacgccagcacccccttccagaacatcctgggctaccacagcgccgccgagagcagcatcagcaccagcgtgttccccagaaccagcagcagagtgctgagagccagccagcaccccaagaagtggaccggcgccgccaccaacgccgccgacaccgtgagcagcaaggtgcagcccaccgccgccgccgccgtgaccctgttcctgagaaagagcagcccccccgccctgagcgccgccctggtggccaagggcaccagcagcagccccctggccgtggccagcggccccgccaagagcagcagcatgaccaccctggccaagaacgtgaccaacaaggccgccagcggccccaagagaacccccggcgccgtgcacaccgccttccccttcacccccacctacatgtacgccagaaccggccacaccaccagcacccacaccgccatgcagggcaacatggacaccgccagcggcctgctgagcaccacctacctgcccagaaagccccaggccatgcacaccggcctgcccaaccccaccaacctggagatgcccagagccagcacccccagacccctgaccgtgaccgccgccctgaccagcatcaccgccagcgtgaaggccaccagactgccccccctgagagccgagaacaccgacgccgtgctgcccgccgccagcgccgccgtggtgaccaccggcaagatggccagcaacctggagtgccagatgagcagcaagctgctggtgaagaccgtgctgttcctgacccagagaagagtgcagatcagcgagagcctgaagttcagcatcgccaagggcctgacccaggccctgagaaaggccttccaccagaacgacgtgagcgcccacgtggacatcctggagtacagccacaacgtgaccgtgggctactacgccaccaagggcaagctggtgtacctgcccgccgtggtgatcgagatgctgggcgtgtacggcgtgagcaacgtgaccgccgacctgaagcagcacaccccccacctgcagagcgtggccgtgctggccagcccctggaacccccagcccgccggctacttccagctgaagaccgtgctgcagttcgtgagccaggccgacaacatccagagctgcaagttcgcccagaccatggagcagagactgcagaaggccttccaggacgccgagagaaaggtgctgaacaccaagagcaacctgaccatccagatcgtgagcaccagcaacgccagccaggccgtgaccctggtgtacgtggtgggcaaccagagcaccttcctgaacggcaccgtggccagcagcctgctgagccagctgagcgccgagctggtgggcttctacctgacctacccccccctgaccatcgccgagcccctggagtaccccaacctggacatcagcgagaccaccagagactactgggtgatcaccgtgctgcagggcgtggacaacagcctggtgggcctgcacaaccagagcttcgccagagtgatggagcagagactggcccagctgttcatgatgagccagcagcagggcagaagattcaagagagccaccaccctgggcagctacaccgtgcagatggtgaagatgcagagagtgcccggccccaaggaccccgccgagctgacctactacaccctgtacaacggcaagcccctgctgggcaccgccgccgccaagatcctgagcaccatcgacagccagagaatggccctgaccctgcaccacgtggtgctgctgcaggccgaccccgtggtgaagaacccccccaacaacctgtggatcatcgccgccgtgctggcccccatcgccgtggtgaccgtgatcatcatcatcatcaccgccgtgctgtgcagaaagaacaagaacgacttcaagcccgacaccatgatcaacctgccccagagagccaagcaggtggcccagtag

SEQ ID NO: 76780 - DNA, 5550 bp, Artificial Sequence
  Description of Artificial Sequence: Synthetic coding sequence
atggaccacaccgccagccagaacgcccaggacctgatcggcatcccccacctgggcgtgagcggcagcagcaccaagtggcacagcgagctgagccccaccgagggcccccacagcgccggcagcagcacccccggcttcctgagccccatggccgagctgagccaccccagcccccccccccccgccctgggcagcctgctgcagctgcccgacggcagccccagctggagcatgctggaggtggccagcggccccgccagcacccagcagatcaaggccggcgtgcccggcagagtgcacaacggcgtgagcctgcccaccttcaagaacaccgagaccgccacccacgaggccgagccccccctgttccagaccgccgagagcggcgccatcgagatgaccagcagaaagctggccagcgccaccgccaacgacagcgccaaccccctgcacctgagcgccgcccccgagaacagcagaggccccgccctgagcgccgagcacaccagcagcctggtgcccagcctgcacatcaccaccctgggccaggagcaggccatcctgagcggcgccgtgcccgccagccccagcaccggcaccgccgacttccccagcatcctgaccttcctgcagcccaccgagaaccacgccagccccagccccgtgcccgagatgcccaccctgcccgccgagggcagcgacggcagcccccccgccaccagagacctgctgctgagcagcaaggtgcccaacctgctgagcaccagctggaccttccccagatggaagaaggacagcgtgaccgccatcctgggcaagaacgaggaggccaacgtgaccatccccctgcaggccttccccagaaaggaggtgctgagcctgcacaccgtgaacggcttcgtgagcgacttcagcaccggcagcgtgagcagccccatcatcaccgcccccagaaccaaccccctgcccagcggcccccccctgcccagcatcctgagcatccaggccacccagaccgtgttccccagcctgggcttcagcagcaccaagcccgaggcctacgccgccgccgtggaccacagcggcctgcccgccagcgccagcaagcaggtgagagccagccccagcagcatggacgtgtacgacagcctgaccatcggcgacatgaagaagcccgccaccaccgacgtgttctggagcagcctgagcgccgagaccggcagcctgagcaccgagagcatcatcagcggcctgcagcagcagaccaactacgacctgaacggccacaccatcagcaccaccagctgggagacccacctggcccccaccgccccccccaacggcctgaccagcgccgccgacgccatcaagagccaggacttcaaggacaccgccggccacagcgtgaccgccgagggcttcagcatccaggacctggtgctgggcaccagcatcgagcagcccgtgcagcagagcgacatgaccatggtgggcagccacatcgacctgtggcccaccagcaacaacaaccacagcagagacttccagaccgccgaggtggcctactacagccccaccaccagacacagcgtgagccacccccagctgcagctgcccaaccagcccgcccaccccctgctgctgaccagccccggccccaccagcaccggcagcctgcaggagatgctgagcgacggcaccgacaccggcagcgagatcagcagcgacatcaacagcagccccgagagaaacgccagcacccccttccagaacatcctgggctaccacagcgccgccgagagcagcatcagcaccagcgtgttccccagaaccagcagcagagtgctgagagccagccagcaccccaagaagtggaccgccgacaccgtgagcagcaaggtgcagcccaccgccgccgccgccgtgaccctgttcctgagaaagagcagcccccccgccctgagcgccgccctggtggccaagggcaccagcagcagccccctggccgtggccagcggccccgccaagagcagcagcatgaccaccctggccaagaacgtgaccaacaaggccgccagcggccccaagagaacccccggcgccgtgcacaccgccttccccttcacccccacctacatgtacgccagaaccggccacaccaccagcacccacaccgccatgcagggcaacatggacaccgccagcggcctgctgagcaccacctacctgcccagaaagccccaggccatgcacaccggcctgcccaaccccaccaacctggagatgcccagagccagcacccccagacccctgaccgtgaccgccgccctgaccagcatcaccgccagcgtgaaggccaccagactgccccccctgagagccgagaacaccgacgccgtgctgcccgccgccagcgccgccgtggtgaccaccggcaagatggccagcaacctggagtgccagatgagcagcaagctgctggtgaagaccgtgctgttcctgacccagagaagagtgcagatcagcgagagcctgaagttcagcatcgccaagggcctgacccaggccctgagaaaggccttccaccagaacgacgtgagcgcccacgtggacatcctggagtacagccacaacgtgaccgtgggctactacgccaccaagggcaagctggtgtacctgcccgccgtggtgatcgagatgctgggcgtgtacggcgtgagcaacgtgaccgccgacctgaagcagcacaccccccacctgcagagcgtggccgtgctggccagcccctggaacccccagcccgccggctacttccagctgaagaccgtgctgcagttcgtgagccaggccgacaacatccagagctgcaagttcgcccagaccatggagcagagactgcagaaggccttccaggacgccgagagaaaggtgctgaacaccaagagcaacctgaccatccagatcgtgagcaccagcaacgccagccaggccgtgaccctggtgtacgtggtgggcaaccagagcaccttcctgaacggcaccgtggccagcagcctgctgagccagctgagcgccgagctggtgggcttctacctgacctacccccccctgaccatcgccgagcccctggagtaccccaacctggacatcagcgagaccaccagagactactgggtgatcaccgtgctgcagggcgtggacaacagcctggtgggcctgcacaaccagagcttcgccagagtgatggagcagagactggcccagctgttcatgatgagccagcagcagggcagaagattcaagagagccaccaccctgggcagctacaccgtgcagatggtgaagatgcagagagtgcccggccccaaggaccccgccgagctgacctactacaccctgtacaacggcaagcccctgctgggcaccgccgccgccaagatcctgagcaccatcgacagccagagaatggccctgaccctgcaccacgtggtgctgctgcaggccgaccccgtggtgaagaacccccccaacaacctgtggatcatcgccgccgtgctggcccccatcgccgtggtgaccgtgatcatcatcatcatcaccgccgtgctgtgcagaaagaacaagaacgacttcaagcccgacaccatgatcaacctgccccagagagccaagcccgtgcagggcttcgactacgccaagcagcacctgggccagcagggcgccgacgaggaggtgatccccgtgacccaggagaccgtggtgctgcccctgcccatcagagacgccccccaggagagagacgtggcccaggacggcagcaccatcaagaccgccaagagcaccgagaccagaaagagcagaagccccagcgagaacggcagcgtgatcagcaacgagagcggcaagcccagcagcggcagaagaagcccccagaacgtgatggcccagcagaaggtgaccaaggaggaggccagaaagagaaacgtgcccgccagcgacgaggaggagggcgccgtgctgttcgacaacagcagcaaggtggccgccgagcccttcgacaccagcagcggcagcgtgcagctgatcgccatcaagcccaccgccctgcccatggtgccccccaccagcgacagaagccaggagagcagcgccgtgctgaacggcgaggtgaacaaggccctgaagcagaagagcgacatcgagcactacagaaacaagctgagactgaaggccaagagaaagggctactacgacttccccgccgtggagaccagcaagggcctgaccgagagaaagaagatgtacgagaaggcccccaaggagatggagcacgtgctggaccccgacagcgagctgtgcgcccccttcaccgagagcaagaacagacagcagatgaagaacagcgtgtacagaagcagacagagcctgaacagccccagccccggcgagaccgagatggacctgctggtgaccagagagagacccagaagaggcatcagaaacagcggctacgacaccgagcccgagatcatcgaggagaccaacatcgacagagtgcccgagcccagaggctacagcagaagcagacaggtgaagggccacagcgagaccagcaccctgagcagccagcccagcatcgacgaggtgagacagcagatgcacatgctgctggaggaggccttcagcctggccagcgccggccacgccggccagagcagacaccaggaggcctacggcagcgcccagcacctgccctacagcgaggtggtgaccagcgcccccggcaccatgaccagacccagagccggcgtgcagtgggtgcccacctacagacccgagatgtaccagtacagcctgcccagacccgcctacagattcagccagctgcccgagatggtgatgggcagcccccccccccccgtgccccccagaaccggccccgtggccgtggccagcctgagaagaagcaccagcgacatcggcagcaagaccagaatggccgagagcaccggccccgagcccgcccagctgcacgacagcgccagcttcacccagatgagcagaggccccgtgagcgtgacccagctggaccagagcgccctgaactacagcggcaacaccgtgcccgccgtgttcgccatccccgccgccaacagacccggcttcaccggctacttcatccccaccccccccagcagctacagaaaccaggcctggatgagctacgccggcgagaacgagctgcccagccagtgggccgacagcgtgcccctgcccggctacatcgaggcctaccccagaagcagatacccccagagcagccccagcagactgcccagacagtacagccagcccgccaacctgcaccccagcctggagcaggcccccgcccccagcaccgccgccagccagcagagcctggccgagaacgaccccagcgacgcccccctgaccaacatcagcaccgccgccctggtgaaggccatcagagaggaggtggccaagctggccaagaagcagaccgacatgttcgagttccaggtgtag

SEQ ID NO: 76781 - DNA, 5568 bp, Artificial Sequence
  Description of Artificial Sequence: Synthetic coding sequence
atggaccacaccgccagccagaacgcccaggacctgatcggcatcccccacctgggcgtgagcggcagcagcaccaagtggcacagcgagctgagccccaccgagggcccccacagcgccggcagcagcacccccggcttcctgagccccatggccgagctgagccaccccagcccccccccccccgccctgggcagcctgctgcagctgcccgacggcagccccagctggagcatgctggaggtggccagcggccccgccagcacccagcagatcaaggccggcgtgcccggcagagtgcacaacggcgtgagcctgcccaccttcaagaacaccgagaccgccacccacgaggccgagccccccctgttccagaccgccgagagcggcgccatcgagatgaccagcagaaagctggccagcgccaccgccaacgacagcgccaaccccctgcacctgagcgccgcccccgagaacagcagaggccccgccctgagcgccgagcacaccagcagcctggtgcccagcctgcacatcaccaccctgggccaggagcaggccatcctgagcggcgccgtgcccgccagccccagcaccggcaccgccgacttccccagcatcctgaccttcctgcagcccaccgagaaccacgccagccccagccccgtgcccgagatgcccaccctgcccgccgagggcagcgacggcagcccccccgccaccagagacctgctgctgagcagcaaggtgcccaacctgctgagcaccagctggaccttccccagatggaagaaggacagcgtgaccgccatcctgggcaagaacgaggaggccaacgtgaccatccccctgcaggccttccccagaaaggaggtgctgagcctgcacaccgtgaacggcttcgtgagcgacttcagcaccggcagcgtgagcagccccatcatcaccgcccccagaaccaaccccctgcccagcggcccccccctgcccagcatcctgagcatccaggccacccagaccgtgttccccagcctgggcttcagcagcaccaagcccgaggcctacgccgccgccgtggaccacagcggcctgcccgccagcgccagcaagcaggtgagagccagccccagcagcatggacgtgtacgacagcctgaccatcggcgacatgaagaagcccgccaccaccgacgtgttctggagcagcctgagcgccgagaccggcagcctgagcaccgagagcatcatcagcggcctgcagcagcagaccaactacgacctgaacggccacaccatcagcaccaccagctgggagacccacctggcccccaccgccccccccaacggcctgaccagcgccgccgacgccatcaagagccaggacttcaaggacaccgccggccacagcgtgaccgccgagggcttcagcatccaggacctggtgctgggcaccagcatcgagcagcccgtgcagcagagcgacatgaccatggtgggcagccacatcgacctgtggcccaccagcaacaacaaccacagcagagacttccagaccgccgaggtggcctactacagccccaccaccagacacagcgtgagccacccccagctgcagctgcccaaccagcccgcccaccccctgctgctgaccagccccggccccaccagcaccggcagcctgcaggagatgctgagcgacggcaccgacaccggcagcgagatcagcagcgacatcaacagcagccccgagagaaacgccagcacccccttccagaacatcctgggctaccacagcgccgccgagagcagcatcagcaccagcgtgttccccagaaccagcagcagagtgctgagagccagccagcaccccaagaagtggaccggcgccgccaccaacgccgccgacaccgtgagcagcaaggtgcagcccaccgccgccgccgccgtgaccctgttcctgagaaagagcagcccccccgccctgagcgccgccctggtggccaagggcaccagcagcagccccctggccgtggccagcggccccgccaagagcagcagcatgaccaccctggccaagaacgtgaccaacaaggccgccagcggccccaagagaacccccggcgccgtgcacaccgccttccccttcacccccacctacatgtacgccagaaccggccacaccaccagcacccacaccgccatgcagggcaacatggacaccgccagcggcctgctgagcaccacctacctgcccagaaagccccaggccatgcacaccggcctgcccaaccccaccaacctggagatgcccagagccagcacccccagacccctgaccgtgaccgccgccctgaccagcatcaccgccagcgtgaaggccaccagactgccccccctgagagccgagaacaccgacgccgtgctgcccgccgccagcgccgccgtggtgaccaccggcaagatggccagcaacctggagtgccagatgagcagcaagctgctggtgaagaccgtgctgttcctgacccagagaagagtgcagatcagcgagagcctgaagttcagcatcgccaagggcctgacccaggccctgagaaaggccttccaccagaacgacgtgagcgcccacgtggacatcctggagtacagccacaacgtgaccgtgggctactacgccaccaagggcaagctggtgtacctgcccgccgtggtgatcgagatgctgggcgtgtacggcgtgagcaacgtgaccgccgacctgaagcagcacaccccccacctgcagagcgtggccgtgctggccagcccctggaacccccagcccgccggctacttccagctgaagaccgtgctgcagttcgtgagccaggccgacaacatccagagctgcaagttcgcccagaccatggagcagagactgcagaaggccttccaggacgccgagagaaaggtgctgaacaccaagagcaacctgaccatccagatcgtgagcaccagcaacgccagccaggccgtgaccctggtgtacgtggtgggcaaccagagcaccttcctgaacggcaccgtggccagcagcctgctgagccagctgagcgccgagctggtgggcttctacctgacctacccccccctgaccatcgccgagcccctggagtaccccaacctggacatcagcgagaccaccagagactactgggtgatcaccgtgctgcagggcgtggacaacagcctggtgggcctgcacaaccagagcttcgccagagtgatggagcagagactggcccagctgttcatgatgagccagcagcagggcagaagattcaagagagccaccaccctgggcagctacaccgtgcagatggtgaagatgcagagagtgcccggccccaaggaccccgccgagctgacctactacaccctgtacaacggcaagcccctgctgggcaccgccgccgccaagatcctgagcaccatcgacagccagagaatggccctgaccctgcaccacgtggtgctgctgcaggccgaccccgtggtgaagaacccccccaacaacctgtggatcatcgccgccgtgctggcccccatcgccgtggtgaccgtgatcatcatcatcatcaccgccgtgctgtgcagaaagaacaagaacgacttcaagcccgacaccatgatcaacctgccccagagagccaagcccgtgcagggcttcgactacgccaagcagcacctgggccagcagggcgccgacgaggaggtgatccccgtgacccaggagaccgtggtgctgcccctgcccatcagagacgccccccaggagagagacgtggcccaggacggcagcaccatcaagaccgccaagagcaccgagaccagaaagagcagaagccccagcgagaacggcagcgtgatcagcaacgagagcggcaagcccagcagcggcagaagaagcccccagaacgtgatggcccagcagaaggtgaccaaggaggaggccagaaagagaaacgtgcccgccagcgacgaggaggagggcgccgtgctgttcgacaacagcagcaaggtggccgccgagcccttcgacaccagcagcggcagcgtgcagctgatcgccatcaagcccaccgccctgcccatggtgccccccaccagcgacagaagccaggagagcagcgccgtgctgaacggcgaggtgaacaaggccctgaagcagaagagcgacatcgagcactacagaaacaagctgagactgaaggccaagagaaagggctactacgacttccccgccgtggagaccagcaagggcctgaccgagagaaagaagatgtacgagaaggcccccaaggagatggagcacgtgctggaccccgacagcgagctgtgcgcccccttcaccgagagcaagaacagacagcagatgaagaacagcgtgtacagaagcagacagagcctgaacagccccagccccggcgagaccgagatggacctgctggtgaccagagagagacccagaagaggcatcagaaacagcggctacgacaccgagcccgagatcatcgaggagaccaacatcgacagagtgcccgagcccagaggctacagcagaagcagacaggtgaagggccacagcgagaccagcaccctgagcagccagcccagcatcgacgaggtgagacagcagatgcacatgctgctggaggaggccttcagcctggccagcgccggccacgccggccagagcagacaccaggaggcctacggcagcgcccagcacctgccctacagcgaggtggtgaccagcgcccccggcaccatgaccagacccagagccggcgtgcagtgggtgcccacctacagacccgagatgtaccagtacagcctgcccagacccgcctacagattcagccagctgcccgagatggtgatgggcagcccccccccccccgtgccccccagaaccggccccgtggccgtggccagcctgagaagaagcaccagcgacatcggcagcaagaccagaatggccgagagcaccggccccgagcccgcccagctgcacgacagcgccagcttcacccagatgagcagaggccccgtgagcgtgacccagctggaccagagcgccctgaactacagcggcaacaccgtgcccgccgtgttcgccatccccgccgccaacagacccggcttcaccggctacttcatccccaccccccccagcagctacagaaaccaggcctggatgagctacgccggcgagaacgagctgcccagccagtgggccgacagcgtgcccctgcccggctacatcgaggcctaccccagaagcagatacccccagagcagccccagcagactgcccagacagtacagccagcccgccaacctgcaccccagcctggagcaggcccccgcccccagcaccgccgccagccagcagagcctggccgagaacgaccccagcgacgcccccctgaccaacatcagcaccgccgccctggtgaaggccatcagagaggaggtggccaagctggccaagaagcagaccgacatgttcgagttccaggtgtag

SEQ ID NO: 76782 - DNA, 5067 bp, Artificial Sequence
  Description of Artificial Sequence: Synthetic coding sequence
atccccgagggcctgagcgccgagcacaccagcagcctggtgcccagcctgcacatcaccaccctgggccaggagcaggccatcctgagcggcgccgtgcccgccagccccagcaccggcaccgccgacttccccagcatcctgaccttcctgcagcccaccgagaaccacgccagccccagccccgtgcccgagatgcccaccctgcccgccgagggcagcgacggcagcccccccgccaccagagacctgctgctgagcagcaaggtgcccaacctgctgagcaccagctggaccttccccagatggaagaaggacagcgtgaccgccatcctgggcaagaacgaggaggccaacgtgaccatccccctgcaggccttccccagaaaggaggtgctgagcctgcacaccgtgaacggcttcgtgagcgacttcagcaccggcagcgtgagcagccccatcatcaccgcccccagaaccaaccccctgcccagcggcccccccctgcccagcatcctgagcatccaggccacccagaccgtgttccccagcctgggcttcagcagcaccaagcccgaggcctacgccgccgccgtggaccacagcggcctgcccgccagcgccagcaagcaggtgagagccagccccagcagcatggacgtgtacgacagcctgaccatcggcgacatgaagaagcccgccaccaccgacgtgttctggagcagcctgagcgccgagaccggcagcctgagcaccgagagcatcatcagcggcctgcagcagcagaccaactacgacctgaacggccacaccatcagcaccaccagctgggagacccacctggcccccaccgccccccccaacggcctgaccagcgccgccgacgccatcaagagccaggacttcaaggacaccgccggccacagcgtgaccgccgagggcttcagcatccaggacctggtgctgggcaccagcatcgagcagcccgtgcagcagagcgacatgaccatggtgggcagccacatcgacctgtggcccaccagcaacaacaaccacagcagagacttccagaccgccgaggtggcctactacagccccaccaccagacacagcgtgagccacccccagctgcagctgcccaaccagcccgcccaccccctgctgctgaccagccccggccccaccagcaccggcagcctgcaggagatgctgagcgacggcaccgacaccggcagcgagatcagcagcgacatcaacagcagccccgagagaaacgccagcacccccttccagaacatcctgggctaccacagcgccgccgagagcagcatcagcaccagcgtgttccccagaaccagcagcagagtgctgagagccagccagcaccccaagaagtggaccgccgacaccgtgagcagcaaggtgcagcccaccgccgccgccgccgtgaccctgttcctgagaaagagcagcccccccgccctgagcgccgccctggtggccaagggcaccagcagcagccccctggccgtggccagcggccccgccaagagcagcagcatgaccaccctggccaagaacgtgaccaacaaggccgccagcggccccaagagaacccccggcgccgtgcacaccgccttccccttcacccccacctacatgtacgccagaaccggccacaccaccagcacccacaccgccgccagaaagcacggccactgcctgtggcccgtggtgtacaacctgccccccagaaagccccaggccatgcacaccggcctgcccaaccccaccaacctggagatgcccagagccagcacccccagacccctgaccgtgaccgccgccctgaccagcatcaccgccagcgtgaaggccaccagactgccccccctgagagccgagaacaccgacgccgtgctgcccgccgccagcgccgccgtggtgaccaccggcaagatggccagcaacctggagtgccagatgagcagcaagctgctggtgaagaccgtgctgttcctgacccagagaagagtgcagatcagcgagagcctgaagttcagcatcgccaagggcctgacccaggccctgagaaaggccttccaccagaacgacgtgagcgcccacgtggacatcctggagtacagccacaacgtgaccgtgggctactacgccaccaagggcaagctggtgtacctgcccgccgtggtgatcgagatgctgggcgtgtacggcgtgagcaacgtgaccgccgacctgaagcagcacaccccccacctgcagagcgtggccgtgctggccagcccctggaacccccagcccgccggctacttccagctgaagaccgtgctgcagttcgtgagccaggccgacaacatccagagctgcaagttcgcccagaccatggagcagagactgcagaaggccttccaggacgccgagagaaaggtgctgaacaccaagagcaacctgaccatccagatcgtgagcaccagcaacgccagccaggccgtgaccctggtgtacgtggtgggcaaccagagcaccttcctgaacggcaccgtggccagcagcctgctgagccagctgagcgccgagctggtgggcttctacctgacctacccccccctgaccatcgccgagcccctggagtaccccaacctggacatcagcgagaccaccagagactactgggtgatcaccgtgctgcagggcgtggacaacagcctggtgggcctgcacaaccagagcttcgccagagtgatggagcagagactggcccagctgttcatgatgagccagcagcagggcagaagattcaagagagccaccaccctgggcagctacaccgtgcagatggtgaagatgcagagagtgcccggccccaaggaccccgccgagctgacctactacaccctgtacaacggcaagcccctgctgggcaccgccgccgccaagatcctgagcaccatcgacagccagagaatggccctgaccctgcaccacgtggtgctgctgcaggccgaccccgtggtgaagaacccccccaacaacctgtggatcatcgccgccgtgctggcccccatcgccgtggtgaccgtgatcatcatcatcatcaccgccgtgctgtgcagaaagaacaagaacgacttcaagcccgacaccatgatcaacctgccccagagagccaagcccgtgcagggcttcgactacgccaagcagcacctgggccagcagggcgccgacgaggaggtgatccccgtgacccaggagaccgtggtgctgcccctgcccatcagagacgccccccaggagagagacgtggcccaggacggcagcaccatcaagaccgccaagagcaccgagaccagaaagagcagaagccccagcgagaacggcagcgtgatcagcaacgagagcggcaagcccagcagcggcagaagaagcccccagaacgtgatggcccagcagaaggtgaccaaggaggaggccagaaagagaaacgtgcccgccagcgacgaggaggagggcgccgtgctgttcgacaacagcagcaaggtggccgccgagcccttcgacaccagcagcggcagcgtgcagctgatcgccatcaagcccaccgccctgcccatggtgccccccaccagcgacagaagccaggagagcagcgccgtgctgaacggcgaggtgaacaaggccctgaagcagaagagcgacatcgagcactacagaaacaagctgagactgaaggccaagagaaagggctactacgacttccccgccgtggagaccagcaagggcctgaccgagagaaagaagatgtacgagaaggcccccaaggagatggagcacgtgctggaccccgacagcgagctgtgcgcccccttcaccgagagcaagaacagacagcagatgaagaacagcgtgtacagaagcagacagagcctgaacagccccagccccggcgagaccgagatggacctgctggtgaccagagagagacccagaagaggcatcagaaacagcggctacgacaccgagcccgagatcatcgaggagaccaacatcgacagagtgcccgagcccagaggctacagcagaagcagacaggtgaagggccacagcgagaccagcaccctgagcagccagcccagcatcgacgaggtgagacagcagatgcacatgctgctggaggaggccttcagcctggccagcgccggccacgccggccagagcagacaccaggaggcctacggcagcgcccagcacctgccctacagcgaggtggtgaccagcgcccccggcaccatgaccagacccagagccggcgtgcagtgggtgcccacctacagacccgagatgtaccagtacagcctgcccagacccgcctacagattcagccagctgcccgagatggtgatgggcagcccccccccccccgtgccccccagaaccggccccgtggccgtggccagcctgagaagaagcaccagcgacatcggcagcaagaccagaatggccgagagcaccggccccgagcccgcccagctgcacgacagcgccagcttcacccagatgagcagaggccccgtgagcgtgacccagctggaccagagcgccctgaactacagcggcaacaccgtgcccgccgtgttcgccatccccgccgccaacagacccggcttcaccggctacttcatccccaccccccccagcagctacagaaaccaggcctggatgagctacgccggcgagaacgagctgcccagccagtgggccgacagcgtgcccctgcccggctacatcgaggcctaccccagaagcagatacccccagagcagccccagcagactgcccagacagtacagccagcccgccaacctgcaccccagcctggagcaggcccccgcccccagcaccgccgccagccagcagagcctggccgagaacgaccccagcgacgcccccctgaccaacatcagcaccgccgccctggtgaaggccatcagagaggaggtggccaagctggccaagaagcagaccgacatgttcgagttccaggtgtag

SEQ ID NO: 76783 - DNA, 783 bp, Artificial Sequence
  Description of Artificial Sequence: Synthetic coding sequence
atgatggacccctgcagcgtgggcgtgcagctgagaaccaccaacgagtgccacaagacctactacaccagacacaccggcttcaagaccctgcaggagctgagcagcaacgacatgctgctgctgcagctgagaaccggcatgaccctgagcggcaacaacaccatctgcttccaccacgtgaagatctacatcgacagattcgaggacctgcagaagagctgctgcgaccccttcaacatccacaagaagctggccaagaagaacctgcacgtgatcgacctggacgacgccaccttcctgagcgccaagttcggcagacagctggtgcccggctggaagctgtgccccaagtgcacccagatcatcaacggcagcgtggacgtggacaccgaggacagacagaagagaaagcccgagagcgacggcagaaccgccaaggccctgagaagcctgcagttcaccaaccccggcagacagaccgagttcgcccccgagaccggcaagagagagaagagaagactgaccaagaacgccaccgccggcagcgacagacaggtgatccccgccaagagcaaggtgtacgacagccagggcctgctgatcttcagcggcatggacctgtgcgactgcctggacgaggactgcctgggctgcttctacgcctgccccgcctgcggcagcaccaagtgcggcgccgagtgcagatgcgacagaaagtggctgtacgagcagatcgagatcgagggcggcgagatcatccacaacaagcacgccggctag

SEQ ID NO: 76784 - DNA, 507 bp, Artificial Sequence
  Description of Artificial Sequence: Synthetic coding sequence
atgatggacccctgcagcgtgggcgtgcagctgagaaccaccaacgagtgccacaagacctactacaccagacacaccggcttcaagaccctgcaggagctgagcagcaacgacatgctgctgctgcagctgagaaccggcatgaccctgagcggcaacaacaccatctgcttccaccacgtgaagatctacatcgacagattcgaggacctgcagaagagctgctgcgaccccttcaacatccacaagaagctggccaagaagaacctgcacgtgatcgacctggacgacgccaccttcctgagcgccaagttcggcagacagctggtgcccggctggaagctgtgccccaagtgcacccagatcatcaacggcagcgtggacgtggacaccgaggacagacagaagagaaagcccgagagcgacggcagaaccgccaaggccctgagaagcctgcagttcaccaaccccggcagacagaccgagttcgcccccgagaccggctag

SEQ ID NO: 76785 - DNA, 180 bp, Artificial Sequence
  Description of Artificial Sequence: Synthetic coding sequence
atgagacagctgaagggcaagcccaagaaggagaccagcaaggacaagaaggagagaaagcaggccatgcaggaggccagacagcagatcaccaccgtggtgctgcccaccctggccgtggtggtgctgctgatcgtggtgttcgtgtacgtggccaccagacccaccatcaccgagtag

SEQ ID NO: 76786 - DNA, 180 bp, Artificial Sequence; identical to SEQ ID NO: 76785
  Description of Artificial Sequence: Synthetic coding sequence

SEQ ID NO: 76787 - DNA, 144 bp, Artificial Sequence
  Description of Artificial Sequence: Synthetic coding sequence
atgagacagctgaagggcaagcccaagaaggagaccagcaaggacaagaaggagagaaagcaggccatgcaggaggccagacagcagatcaccaccgtggtgctgcccaccctggccgtggtggtgctgctgatcgtggtgtag

SEQ ID NO: 76788 - DNA, 180 bp, Artificial Sequence; identical to SEQ ID NO: 76785
  Description of Artificial Sequence: Synthetic coding sequence

SEQ ID NO: 76789 - DNA, 159 bp, Artificial Sequence
  Description of Artificial Sequence: Synthetic coding sequence
atgagacagctgaagggcaagcccaagaaggagaccagcaaggacaagaaggagagaaagcaggccatgcaggaggccagacagcagatcaccaccgtggtgctgcccaccctggccgtggtggtgctgctgatcgtggtgttcgtgtacgtggcctag

SEQ ID NO: 76790 - DNA, 3336 bp, Artificial Sequence
  Description of Artificial Sequence: Synthetic coding sequence
atgcactggctgcccgccggccacgacatcaacggcgccctggagcccagcaacatcgacaccagcatcctggaggagtacatcagcaaggaggacgccagcgacctgtgcttccccgacatcagcgcccccgccagcagcgccagctacagccacggccagcccgccatgcccggcagcagcggcgtgcaccacctgagcccccccggcggcggccccagccccggcagacacggccccctgcccccccccggctacggcacccccctgaactgcaacaacaacaacggcatgggcgccgcccccaagcccttccccggcggcaccggcccccccatcaaggccgagcccaaggccccctacgcccccggcaccctgcccgacagcccccccgacagcggcagcgaggcctacagcccccagcaggtgaacgagccccacctgctgagaaccatcacccccgagaccctgtgccacgtgggcgtgcccagcagactggagcaccccccccccccccccgcccacctgcccggcccccccccccccccccccccccccccccactaccccgtgctgcagagagacctgtacatgaaggccgagccccccatcccccactacgccgccatgggccagggcctggtgcccaccgacctgcaccacacccagcagagccagatgctgcaccagctgctgcagcagcacggcgccgagctgcccacccaccccagcaagaagagaaagcacagcgagagcccccccagcaccctgaacgcccagatgctgaacggcatgatcaagcaggagcccggcaccgtgaccgccctgcccctgcaccccaccagagcccccagccccccctggcccccccagggccccctgagccccggccccggcagcctgcccctgagcatcgccagagtgcagacccccccctggcacccccccggcgcccccagccccggcctgctgcaggacagcgacagcctgagcggcagctacctggaccccaactaccagagcatcaagtggcagccccaccagcagaacaagtgggccaccctgtacgacgccaactacaaggagctgcccatgctgacctacagagtggacgccgacaagggcttcaacttcagcgtgggcgacgacgccttcgtgtgccagaagaagaaccacttccaggtgaccgtgtacatcggcatgctgggcgagcccaagtacgtgaagacccccgagggcctgaagcccctggactgcttctacctgaagctgcacggcgtgaagctggaggccctgaaccagagcatcaacatcgagcagagccagagcgacagaagcaagagacccttcaaccccgtgaccgtgaacctgccccccgagcaggtgaccaaggtgaccgtgggcagactgcacttcagcgagaccaccgccaacaacatgagaaagaagggcaagcccaaccccgaccagagatacttcatgctggtggtggccctgcaggcccacgcccagaaccagaactacaccctggccgcccagatcagcgagagaatcatcgtgagagccagcaaccccggccagttcgagagcgacagcgacgtgctgtggcagagagcccaggtgcccgacaccgtgttccaccacggcagagtgggcatcaacaccgacagacccgacgaggccctggtggtgcacggcaacgtgaaggtgatgggcagcctgatgcaccccagcgacctgagagccaaggagcacgtgcaggaggtggacaccaccgagcagctgaagagaatcagcagaatgagactggtgcactacagatacaagcccgagttcgccgccagcgccggcatcgaggccaccgcccccgagaccggcgtgatcgcccaggaggtgaaggagatcctgcccgaggccgtgaaggacaccggcgacatggtgttcgccaacggcaagaccatcgagaacttcctggtggtgaacaaggagagaatcttcatggagaacgtgggcgccgtgaaggagctgtgcaagctgaccgacaacctggagaccagaatcgacgagctggagagatggagccacaagctggccaagctgagaagactggacagcctgaagagcaccggcagcagcggcgccttcagccacgccggcagccagttcagcagagccggcagcgtgccccacaagaagagaccccccaaggtggccagcaagagcagcagcgtggtgcccgaccaggcctgcatcagccagagattcctgcagggcaccatcatcgccctggtggtggtgatggccttcagcgtggtgagcatgagcaccctgtacgtgctgagcctgagaaccgaggaggacctggtggacaccgacggcagaagcagccagagcttcggcaccacccagctgagacagagccccctgaccaccggcctgcccggcatccagcccagcctgctgctggtgaccaccagcctgaccagcagcgcccccggcagcgccgtgagaaccctggacatgtgcagcagccacccctgccccgtgatctgctgcagcagccccaccaccaaccccaccaccggccccagcctgggccccagcttcaaccccggccacgtgctgagccccagccccagccccagcaccaacagaagcggccccagccagatggccctgctgcccgtgaccaacatcagagccaagagctggggcctgagcgtgaacggcatcggccacagcaagcaccacaagagcctggagcccctggccagccccgccgtgcccttccccggcggccagggcaaggccaagaacagccccagcctgggcttccacggcagagccagaagaggcgccctgcagagcagcgtgggccccgccgagcccacctgggcccagggccagagcgagcccgtgcccagcctgaccagcatccaggtgctggagaacagcatgagcatcaccagccagtactgcgcccccggcgacgcctgcagacccggcaacttcacctaccacatccccgtgagcagcggcacccccctgcacctgagcctgaccctgcagatgaacagcagcagccccgtgagcgtggtgctgtgcagcctgagaagcaaggaggagccctgcgaggagggcagcctgccccagagcctgcacacccaccaggacacccagggcaccagccacagatggcccatcaccatcctgagcttcagagagttcacctaccacttcagagtggccctgctgggccaggccaactgcagcagcgaggccctggcccagcccgccaccgactaccacttccacttctacagactgtgcgactag

SEQ ID NO: 76791 - DNA, 3456 bp, Artificial Sequence
  Description of Artificial Sequence: Synthetic coding sequence
atggaggtggtggacgagaccgaggccctgcagagattcttcgagggccacgacatcaacggcgccctggagcccagcaacatcgacaccagcatcctggaggagtacatcagcaaggaggacgccagcgacctgtgcttccccgacatcagcgcccccgccagcagcgccagctacagccacggccagcccgccatgcccggcagcagcggcgtgcaccacctgagcccccccggcggcggccccagccccggcagacacggccccctgcccccccccggctacggcacccccctgaactgcaacaacaacaacggcatgggcgccgcccccaagcccttccccggcggcaccggcccccccatcaaggccgagcccaaggccccctacgcccccggcaccctgcccgacagcccccccgacagcggcagcgaggcctacagcccccagcaggtgaacgagccccacctgctgagaaccatcacccccgagaccctgtgccacgtgggcgtgcccagcagactggagcaccccccccccccccccgcccacctgcccggcccccccccccccccccccccccccccccactaccccgtgctgcagagagacctgtacatgaaggccgagccccccatcccccactacgccgccatgggccagggcctggtgcccaccgacctgcaccacacccagcagagccagatgctgcaccagctgctgcagcagcacggcgccgagctgcccacccaccccagcaagaagagaaagcacagcgagagcccccccagcaccctgaacgcccagatgctgaacggcatgatcaagcaggagcccggcaccgtgaccgccctgcccctgcaccccaccagagcccccagccccccctggcccccccagggccccctgagccccggccccggcagcctgcccctgagcatcgccagagtgcagacccccccctggcacccccccggcgcccccagccccggcctgctgcaggacagcgacagcctgagcggcagctacctggaccccaactaccagagcatcaagtggcagccccaccagcagaacaagtgggccaccctgtacgacgccaactacaaggagctgcccatgctgacctacagagtggacgccgacaagggcttcaacttcagcgtgggcgacgacgccttcgtgtgccagaagaagaaccacttccaggtgaccgtgtacatcggcatgctgggcgagcccaagtacgtgaagacccccgagggcctgaagcccctggactgcttctacctgaagctgcacggcgtgaagctggaggccctgaaccagagcatcaacatcgagcagagccagagcgacagaagcaagagacccttcaaccccgtgaccgtgaacctgccccccgagcaggtgaccaaggtgaccgtgggcagactgcacttcagcgagaccaccgccaacaacatgagaaagaagggcaagcccaaccccgaccagagatacttcatgctggtggtggccctgcaggcccacgcccagaaccagaactacaccctggccgcccagatcagcgagagaatcatcgtgagagccagcaaccccggccagttcgagagcgacagcgacgtgctgtggcagagagcccaggtgcccgacaccgtgttccaccacggcagagtgggcatcaacaccgacagacccgacgaggccctggtggtgcacggcaacgtgaaggtgatgggcagcctgatgcaccccagcgacctgagagccaaggagcacgtgcaggaggtggacaccaccgagcagctgaagagaatcagcagaatgagactggtgcactacagatacaagcccgagttcgccgccagcgccggcatcgaggccaccgcccccgagaccggcgtgatcgcccaggaggtgaaggagatcctgcccgaggccgtgaaggacaccggcgacatggtgttcgccaacggcaagaccatcgagaacttcctggtggtgaacaaggagagaatcttcatggagaacgtgggcgccgtgaaggagctgtgcaagctgaccgacaacctggagaccagaatcgacgagctggagagatggagccacaagctggccaagctgagaagactggacagcctgaagagcaccggcagcagcggcgccttcagccacgccggcagccagttcagcagagccggcagcgtgccccacaagaagagaccccccaaggtggccagcaagagcagcagcgtggtgcccgaccaggcctgcatcagccagagattcctgcagggcaccatcatcgccctggtggtggtgatggccttcagcgtggtgagcatgagcaccctgtacgtgctgagcctgagaaccgaggaggacctggtggacaccgacggcagcttcgccgtgagcaccagctgcctgctggccctgctgagaccccagccccccggcggcagcgaggccctgtgcccctggagcagccagagcttcggcaccacccagctgagacagagccccctgaccaccggcctgcccggcatccagcccagcctgctgctggtgaccaccagcctgaccagcagcgcccccggcagcgccgtgagaaccctggacatgtgcagcagccacccctgccccgtgatctgctgcagcagccccaccaccaaccccaccaccggccccagcctgggccccagcttcaaccccggccacgtgctgagccccagccccagccccagcaccaacagaagcggccccagccagatggccctgctgcccgtgaccaacatcagagccaagagctggggcctgagcgtgaacggcatcggccacagcaagcaccacaagagcctggagcccctggccagccccgccgtgcccttccccggcggccagggcaaggccaagaacagccccagcctgggcttccacggcagagccagaagaggcgccctgcagagcagcgtgggccccgccgagcccacctgggcccagggccagagcgccagcctgctggccgagcccgtgcccagcctgaccagcatccaggtgctggagaacagcatgagcatcaccagccagtactgcgcccccggcgacgcctgcagacccggcaacttcacctaccacatccccgtgagcagcggcacccccctgcacctgagcctgaccctgcagatgaacagcagcagccccgtgagcgtggtgctgtgcagcctgagaagcaaggaggagccctgcgaggagggcagcctgccccagagcctgcacacccaccaggacacccagggcaccagccacagatggcccatcaccatcctgagcttcagagagttcacctaccacttcagagtggccctgctgggccaggccaactgcagcagcgaggccctggcccagcccgccaccgactaccacttccacttctacagactgtgcgactag

SEQ ID NO: 76792 - DNA, 1449 bp, Artificial Sequence
  Description of Artificial Sequence: Synthetic coding sequence
atgctgacctacagagtggacgccgacaagggcttcaacttcagcgtgggcgacgacgccttcgtgtgccagaagaagaaccacttccaggtgaccgtgtacatcggcatgctgggcgagcccaagtacgtgaagacccccgagggcctgaagcccctggactgcttctacctgaagctgcacggcctggaggccctgaaccagagcatcaacatcgagcagagccagagcgacagaagcaagagacccttcaaccccgtgaccgtgaacctgccccccgagcaggtgaccaaggtgaccgtgggcagactgcacttcagcgagaccaccgccaacaacatgagaaagaagggcaagcccaaccccgaccagagatacttcatgctggtggtggccctgcaggcccacgcccagaaccagaactacaccctggccgcccagatcagcgagagaatcatcgtgagagccagcaaccccggccagttcgagagcgacagcgacgtgctgtggcagagagcccaggtgcccgacaccgtgttccaccacggcagagtgggcatcaacaccgacagacccgacgaggccctggtggtgcacggcaacgtgaaggtgatgggcagcctgatgcaccccagcgacctgagagccaaggagcacgtgcaggaggtggacaccaccgagcagctgaagagaatcagcagaatgagactggtgcactacagatacaagcccgagttcgccgccagcgccggcatcgaggccaccgcccccgagaccggcgtgatcgcccaggaggtgaaggagatcctgcccgaggccgtgaaggacaccggcgacatggtgttcgccaacggcaagaccatcgagaacttcctggtggtgaacaaggtgtgcggcctgaagtacgtggtgtactgcgaggacgacgtgtgccacctgcccgtgctgagcctgggcgccaaggaggcctgggccgtgaaggagctgtgcaagctgaccgacaacctggagaccagaatcgacgagctggagagatggagccacaagctggccaagctgagaagactggacagcctgaagagcaccggcagcagcggcgccttcagccacgccggcagccagttcagcagagccggcagcgtgccccacaagaagagaccccccaaggtggccagcaaggtgggcagcagcagcgtggtgcccgaccaggcctgcatcagccagagattcctgcagggcaccatcatcgccctggtggtggtgatggccttcagacaccacctgggcgcccagccccaggagcagggcccccagccctgccccagagagagagccctggacggcggcagcagcagcaacggccaccccttcctgtggctgcagagaggcgtgcacgtgcacaccgtgagagccgagcccgcccacagaggcggccccggcagacactag

SEQ ID NO: 76793 - DNA, 789 bp, Artificial Sequence
  Description of Artificial Sequence: Synthetic coding sequence
atggccgcccccagcggcaccgtgagcgacagcgagagcagcaacagcagcagcgacgccgaggagctggagagatgcagagaggccgccatgcccgcctggggcctggagcagagaccccacgtggccggcaagcccagagccggcgccgccaacagccagctgagcaccagccagcccagcctgagacacaaggtgaacgagcacgagcaggacggcaacgagctgcagaccacccccgagttcagagcccacgtggccaagaagctgggcgccctgctggacagcttcatcaccatcagcgaggccgccaaggagcccgccaaggccaaggtgcagaaggtggccctggaggacgacggcttcagactgttcttcaccagcgtgcccggcggcagagagaaggaggagagcccccagcccagaagaaagagacagcccagcagcagcagcgaggacagcgacgaggagtggagaagatgcagagaggccgccgtgagcgccagcgacatcctgcaggagagcgccatccacagccccggcaccgtggagaaggaggccaagaagaagagaaagctgaagaagaaggccaagaaggtggccagcgtggacagcgccgtggccgccaccacccccaccagcatggccaccgtgcagaagcagaagagcggcgagctgaacggcgaccaggtgagcctgggcaccaagaagaagaagaaggccaagaaggccagcgagaccagccccttcccccccgccaagagcgccaccgccatccccgccaactag

SEQ ID NO: 76794 - DNA, 666 bp, Artificial Sequence
  Description of Artificial Sequence: Synthetic coding sequence
atgttctgccagaaccccggcgccgccaacagccagctgagcaccagccagcccagcctgagacacaaggtgaacgagcacgagcaggacggcaacgagctgcagaccacccccgagttcagagcccacgtggccaagaagctgggcgccctgctggacagcttcatcaccatcagcgaggccgccaaggagcccgccaaggccaaggtgcagaaggtggccctggaggacgacggcttcagactgttcttcaccagcgtgcccggcggcagagagaaggaggagagcccccagcccagaagaaagagacagcccagcagcagcagcagcgaggacagcgacgaggagtggagaagatgcagagaggccgccgtgagcgccagcgacatcctgcaggagagcgccatccacagccccggcaccgtggagaaggaggccaagaagaagagaaagctgaagaagaaggccaagaaggtggccagcgtggacagcgccgtggccgccaccacccccaccagcatggccaccgtgcagaagcagaagagcggcgagctgaacggcgaccaggtgagcctgggcaccaagaagaagaagaaggccaagaaggccagcgagaccagccccttcccccccgccaagagcgccaccgccatccccgccaactag

SEQ ID NO: 76795 - DNA, 699 bp, Artificial Sequence
  Description of Artificial Sequence: Synthetic coding sequence
atgcccgcctggggcctggagcagagaccccacgtggccggcaagcccagagccggcgccgccaacagccagctgagcaccagccagcccagcctgagacacaaggtgaacgagcacgagcaggacggcaacgagctgcagaccacccccgagttcagagcccacgtggccaagaagctgggcgccctgctggacagcttcatcaccatcagcgaggccgccaaggagcccgccaaggccaaggtgcagaaggtggccctggaggacgacggcttcagactgttcttcaccagcgtgcccggcggcagagagaaggaggagagcccccagcccagaagaaagagacagcccagcagcagcagcgaggacagcgacgaggagtggagaagatgcagagaggccgccgtgagcgccagcgacatcctgcaggagagcgccatccacagccccggcaccgtggagaaggaggccaagaagaagagaaagctgaagaagaaggccaagaaggtggccagcgtggacagcgccgtggccgccaccacccccaccagcatggccaccgtgcagaagcagaagagcggcgagctgaacggcgaccaggtgagcctgggcaccaagaagaagaagaaggccaagaaggccagcgagaccagccccttcccccccgccaagagcgccaccgccatccccgccaactag

SEQ ID NO: 76796 - DNA, 1497 bp, Artificial Sequence
  Description of Artificial Sequence: Synthetic coding sequence
atggacgtgaccgaccactacgaggacgtgagaaagatctacgacgacttcctgaagaacagcaacatgctggacctgatcgacgtgtaccagaagtgcagagccctgaccagcaactgcgagaactacaacaccgtgagccccagccagctgctggacttcctgagcggcaagcagtacgccgtgggcgacgagaccgacctgagcatccccaccagccccaccagcaagtacaacagagacaacgagaaggtgcagctgctggccagaaagatcatcttcagctacctgaacctgctggtgaacagcaagaacgacctggccgtggcctacatcctgaacatccccgacagaggcctgggcagagaggccttcaccgacctgaagcacgccgccagagagaagcagatgagcatcttcctggtggccaccagcttcatcagaaccatcgagctgggcggcaagggctacgcccccccccccagcgaccccctgagaacccacgtgaagggcctgagcaacttcatcaacttcatcgacaagctggacgagatcctgggcgagatccccaaccccagcatcgccggcggccagatcctgagcgtgatcaagatgcagctgatcaagggccagaacagcagagaccccttctgcaaggccatcgaggaggtggcccaggacctggacctgagaatcaagaacatcatcaacagccaggagggcgtggtggccctgagcaccaccgacatcagccccgccagacccaagagccacgccatcaaccacggcaccgcctactgcggcagagacaccgtgaaggccctgctggtgctgctggacgaggaggccgccaacgcccccaccaagaacaaggccgagctgctgtacgacgaggagaacaccatccaccaccacggcaccagcatcctgaccctgttcagaagccccacccaggtgaacaacagcatcaagcccctgagagagagaatctgcgtgagcatgcaggagaagaagatcaagatgaagcagaccctgatcagaagccagttcgcctgcacctacaaggacgactacatgatcagcaaggacaactggaacaacgtgaacctggccagcaagcccctgtgcgtgctgtacatggagaacgacctgagcgagggcgtgaaccccagcgtgggcagaagcaccatcggcaccagcttcggcaacgtgcacctggacagaagcaagaacgagaaggtgagcagaaagagcaccagccagaccggcaacaagagcagcaagagaaagcaggtggacctggacggcgagaacatcctgtgcgacaacagaaacgagcccccccagcacaagaacgccaagatccccaagaagagcaacgacagccagaacagactgtacggcaagctggccaaggtggccaagagcaacaagtgcaccgccaaggacaagctgatcagcggccaggccaagctgacccagttcttcagactgtag

SEQ ID NO: 76797 - DNA, 1740 bp, Artificial Sequence
  Description of Artificial Sequence: Synthetic coding sequence
atggccgtgttcaaccagaagagcgtgagcgacatgatcaaggagttcagaaagaactggagagccctgtgcaacagcgagagaaccaccctgtgcggcgccgacagcatgctgctggccctgcagctgagcatggccgagaacaacaagcagcacagcggcgagttcaccgtgagcctgagcgacgtgctgctgacctggaagtacctgctgcacgagaagctgaacctgcccgtggagaacatggacgtgaccgaccactacgaggacgtgagaaagatctacgacgacttcctgaagaacagcaacatgctggacctgatcgacgtgtaccagaagtgcagagccctgaccagcaactgcgagaactacaacaccgtgagccccagccagctgctggacttcctgagcggcaagcagtacgccgtgggcgacgagaccgacctgagcatccccaccagccccaccagcaagtacaacagagacaacgagaaggtgcagctgctggccagaaagatcatcttcagctacctgaacctgctggtgaacagcaagaacgacctggccgtggcctacatcctgaacatccccgacagaggcctgggcagagaggccttcaccgacctgaagcacgccgccagagagaagcagatgagcatcttcctggtggccaccagcttcatcagaaccatcgagctgggcggcaagggctacgcccccccccccagcgaccccctgagaacccacgtgaagggcctgagcaacttcatcaacttcatcgacaagctggacgagatcctgggcgagatccccaaccccagcatcgccggcggccagatcctgagcgtgatcaagatgcagctgatcaagggccagaacagcagagaccccttctgcaaggccatcgaggaggtggcccaggacctggacctgagaatcaagaacatcatcaacagccaggagggcgtggtggccctgagcaccaccgacatcagccccgccagacccaagagccacgccatcaaccacggcaccgcctactgcggcagagacaccgtgaaggccctgctggtgctgctggacgaggaggccgccaacgcccccaccaagaacaaggccgagctgctgtacgacgaggagaacaccatccaccaccacggcaccagcatcctgaccctgttcagaagccccacccaggtgaacaacagcatcaagcccctgagagagagaatctgcgtgagcatgcaggagaagaagatcaagatgaagcagaccctgatcagaagccagttcgcctgcacctacaaggacgactacatgatcagcaaggacaactggaacaacgtgaacctggccagcaagcccctgtgcgtgctgtacatggagaacgacctgagcgagggcgtgaaccccagcgtgggcagaagcaccatcggcaccagcttcggcaacgtgcacctggacagaagcaagaacgagaaggtgagcagaaagagcaccagccagaccggcaacaagagcagcaagagaaagcaggtggacctggacggcgagaacatcctgtgcgacaacagaaacgagcccccccagcacaagaacgccaagatccccaagaagagcaacgacagccagaacagactgtacggcaagctggccaaggtggccaagagcaacaagtgcaccgccaaggacaagctgatcagcggccaggccaagctgacccagttcttcagactgtag

SEQ ID NO: 76798 - DNA, 894 bp, Artificial Sequence
  Description of Artificial Sequence: Synthetic coding sequence
atggccgtgttcaaccagaagagcgtgagcgacatgatcaaggagttcagaaagaactggagagccctgtgcaacagcgagagaaccaccctgtgcggcgccgacagcatgctgctggccctgcagctgagcatggccgagaacaacaagcagcacagcggcgagttcaccgtgagcctgagcgacgtgctgctgacctggaagtacctgctgcacgagaagctgaacctgcccgtggagaacatggacgtgaccgaccactacgaggacgtgagaaagatctacgacgacttcctgaagaacagcaacatgctggacctgatcgacgtgtaccagaagtgcagagccctgaccagcaactgcgagaactacaacaccgtgagccccagccagctgctggacttcctgagcggcaagcagtacgccgtgggcgacgagaccgacctgagcatccccaccagccccaccagcaagtacaacagagacaacgagaaggtgcagctgctggccagaaagatcatcttcagctacctgaacctgctggtgaacagcaagaacgacctggccgtggcctacatcctgaacatccccgacagaggcctgggcagagaggccttcaccgacctgaagcacgccgccagagagaagcagatgagcatcttcctggtggccaccagcttcatcagaaccatcgagctgggcggcaagggctacgcccccccccccagcgaccccctgagaacccacgtgaagggcctgagcaacttcatcaacttcatcgacaagctggacgagatcctgggcgagatccccaaccccagaggctgcaagagcatctgctggaagatcaacaactggaacgagttctggaagtgcagcagcggccagaagtag

SEQ ID NO: 76799 - DNA, 1497 bp, Artificial Sequence; identical to SEQ ID NO: 76796
  Description of Artificial Sequence: Synthetic coding sequence

SEQ ID NO: 76800 - DNA, 813 bp, Artificial Sequence
  Description of Artificial Sequence: Synthetic coding sequence
atggccagattcgccctgaccgtggtgagacacggcgagaccagattcaacaaggagaagatcatccagggccagggcgtggacgagcccctgagcgagaccggcttcaagcaggccgccgccgccggcatcttcctgaacaacgtgaagttcacccacgccttcagcagcgacctgatgagaaccaagcagaccatgcacggcatcctggagagaagcaagttctgcaaggacatgaccgtgaagtacgacagcagactgagagagagaaagtacggcgtggtggagggcaaggccctgagcgagctgagagccatggccaaggccgccagagaggagtgccccgtgttcaccccccccggcggcgagaccctggaccaggtgaagatgagaggcatcgacttcttcgagttcctgtgccagctgatcctgaaggaggccgaccagaaggagcagttcagccagggcagccccagcaactgcctggagaccagcctggccgagatcttccccctgggcaagaaccacagcagcaaggtgaacagcgacagcggcatccccggcctggccgccagcgtgctggtggtgagccacggcgcctacatgagaagcctgttcgactacttcctgaccgacctgaagtgcagcctgcccgccaccctgagcagaagcgagctgatgagcgtgacccccaacaccggcatgagcctgttcatcatcaacttcgaggagggcagagaggtgaagcccaccgtgcagtgcatctgcatgaacctgcaggaccacctgaacggcctgaccgagaccagatag

SEQ ID NO: 76801 - DNA, 501 bp, Artificial Sequence
  Description of Artificial Sequence: Synthetic coding sequence
atgagcaccgtgggcctgttccacttccccacccccctgaccagaatctgccccgccccctggggcctgagactgtgggagaagctgaccctgctgagccccggcatcgccgtgacccccgtgcagatggccggcaagaaggactaccccgccctgctgagcctggacgagaacgagctggaggagcagttcgtgaagggccacggccccggcggccaggccaccaacaagaccagcaactgcgtggtgctgaagcacatccccagcggcatcgtggtgaagtgccaccagaccagaagcgtggaccagaacagaaagctggccagaaagatcctgcaggagaaggtggacgtgttctacaacggcgagaacagccccgtgcacaaggagaagagagaggccgccaagaagaagcaggagagaaagaagagagccaaggagaccctggagaagaagaagctgctgaaggagctgtgggagagcagcaagaaggtgcactag

SEQ ID NO: 76802 - DNA, 501 bp, Artificial Sequence; identical to SEQ ID NO: 76801
  Description of Artificial Sequence: Synthetic coding sequence

SEQ ID NO: 76803 - DNA, 501 bp, Artificial Sequence; identical to SEQ ID NO: 76801
  Description of Artificial Sequence: Synthetic coding sequence

SEQ ID NO: 76804 - DNA, 111 bp, Artificial Sequence
  Description of Artificial Sequence: Synthetic coding sequence
atgagcaccgtgggcctgttccacttccccacccccctgaccagaatctgccccgccccctggggcctgagactgtgggagaagctgaccctgctgagccccggcatctag

SEQ ID NO: 76805 - DNA, 417 bp, Artificial Sequence
  Description of Artificial Sequence: Synthetic coding sequence
atgagcaccgtgggcctgttccacttccccacccccctgaccagaatctgccccgccccctggggcctgagactgtgggagaagctgaccctgctgagccccggcatcgccgtgacccccgtgcagatggccggcaagaaggactaccccgccctgctgagcctggacgagaacgagctggaggagcagttcgtgaagggccacggccccggcggccaggccaccaacaagaccagcaactgcgtggtgctgaagcacatccccagcggcatcgtggtgaagtgccaccagaccagaagcgtggaccagaacagaaagctggccagaaagatcctgcaggagaaggtggacgtgttctacaacggcgagaacagccccgtgcacaaggagaagagagaggccgccaagaagaagtag

SEQ ID NO: 76806 - DNA, 291 bp, Artificial Sequence
  Description of Artificial Sequence: Synthetic coding sequence
atgagcaccgtgggcctgttccacttccccacccccctgaccagaatctgccccgccccctggggcctgagactgtgggagaagctgaccctgctgagccccggcatcgccgtgacccccgtgcagatggccggcaagaaggactaccccgccctgctgagcctggacgagaacgagctggaggagcagttcgtgaagggccacggccccggcggccaggccaccaacaagaccagcaactgcgtggtgctgaagcacatccccagcggcatcgtggtgaaggtggactag

SEQ ID NO: 76807 - DNA, 423 bp, Artificial Sequence
  Description of Artificial Sequence: Synthetic coding sequence
atgagcagattcctgaacgtgctgagaagctggctggtgatggtgagcatcatcgccatgggcaacaccctgcagagcttcagagaccacaccttcctgtacgagaagctgtacaccggcaagcccaacctggtgaacggcctgcaggccagaaccttcggcatctggaccctgctgagcagcgtgatcagatgcctgtgcgccatcgacatccacaacaagaccctgtaccacatcaccctgtggaccttcctgctggccctgggccacttcctgagcgagctgttcgtgtacggcaccgccgcccccaccatcggcgtgctggcccccctgatggtggccagcttcagcatcctgggcatgctggtgggcctgagatacctggaggtggagcccgtgagcagacagaagaagagaaactag

SEQ ID NO: 76808 - DNA, 1443 bp, Artificial Sequence
  Description of Artificial Sequence: Synthetic coding sequence
atgaacagaaccaagggcgacgaggaggagtactggaacagcagcaagttcaaggccttcaccttcgacgacgaggacgacgagctgagccagctgaaggagagcaagagagccgtgaacagcctgagagacttcgtggacgacgacgacgacgacgacctggagagagtgagctggagcggcgagcccgtgggcagcatcagctggagcatcagagagaccgccggcaacagcggcagcacccacgagggcagagagcagctgaagagcagaaacagcttcagcagctacgcccagctgcccaagcccaccagcacctacagcctgagcagcttcttcagagccctgagcgacacccccgccaagagctacgcccccgagctgggcagacccaagggcgagtacagagactacagcaacgactggagccccagcgacaccgtgagaagactgagaaagggcaaggtgtgcagcctggagagattcagaagcctgcaggacaagctgcagctgctggaggaggccgtgagcatgcacgacggcaacgtgatcaccgccgtgctgatcttcctgaagagaaccctgagcaaggagatcctgttcagagagctggaggtgagacaggtggccctgagacacctgatccacttcctgaaggagatcggcgaccagaagctgctgctggacctgttcagattcctggacagaaccgaggagctggccctgagccactacagagagcacctgaacatccaggaccccgacaagagaaaggagttcctgaagacctgcgtgggcctgcccttcagcgccgaggacagcgcccacatccaggaccactacaccctgctggagagacagatcatcatcgaggccaacgacagacacctggagagcgccggccagaccgagatcttcagaaagcaccccagaaaggccagcatcctgaacatgcccctggtgaccaccctgttctacagctgcttctaccactacaccgaggccgagggcaccttcagcagccccgtgaacctgaagaagaccttcaagatccccgacaagcagtacgtgctgaccgccctggccgccagagccaagctgagagcctggaacgacgtggacgccctgttcaccaccaagaactggctgggctacaccaagaagagagcccccatcggcttccacagagtggtggagatcctgcacaagaacaacgcccccgtgcagatcctgcaggagtacgtgaacctggtggaggacgtggacaccaagctgaacctggccaccaagttcaagtgccacgacgtggtgatcgacacctacagagacctgaaggacagacagcagctgctggcctacagaagcaaggtggacaagggcagcgccgaggaggagaagatcgacgccctgctgagcagcagccagatcagatggaagaactag

SEQ ID NO: 76809 - DNA, 1482 bp, Artificial Sequence
  Description of Artificial Sequence: Synthetic coding sequence
atgaacagaaccaagggcgacgaggaggagtactggaacagcagcaagttcaaggccttcaccttcgacgacgaggacgacgagctgagccagctgaaggagagcaagagagccgtgaacagcctgagagacttcgtggacgacgacgacgacgacgacctggagagagtgagctggagcggcgagcccgtgggcagcatcagctggagcatcagagagaccgccggcaacagcggcagcacccacgagggcagagagcagctgaagagcagaaacagcttcagcagctacgcccagctgcccaagcccaccagcacctacagcctgagcagcttcttcagaggcagaaccagacccggcagcttccagagcctgagcgacgccctgagcgacacccccgccaagagctacgcccccgagctgggcagacccaagggcgagtacagagactacagcaacgactggagccccagcgacaccgtgagaagactgagaaagggcaaggtgtgcagcctggagagattcagaagcctgcaggacaagctgcagctgctggaggaggccgtgagcatgcacgacggcaacgtgatcaccgccgtgctgatcttcctgaagagaaccctgagcaaggagatcctgttcagagagctggaggtgagacaggtggccctgagacacctgatccacttcctgaaggagatcggcgaccagaagctgctgctggacctgttcagattcctggacagaaccgaggagctggccctgagccactacagagagcacctgaacatccaggaccccgacaagagaaaggagttcctgaagacctgcgtgggcctgcccttcagcgccgaggacagcgcccacatccaggaccactacaccctgctggagagacagatcatcatcgaggccaacgacagacacctggagagcgccggccagaccgagatcttcagaaagcaccccagaaaggccagcatcctgaacatgcccctggtgaccaccctgttctacagctgcttctaccactacaccgaggccgagggcaccttcagcagccccgtgaacctgaagaagaccttcaagatccccgacaagcagtacgtgctgaccgccctggccgccagagccaagctgagagcctggaacgacgtggacgccctgttcaccaccaagaactggctgggctacaccaagaagagagcccccatcggcttccacagagtggtggagatcctgcacaagaacaacgcccccgtgcagatcctgcaggagtacgtgaacctggtggaggacgtggacaccaagctgaacctggccaccaagttcaagtgccacgacgtggtgatcgacacctacagagacctgaaggacagacagcagctgctggcctacagaagcaaggtggacaagggcagcgccgaggaggagaagatcgacgccctgctgagcagcagccagatcagatggaagaactag

SEQ ID NO: 76810 - DNA, 1335 bp, Artificial Sequence
  Description of Artificial Sequence: Synthetic coding sequence
atgaacagaaccaagggcgacgaggaggagtactggaacagcagcaagttcaaggccttcaccttcgacgacgaggacgacgagctgagccagctgaaggagagcaagagagccgtgaacagcctgagagacttcgtggacgacgacgacgacgacgacctggagagagtgagctggagcggcgagcccgtgggcagcagaaccagacccggcagcttccagagcctgagcgacgccctgagcgacacccccgccaagagctacgcccccgagctgggcagacccaagggcgagtacagagactacagcaacgactggagccccagcgacaccgtgagaagactgagaaagggcaaggtgtgcagcctggagagattcagaagcctgcaggacaagctgcagctgctggaggaggccgtgagcatgcacgacggcaacgtgatcaccgccgtgctgatcttcctgaagagaaccctgagcaaggagatcctgttcagagagctggaggtgagacaggtggccctgagacacctgatccacttcctgaaggagatcggcgaccagaagctgctgctggacctgttcagattcctggacagaaccgaggagctggccctgagccactacagagagcacctgaacatccaggaccccgacaagagaaaggagttcctgaagacctgcgtgggcctgcccttcagcgccgaggacagcgcccacatccaggaccactacaccctgctggagagacagatcatcatcgaggccaacgacagacacctggagagcgccggccagaccgagatcttcagaaagcaccccagaaaggccagcatcctgaacatgcccctggtgaccaccctgttctacagctgcttctaccactacaccgaggccgagggcaccttcagcagccccgtgaacctgaagaagaccttcaagatccccgacaagcagtacgtgctgaccgccctggccgccagagccaagctgagagcctggaacgacgtggacgccctgttcaccaccaagaactggctgggctacaccaagaagagagcccccatcggcttccacagagtggtggagatcctgcacaagaacaacgcccccgtgcagatcctgcaggagtacgtgaacctggtggaggacgtggacaccaagctgaacctggccaccaagttcaagtgccacgacgtggtgatcgacacctacagagacctgaaggacagacagcagctgctggcctacagaagcaaggtggacaagggcagcgccgaggaggagaagatcgacgccctgctgagcagcagccagatcagatggaagaactag

SEQ ID NO: 76811 - DNA, 1482 bp, Artificial Sequence; identical to SEQ ID NO: 76809
  Description of Artificial Sequence: Synthetic coding sequence

SEQ ID NO: 76812 - DNA, 1560 bp, Artificial Sequence
  Description of Artificial Sequence: Synthetic coding sequence
atgaccaccggcctgatcctgttcttccagagcggcagacccctgggcgccggcgtgagactgggcctgggcctgagaatgaacagaaccaagggcgacgaggaggagtactggaacagcagcaagttcaaggccttcaccttcgacgacgaggacgacgagctgagccagctgaaggagagcaagagagccgtgaacagcctgagagacttcgtggacgacgacgacgacgacgacctggagagagtgagctggagcggcgagcccgtgggcagcatcagctggagcatcagagagaccgccggcaacagcggcagcacccacgagggcagagagcagctgaagagcagaaacagcttcagcagctacgcccagctgcccaagcccaccagcacctacagcctgagcagcttcttcagaggcagaaccagacccggcagcttccagagcctgagcgacgccctgagcgacacccccgccaagagctacgcccccgagctgggcagacccaagggcgagtacagagactacagcaacgactggagccccagcgacaccgtgagaagactgagaaagggcaaggtgtgcagcctggagagattcagaagcctgcaggacaagctgcagctgctggaggaggccgtgagcatgcacgacggcaacgtgatcaccgccgtgctgatcttcctgaagagaaccctgagcaaggagatcctgttcagagagctggaggtgagacaggtggccctgagacacctgatccacttcctgaaggagatcggcgaccagaagctgctgctggacctgttcagattcctggacagaaccgaggagctggccctgagccactacagagagcacctgaacatccaggaccccgacaagagaaaggagttcctgaagacctgcgtgggcctgcccttcagcgccgaggacagcgcccacatccaggaccactacaccctgctggagagacagatcatcatcgaggccaacgacagacacctggagagcgccggccagaccgagatcttcagaaagcaccccagaaaggccagcatcctgaacatgcccctggtgaccaccctgttctacagctgcttctaccactacaccgaggccgagggcaccttcagcagccccgtgaacctgaagaagaccttcaagatccccgacaagcagtacgtgctgaccgccctggccgccagagccaagctgagagcctggaacgacgtggacgccctgttcaccaccaagaactggctgggctacaccaagaagagagcccccatcggcttccacagagtggtggagatcctgcacaagaacaacgcccccgtgcagatcctgcaggagtacgtgaacctggtggaggacgtggacaccaagctgaacctggccaccaagttcaagtgccacgacgtggtgatcgacacctacagagacctgaaggacagacagcagctgctggcctacagaagcaaggtggacaagggcagcgccgaggaggagaagatcgacgccctgctgagcagcagccagatcagatggaagaactag

SEQ ID NO: 76813 - DNA, 138 bp, Artificial Sequence
  Description of Artificial Sequence: Synthetic coding sequence
atgaacagaaccaagggcgacgaggaggagtactggaacagcagcaagttcaaggccttcaccttcgacgacgaggacgacgagctgagccagctgaaggagagcaagagagccgtgaacagcctgagagacttctag

SEQ ID NO: 76814 - DNA, 1482 bp, Artificial Sequence; identical to SEQ ID NO: 76809
  Description of Artificial Sequence: Synthetic coding sequence

SEQ ID NO: 76815 - DNA, 735 bp, Artificial Sequence
  Description of Artificial Sequence: Synthetic coding sequence
atgttcagaagaaagctgaccgccctggactaccacaaccccgccggcttcaactgcaaggacgagaccgagttcagaaacttcatcgtgtggctggaggaccagaagatcagacactacaagatcgaggacagaggcaacctgagaaacatccacagcagcgactggcccaagttcttcgagaagtacctgagagacgtgaactgccccttcaagatccaggacagacaggaggccatcgactggctgctgggcctggccgtgagactggagtacggcgacaacgccgagaagtacaaggacctggtgcccgacaacagcaagaccgccgacaacgccaccaagaacgccgagcccctgatcaacctggacgtgaacaaccccgacttcaaggccggcgtgatggccctggccaacctgctgcagatccagagacacgacgactacctggtgatgctgaaggccatcagaatcctggtgcaggagagactgacccaggacgccgtggccaaggccaaccagaccaaggagggcctgcccgtggccctggacaagcacatcctgggcttcgacaccggcgacgccgtgctgaacgaggccgcccagatcctgagactgctgcacatcgaggagctgagagagctgcagaccaagatcaacgaggccatcgtggccgtgcaggccatcatcgccgaccccaagaccgaccacagactgggcaaggtgggcagatag

SEQ ID NO: 76816 - DNA, 177 bp, Artificial Sequence
  Description of Artificial Sequence: Synthetic coding sequence
atgctgcagagcatcatcaagaacatctggatccccatgaagccctactacaccaaggtgtaccaggagatctggatcggcatgggcctgatgggcttcatcgtgtacaagatcagagccgccgacaagagaagcaaggccctgaaggccagcgcccccgcccccggccaccactag

SEQ ID NO: 76817 - DNA, 228 bp, Artificial Sequence
  Description of Artificial Sequence: Synthetic coding sequence
atgaagctgtacggcaccagaggcagcgacatcagccacttccagtgccagatgctgcagagcatcatcaagaacatctggatccccatgaagccctactacaccaaggtgtaccaggagatctggatcggcatgggcctgatgggcttcatcgtgtacaagatcagagccgccgacaagagaagcaaggccctgaaggccagcgcccccgcccccggccaccactag

SEQ ID NO: 76818 - DNA, 177 bp, Artificial Sequence; identical to SEQ ID NO: 76816
  Description of Artificial Sequence: Synthetic coding sequence

SEQ ID NO: 76819 - DNA, 177 bp, Artificial Sequence; identical to SEQ ID NO: 76816
  Description of Artificial Sequence: Synthetic coding sequence

SEQ ID NO: 76820 - DNA, 2928 bp, Artificial Sequence
  Description of Artificial Sequence: Synthetic coding sequence
atgacccagcagccccaggacgacttcgacagaagcgtggaggacgcccaggcctggatgaaggccgtgcaggaccagctgcaggtgaacgacaacacccagggccccagagccgccctggaggccagactgtgggagaccgagaagatctgccagctggagcccgagggcagagtgagagtggacctggtgctgagaatggccgaggccctgctggcctgctgccccggcgaccagaagcccggcatcctggccagactgaaggacatcaaggcccagtgggaggagaccgtgacctacatgacccactgccacagcagaatcgagtgggtgtggctgcactggagcgagtacctgctggccagagacgagttctacagatggttccagaagatgatggtgaccctggagccccacatcgagctgcagctgggcctgaaggagaagcagtggcagctgagccacgcccaggtgctgctgcacaacgtggacaaccaggccgtgctgctggacagactgctggaggaggccgccagcctgttcaacagaatcggcgaccccagcgtggacgaggacgcccagaagagaatgaaggccgagtacgacgccgtgaaggccaaggcccagaagagagtggacctgctggagcaggtggccagagagcacgaggagtaccaggccggcgtggacgagttccagctgtggctgaaggccgtggtggagaaggtgaacggctgcctgggcagaaactgcaagctgcccatcacccagagactgagcaccctgcaggacatcgccaaggacttccccagaggcgaggagagcctggagaccctggaggagcagagcgccggcgtgatcagaaacaccagccccctgggcgccgagaagatcaccggcgagctggaggagatgagaaaggtgctggagaagctgagagccctgtgggaggaggaggaggagagactgagaggcctgctgagaagcagaggcgcctgggagcagcagatcaagcagctggaggccgagctgagcgagttcagaatggtgctgcagagactggcccaggagggcctgcagcccgccgccaaggccggcaccgaggacgagctggtggcccactggagaagatacagcgccaccagagccgccctggccagcgaggagcccagagtggacagactgcaggcccagctgaaggagctgatcgtgttcccccacaacctgaagcccctgagcgacagcgtgatcgccaccatccaggagtaccagagcctgaaggtgaagagcgccagactgagaaacgccgccgccgtggagctgtggcagcacttccagagacccctgcaggacctgcagctgtggaaggccctggcccagagactgctggaggtgaccgccagcctgcccgacctgcccagcctgcacaccttcctgccccagatcgaggccgccctgatggagagcagcagactgaaggagctgctgaccatgctgcagctgaagaaggacctgctgatcggcatcttcggccaggagagagccaccgccctgctggagcaggtggccggcagcatgagagacagagacctgctgcacaacagcctgctgcagagaaagagcaagctgcagagcctgctggcccagcacaaggacttcggcgccgccttcgagcccctgcagagaaagctgctggacctgcaggtgagagtgcaggccgagaagggcctgcagagagacctgcccggcaagcaggcccagctgagcagactgcagggcctgcaggaggagggcctggacctgggcgcccagatggaggccgccagacccctggtgcaggagaaccccaaccaccagcacaagatggaccagctgagcagcgacttccaggccctgcagagaagcctggaggacctggtggacagatgcagacagagcgtgcaggagcactgcaccttcagccaccagctgctggagctgagacagtggatcgtggtgaccacccagaagctggaggcccacagaggcgaggccggccccggcgacgccgagagccaggaggccgagttcgagagactggtggccgagttccccgagaaggaggcccagctgagcctggtggaggcccagggctggctggtgatggagaagagcagccccgagggcgccgccgtggtgcaggaggagctgagagagctggccgagagctggagagccctgagactgctggaggagagcctgctgagcctgatcagaaactggcacctgcagagaatggaggtggacagcggcaagaagatggtgttcaccaacaacatccccaagagcggcttcctgatcaaccccatggaccccatccccagacacagaagaagagccaacctgctgcaggaggaggagggcagccacgaggacttcagccagctgctgagaaacttcggccagtggctgcaggtggagaacagcaagctggtgagaatcatcgccatgagaaccagcaccgccgaggacctgagaaccagaaagagcaagctgcaggagctggaggccagagtgcccgagggccagcacctgttcgagaacctgctgagactgggccccgccagaggcaccagcgacgagctggaggacctgagataccagtggatgctgtacaagagcaagctgaaggacagcggccacctgctgacccagagcagccccggcgagcccaccggcttccagaagaccagaagatggagaggcctgggcagcctgttcagaagagcctgctgcgtggccctgcccctgcagctgctgctgctgctgttcctgctgctgctgttcctgctgcccatcagagaggaggacagaagctgcaccctggccaacaacttcgccagaagcttcaccctgatgctgagatacaacggccccccccccacctag

SEQ ID NO: 76821 - DNA, 1791 bp, Artificial Sequence
  Description of Artificial Sequence: Synthetic coding sequence
atgacccagcagccccaggacgacttcgacagaagcgtggaggacgcccaggcctggatgaaggccgtgcaggaccagctgcaggtgaacgacaacacccagggccccagagccgccctggaggccagactgtgggagaccgagaagatctgccagctggagcccgagggcagagtgagagtggacctggtgctgagaatggccgaggccctgctggcctgctgccccggcgaccagaagcccggcatcctggccagactgaaggacatcaaggcccagtgggaggagaccgtgacctacatgacccactgccacagcagaatcgagtgggtgtggctgcactggagcgagtacctgctggccagagacgagttctacagatggttccagaagatgatggtgaccctggagccccacatcgagctgcagctgggcctgaaggagaagcagtggcagctgagccacgcccaggtgctgctgcacaacgtggacaaccaggccgtgctgctggacagactgctggaggaggccgccagcctgttcaacagaatcggcgaccccagcgtggacgaggacgcccagaagagaatgaaggccgagtacgacgccgtgaaggccaaggcccagaagagagtggacctgctggagcaggtggccagagagcacgaggagtaccaggccggcgtggacgagttccagctgtggctgaaggccgtggtggagaaggtgaacggctgcctgggcagaaactgcaagctgcccatcacccagagactgagcaccctgcaggacatcgccaaggacttccccagaggcgaggagagcctggagaccctggaggagcagagcgccggcgtgatcagaaacaccagccccctgggcgccgagaagatcaccggcgagctggaggagatgagaaaggtgctggagaagctgagagccctgtgggaggaggaggaggagagactgagaggcctgctgagaagcagaggcgcctgggagcagcagatcaagcagctggaggccgagctgagcgagttcagaatggtgctgcagagactggcccaggagggcctgcagcccgccgccaaggccggcaccgaggacgagctggtggcccactggagaagatacagcgccaccagagccgccctggccagcgaggagcccagagtggacagactgcaggcccagctgaaggagctgatcgtgttcccccacaacctgaagcccctgagcgacagcgtgatcgccaccatccaggagtaccagagcctgaaggtgaagagcgccagactgagaaacgccgccgccgtggagctgtggcagcacttccagagacccctgcaggacctgcagctgtggaaggccctggcccagagactgctggaggtgaccgccagcctgcccgacctgcccagcctgcacaccttcctgccccagatcgaggccgccctgatggagagcagcagactgaaggagctgctgaccatgctgcagctgaagaaggacctgctgatcggcatcttcggccaggagagagccaccgccctgctggagcaggtggccggcagcatgagagacagagacctgctgcacaacagcctgctgcagagaaagagcaagctgcagagcctgctggcccagcacaaggacttcggcgccgccttcgagcccctgcagagaaagctgctggacctgcaggtgagagtgcaggccgagaagggcctgcagagagacctgcccggcaagcaggcccagctgagcagactgcaggtgagaggcctgtag

SEQ ID NO: 76822 - DNA, 2913 bp, Artificial Sequence
  Description of Artificial Sequence: Synthetic coding sequence
atgacccagcagccccaggacgacttcgacagaagcgtggaggacgcccaggcctggatgaaggccgtgcaggaccagctgcaggtgaacgacaacacccagggccccagagccgccctggaggccagactgtgggagaccgagaagatctgccagctggagcccgagggcagagtgagagtggacctggtgctgagaatggccgaggccctgctggcctgctgccccggcgaccagaagcccggcatcctggccagactgaaggacatcaaggcccagtgggaggagaccgtgacctacatgacccactgccacagcagaatcgagtgggtgtggctgcactggagcgagtacctgctggccagagacgagttctacagatggttccagaagatgatggtgaccctggagccccacatcgagctgcagctgggcctgaaggagaagcagtggcagctgagccacgcccaggtgctgctgcacaacgtggacaaccaggccgtgctgctggacagactgctggaggaggccgccagcctgttcaacagaatcggcgaccccagcgtggacgaggacgcccagaagagaatgaaggccgagtacgacgccgtgaaggccaaggcccagaagagagtggacctgctggagcaggtggccagagagcacgaggagtaccaggccggcgtggacgagttccagctgtggctgaaggccgtggtggagaaggtgaacggctgcctgggcagaaactgcaagctgcccatcacccagagactgagcaccctgcaggacatcgccaaggacttccccagaggcgaggagagcctggagaccctggaggagcagagcgccggcgtgatcagaaacaccagccccctgggcgccgagaagatcaccggcgagctggaggagatgagaaaggtgctggagaagctgagagccctgtgggaggaggaggaggagagactgagaggcctgctgagaagcagaggcgcctgggagcagcagatcaagcagctggaggccgagctgagcgagttcagaatggtgctgcagagactggcccaggagggcctgcagcccgccgccaaggccggcaccgaggacgagctggtggcccactggagaagatacagcgccaccagagccgccctggccagcgaggagcccagagtggacagactgcaggcccagctgaaggagctgatcgtgttcccccacaacctgaagcccctgagcgacagcgtgatcgccaccatccaggagtaccagagcctgaaggtgaagagcgccagactgagaaacgccgccgccgtggagctgtggcagcacttccagagacccctgcaggacctgcagctgtggaaggccctggcccagagactgctggaggtgaccgccagcctgcccgacctgcccagcctgcacaccttcctgccccagatcgaggccgccctgatggagagcagcagactgaaggagctgctgaccatgctgcagctgaagaaggacctgctgatcggcatcttcggccaggagagagccaccgccctgctggagcaggtggccggcagcatgagagacagagacctgctgcacaacagcctgctgcagagaaagagcaagctgcagagcctgctggcccagcacaaggacttcggcgccgccttcgagcccctgcagagaaagctgctggacctgcaggtgagagtgcaggccgagaagggcctgcagagagacctgcccggcaagcaggcccagctgagcagactgcagggcctgcaggaggagggcctggacctgggcgcccagatggaggccgccagacccctggtgcaggagaaccccaaccaccagcacaagatggaccagctgagcagcgacttccaggccctgcagagaagcctggaggacctggtggacagatgcagacagagcgtgcaggagcactgcaccttcagccaccagctgctggagctgagacagtggatcgtggtgaccacccagaagctggaggcccacagaggcgaggccggccccggcgacgccgagagccaggaggccgagttcgagagactggtggccgagttccccgagaaggaggcccagctgagcctggtggaggcccagggctggctggtgatggagaagagcagccccgagggcgccgccgtggtgcaggaggagctgagagagctggccgagagctggagagccctgagactgctggaggagagcctgctgagcctgatcagaaactggcacctgcagagaatggaggtggacagcggcaagaagatggtgttcaccaacaacatccccaagagcggcttcctgatcaaccccatggaccccatccccagacacagaagaagagaggaggagggcagccacgaggacttcagccagctgctgagaaacttcggccagtggctgcaggtggagaacagcaagctggtgagaatcatcgccatgagaaccagcaccgccgaggacctgagaaccagaaagagcaagctgcaggagctggaggccagagtgcccgagggccagcacctgttcgagaacctgctgagactgggccccgccagaggcaccagcgacgagctggaggacctgagataccagtggatgctgtacaagagcaagctgaaggacagcggccacctgctgacccagagcagccccggcgagcccaccggcttccagaagaccagaagatggagaggcctgggcagcctgttcagaagagcctgctgcgtggccctgcccctgcagctgctgctgctgctgttcctgctgctgctgttcctgctgcccatcagagaggaggacagaagctgcaccctggccaacaacttcgccagaagcttcaccctgatgctgagatacaacggccccccccccacctag

SEQ ID NO: 76823 - DNA, 3471 bp, Artificial Sequence
  Description of Artificial Sequence: Synthetic coding sequence
atgggcaacctgctgagcaagttcagacccggctgcagaagaagacccctgcccggccccggcagaggcgcccccgcccccctgagcagagacgccagcccccccggcagagcccacagcgtgcccacccccagacccttcagaggcctgttcagaagaaacgccagaagaagacccagcgccgccagcatcttcgtggcccccaagagaccctgccccctgcccagagccgccgccgcccccctgggcgtgctgcccgccgtgggctggggcctggccatcagaaagacccccatgctgcccgccagaaacccccccagattcggccaccccagcagcgtgagaatccccccccccagcagaatgttcaccctgctgctgcccagccccagagagcccgccgtgaaggccagaaagcccatccccgccaccctgctggaggagaccgaggtgtgggcccaggagggccccagaagagtgaagaaggacgaggaccccgtgcagatcgagggcgaggacgacgagaagagaacccccctgagcagcggcgaggccagcagcaccagcagaagccagggcacccagggcgacgtggccagcttcagatgcagccccggccccctggagggcaacgtgtaccacaagttcagcgagaacagcatgagcgagaaggcccaggccagccccgccagcagctgcctggagggccccgccatgcccagcacccacagccaggccggctgcgccagacacctgggcaagcccgaccccgacgccaccgccccccccgagcccgccgtgggctgcagcctgctgcagcagaagctggccgccgaggtgctgaacgaggagcccccccccagcagcctgggcctgcccatccccctgatgagcggcaagagaatgcccgacgagaagcccttctgcatcccccccagaagcgccgccccccccagagccgccagaaacagaccctgcaagagaaagatgagcatccccctgctgctgcccctgccccccagcctgcccctgctgtgggacagaggcgagctgcccccccccgccaagctgccctgcctgagcgtggagggcgacctgcacaccctggagaagagccccgagtacaagagaaacagcagaatcctggaggacaagaccgagaccatgaccaacagcagcatcacccagcccgcccccagcttcagccagcccgtgcagaccaccgacagcctgcccctgaccacctacaccagccaggtgagcgcccccctgcccatccccgacctggccgacctggccaccggccccctgatcctgcccatcccccccctgagcaccacccccaagatggacgagaagatcgccttcaccatccccaacagccccctggccctgcccgccgacctggtgcccatcctgggcgaccagagcaacgagaagggcggcagctacaacagcgtggtgggcgccgcccccctgaccagcgacccccccaccccccccagcagcacccccagcttcaagccccccgtgaccagagagagccccatcagcatgtgcgtggacagccccccccccctgagcttcctgaccctgctgcccgtgcccagcaccggcaccagcgtgatcaccagcaagcccatgaacagcaccagcgtgatcagcaccgtgaccaccaacgccagcgcccacctgaccagccagaccgccgtggaccccgaggtggtgaacatggacaccaccgcccccagccaggtggtgatcttcaccagcagcctgagcagcagagtgagcagcctgcccaacagccagatccactgcagcgccgagcagagacaccccggcaagaccagcgtgtacaccagccccctgcccttcatcttccacaacaccacccccagcttcaaccagctgttcggcaaggaggccaccccccagcccaagttcgaggcccccgacggccagccccagaaggccagcctgcccagcgcctgcgtgttcctgagcctgcccatcatccccccccccgacaccagcaccctggtgaacagcgccagcaccgccagcagcagcaagccccccatcgagaccaacgccatgcacaccaccccccccagcaaggccgtgatcctgcagagcgccagcgtgagcaagaagtacctgcccttctacctgggcctgcccggcagcggcaacacccagcccagcggcaacaccgccagcgtgcagggcagcaccagcctgcccgcccagagcgtgagagcccccgccaccgccagcaaccaccccctgaaccccggcgccaccccccagcccaagttcggcgcccccgacggcccccagcagaagaccagcctgcccagcgcccacgacttcctgagcctgcccatcatggtgccccccgacaccagcaccctggtgagcagcgccagcgccgccagcctgagcaagcccgccatcgacaccagcgacatgaacaccaccccccccagcaagaccgtgatcctgcagagcaccttcgtgagcagaaaggaggagtacatcagattctacatgggcctgcccggcagcggcaacaccctgcacagcgacagcatcgccagcgcccaggtgagcaccagcttccccgcccaggccgacagaagacccaccaccaccagcagccaccccctgaacaccggcagcatcagccacagcaccctgggcgccaccgacggccagcagaagagcgacagcagcttcatcctgggcaaccccgccacccccgcccccgtgatcggcctgaccagccccagcgtgcagcccctgagcggcagcatcatcccccccggcttcgccgagctgaccagcccctacaccgccctgggcacccccgtgaacgccgagcccgtggagggccacaacgccagcgccttccccaacggcaccgccaagaccagcggcttcagaatcgccaccggcatgcccggcaccggcgacagcaccctgctggtgggcaacaccatccccggcccccaggtgatcatgggccccggcacccccatggacggcggcagcatcggcttcagcatgagcgcccccggccccagcagcaccagcggcgagctgaacatcggccagggccagagcggcacccccagcaccaccagcgtgttccccttcggccaggccgcctgggaccccaccggccacagcatggccgccgccccccagggcgccagcaacatccccgtgttcggctacaccagcgccgccgcctacatccccggcctggacccccccacccagaacagctgcagcggcatgggcggcgacggcaccagaagcatcgtgggcggcccctgcgtgcccgccttccagcagtgcatcctgcagcacacctggaccgagagaaagttctacaccagcagcacccactactacggccaggagacctacgtgagaagacacgtgtgcttccagctgccctag

SEQ ID NO: 76824 - DNA, 5733 bp, Artificial Sequence
  Description of Artificial Sequence: Synthetic coding sequence
atggcctgctgccacaaggtgatgctgctgctggacaccgccggcggcgccgccagacacagcagagtgagaagagccgccctgagactgctgacctacctgagctgcagattcggcctggccagagtgcactgggccttcaagttcttcgacagccagggcgccagaagcagacccagcagagtgagcgacttcagagagctgggcagcagaagctgggaggacttcgaggaggagctggaggccagactggaggacagagcccacctgcccggccccgcccccagagccacccacacccacggcgccctgatggagaccctgctggactaccagtgggacagacccgagatcaccagccccaccaagcccatcctgagaagcagcggcagaagactgctggacgtggagagcgaggccaaggaggccgaggccgccctgggcggcctggtgaacgccgtgttcctgctggccccctgcccccacagccagagagagctgctgcagttcgtgagcggctgcgaggcccaggcccagagactgccccccacccccaagcaggtgatggagaagctgctgcccaagagagtgagagaggtgatggtggccagaaagatcaccttctactgggtggacaccaccgagtggagcaagctgtgggagagccccgaccacctgggctactggaccgtgtgcgagctgctgcaccacggcggcggcaccgtgctgcccagcgagagcttcagctgggacttcgcccaggccggcgagatgctgctgagaagcggcatcaagctgagcagcgagccccacctgagcccctggatcagcatgctgcccaccgacgccaccctgaacagactgctgtacaacagccccgagtacgaggccagcttccccagaatggagggcatgctgttcctgcccgtggaggccggcaaggagatccaggagacctggaccgtgaccctggagcccctggccatgcaccagagacacttccagaagcccgtgagaatcttcctgaagggcagcgtggcccagtggagcctgcccaccagcagcaccctgggcaccgacagctggatgctgggcagccccgaggagagcaccgccacccagagactgctgttccagcagctggtgagcagactgaccgccgaggagctgcacctggtggccgacgtggaccccggcgagggcagaccccccatcaccggcgtgatcagccccctgagcgccagcgccatgatcctgaccgtgtgcagaaccaaggaggccgagttccagagacacgtgctgcagaccgccgtggccgacagccccagagacaccgccagcctgttcagcgacgtggtggacagcatcctgaaccagacccacgacagcctggccgacaccgccagcgccgccagccccgtgcccgagtgggcccagcaggagctgggccacaccaccccctggagccccgccgtggtggagaagtggttccccttctgcaacatcagcggcgccagcagcgacctgatggagagcttcggcctgctgcaggccgccagcgccaacaaggaggagagcagcaagaccgagggcgagctgatccactgcctggccgagctgtaccagagaaagagcagagaggagagcaccatcgcccaccaggaggacagcaagaagaagagaggcgtgcccagaacccccgtgagacagaagatgaacaccatgtgcagaagcctgaagatgctgaacgtggccagactgaacgtgaaggcccagaagctgcaccccgacggcagccccgacgtggccggcgagaagggcatccagaagatccccagcggcagaaccgtggacaagctggaggacagaggcagaaccctgagaagcagcaagcccaaggacttcaagaccgaggaggagctgctgagctacatcagagagaactaccagaagaccgtggccaccggcgagatcatgctgtacgcctgcgccagaaacatgatcagcaccgtgaagatgttcctgaagagcaagggcaccaaggagctggaggtgaactgcctgaaccaggtgaagagcagcctgctgaagaccagcaagagcctgagacagaacctgggcaagaagctggacaaggaggacaaggtgagagagtgccagctgcaggtgttcctgagactggagatgtgcctgcagtgccccagcatcaacgagagcaccgacgacatggagcaggtggtggaggaggtgaccgacctgctgagaatggtgtgcctgaccgaggacagcgcctacctggccgagttcctggaggagatcctgagactgtacatcgacagcatccccaagaccctgggcaacctgtacaacagcctgggcttcgtgatcccccagaagctggccggcgtgctgcccaccgacttcttcagcgacgacagcatgacccaggagaacaagagccccctgctgagcgtgcccttcctgagcagcgccagaagaagcgtgagcggcagccccgagagcgacgagctgcaggagctgagaaccagaagcgccaagaagagaagaaagaacgccctgatcagacacaagagcatcgccgaggtgagccagaacctgagacagatcgagatccccaaggtgagcaagagagccaccaagaaggagaacagccaccccgccccccagcagcccagccagcccgtgaaggacaccgtgcaggaggtgaccaaggtgagaagaaacctgttcaaccaggagctgctgagccccagcaagagaagcctgaagagaggcctgcccagaagccacagcgtgagcgccgtggacggcctggaggacaagctggacaacttcaagaagaacaagggctaccacaagctgctgaccaagagcgtggccgagacccccgtgcacaagcagatcagcaagagactgctgcacagacagatcaagggcagaagcagcgaccccggccccgacatcggcgtggtggaggagagccccgagaagggcgacgagatcagcctgagaagaagccccagaatcaagcagctgagcttcagcagaacccacagcgccagcttctacagcgtgagccagcccaagagcagaagcgtgcagagagtgcacagcttccagcaggacaagagcgaccagagagagaacagccccgtgcagagcatcagaagccccaagagcctgctgttcggcgccatgagcgagatgatcagccccagcgagaagggcagcgccagaatgaagaagagaagcagaaacaccctggacagcgaggtgcccgccgcctaccagacccccaagaagagccaccagaagagcctgagcttcagcaagaccacccccagaagaatcagccacaccccccagacccccctgtacacccccgagagactgcagaagagccccgccaagatgacccccaccaagcaggccgccttcaaggagagcctgaaggacagcagcagccccggccacgacagccccctggacagcaagatcaccccccagaagagacacacccaggccggcgagggcaccagcctggagaccaagacccccagaacccccaagagacagggcacccagccccccggcttcctgcccaactgcacctggccccacagcgtgaacagcagccccgagagccccagctgccccgccccccccaccagcagcaccgcccagcccagaagagagtgcctgacccccatcagagaccccctgagaaccccccccagagccgccgccttcatgggcaccccccagaaccagacccaccagcagccccacgtgctgagagccgccagagccgaggagcccgcccagaagctgaaggacaaggccatcaagacccccaagagacccggcaacagcaccgtgaccagcagcccccccgtgacccccaagaagctgttcaccagccccctgtgcgacgtgagcaagaagagccccttcagaaagagcaagatcgagtgccccagccccggcgagctggaccagaaggagccccagatgagccccagcgtggccgccagcctgagctgccccgtgcccagcaccccccccgagctgagccagagagccaccctggacaccgtgcccccccccccccccagcaaggtgggcaagagatgcagaaagaccagcgaccccagaagaagcatcgtggagtgccagcccgacgccagcgccacccccggcgtgggcaccgccgacagccccgccgcccccaccgacagcagagacgaccagaagggcctgagcctgagcccccagagcccccccgagagaagaggctaccccggccccggcctgagaagcgactggcacgccagcagccccctgctgatcaccagcgacaccgagcacgtgaccctgctgagcgaggccgagcaccacggcatcggcgacctgaagagcaacgtgctgagcgtggaggagggcgagggcctgagaaccgccgacgccgagaagagcagcctgagccaccccggcatcccccccagcccccccagctgcggccccggcagccccctgatgcccagcagagacgtgcactgcaccaccgacggcagacagtgccaggccagcgcccagctggacaacctgcccgccagcgcctggcacagcaccgacagcgccagcccccagacctacgaggtggagctggagatgcaggccagcggcctgcccaagctgagaatcaagaagatcgaccccagcagcagcctggaggccgagcccctgagcaaggaggagagcagcctgggcgaggagagcttcctgcccgccctgagcatgcccagagccagcagaagcctgagcaagcccgagcccacctacgtgagccccccctgccccagactgagccacagcacccccggcaagagcagaggccagacctacatctgccaggcctgcacccccacccacggccccagcagcacccccagccccttccagaccgacggcgtgccctggacccccagccccaagcacagcggcaagaccacccccgacatcatcaaggactggcccagaagaaagagagccgtgggctgcggcgccggcagcagcagcggcagaggcgaggtgggcgccgacctgcccggcagcctgagcctgctggagagcgagggcaaggaccacggcctggagctgagcatccacagaacccccatcctggaggacttcgagctggagggcgtgtgccagctgcccgaccagagcccccccagaaacagcatgcccaaggccgaggaggccagcagctggggccagttcggcctgagcagcagaaagagagtgctgctggccaaggaggaggccgacagaggcgccaagagaatctgcgacctgagagaggacagcgaggtgagcaagagcaaggagggcagccccagctggagcgcctggcagctgcccagcaccggcgacgaggaggtgttcgtgagcggcagcacccccccccccagctgcgccgtgagaagctgcctgagcgccagcgccctgcaggccctgacccagagccccctgctgttccagggcaagacccccagcagccagagcaaggaccccagagacgaggacgtggacgtgctgcccagcaccgtggaggacagccccttcagcagagccttcagcagaagaagacccatcagcagaacctacaccagaaagaagctgatgggcacctggctggaggacctgtag

SEQ ID NO: 76825 - DNA, 354 bp, Artificial Sequence
  Description of Artificial Sequence: Synthetic coding sequence
atgaagctgagcagcgccgccggccaggagagccccggccacccccaccccagcccccccgcctggaccctgaagaagcccagcgagagcgtggcccagagagccatgtgcagcgccagagcctgccccgtggcctgccccgtgggctgccccatcgcctgccccgtgagctgccccgtggcctgccccgtgggctgccccgtgggcagcatggccaccgccccccagggcctgagcccccaggagtgggaggccgacagagagaccggcagcagcagccacgccggcaccacccagtgcagcatccacagccccagcagcagcagcagacacctgagcagaacccagacctag

SEQ ID NO: 76826 - DNA, 627 bp, Artificial Sequence; identical to SEQ ID NO: 76163
  Description of Artificial Sequence: Synthetic coding sequence

SEQ ID NO: 76827 - DNA, 765 bp, Artificial Sequence
  Description of Artificial Sequence: Synthetic coding sequence
atgagcctggccagaggccacggcgacaccgccgccagcaccgccgcccccctgagcgaggagggcgaggtgaccagcggcctgcaggccctggccgtggaggacaccggcggccccagcgccagcgccggcaaggccgaggacgagggcgagggcggcagagaggagaccgagagagagggcagcggcggcgaggaggcccagggcgaggtgcccagcgccggcggcgaggagcccgccgaggaggacagcgaggactggtgcgtgccctgcagcgacgaggaggtggagctgcccgccgacggccagccctggatgcccccccccagcgagatccagagactgtacgagctgctggccgcccacggcaccctggagctgcaggccgagatcctgcccagaagaccccccacccccgaggcccagagcgaggaggagagaagcgacgaggagcccgaggccaaggaggaggaggaggagaagccccacatgcccaccgagttcgacttcgacgacgagcccgtgacccccaaggacagcctgatcgacagaagaagaacccccggcagcagcgccagaagccagaagagagaggccagactggacaaggtgctgagcgacatgaagagacacaagaagctggaggagcagatcctgagaaccggcagagacctgttcagcctggacagcgaggaccccagccccgccagcccccccctgagaagcagcggcagcagcctgttccccagacagagaaagtactag

SEQ ID NO: 76828 - DNA, 2010 bp, Artificial Sequence
  Description of Artificial Sequence: Synthetic coding sequence
atgggcagcgaccccagcgcccccggcagacccggctggaccggcagcctgctgggcgacagagaggaggccgccagacccagactgctgcccctgctgctggtgctgctgggctgcctgggcctgggcgtggccgccgaggacgccgaggtgcacgccgagaactggctgagactgtacggctacctgccccagcccagcagacacatgagcaccatgagaagcgcccagatcctggccagcgccctggccgagatgcagagattctacggcatccccgtgaccggcgtgctggacgaggagaccaaggagtggatgaagagacccagatgcggcgtgcccgaccagttcggcgtgagagtgaaggccaacctgagaagaagaagaaagagatacgccctgaccggcagaaagtggaacaaccaccacctgaccttcagcatccagaactacaccgagaagctgggctggtaccacagcatggaggccgtgagaagagccttcagagtgtgggagcaggccacccccctggtgttccaggaggtgccctacgaggacatcagactgagaagacagaaggaggccgacatcatggtgctgttcgccagcggcttccacggcgacagcagccccttcgacggcaccggcggcttcctggcccacgcctacttccccggccccggcctgggcggcgacacccacttcgacgccgacgagccctggaccttcagcagcaccgacctgcacggcaacaacctgttcctggtggccgtgcacgagctgggccacgccctgggcctggagcacagcagcaaccccaacgccatcatggcccccttctaccagtggaaggacgtggacaacttcaagctgcccgaggacgacctgagaggcatccagcagctgtacggcacccccgacggccagccccagcccacccagcccctgcccaccgtgacccccagaagacccggcagacccgaccacagaccccccagacccccccagccccccccccccggcggcaagcccgagagaccccccaagcccggcccccccgtgcagcccagagccaccgagagacccgaccagtacggccccaacatctgcgacggcgacttcgacaccgtggccatgctgagaggcgagatgttcgtgttcaagggcagatggttctggagagtgagacacaacagagtgctggacaactaccccatgcccatcggccacttctggagaggcctgcccggcgacatcagcgccgcctacgagagacaggacggcagattcgtgttcttcaagggcgacagatactggctgttcagagaggccaacctggagcccggctacccccagcccctgaccagctacggcctgggcatcccctacgacagaatcgacaccgccatctggtgggagcccaccggccacaccttcttcttccaggaggacagatactggagattcaacgaggagacccagagaggcgaccccggctaccccaagcccatcagcgtgtggcagggcatccccgccagccccaagggcgccttcctgagcaacgacgccgcctacacctacttctacaagggcaccaagtactggaagttcgacaacgagagactgagaatggagcccggctaccccaagagcatcctgagagacttcatgggctgccaggagcacgtggagcccggccccagatggcccgacgtggccagaccccccttcaacccccacggcggcgccgagcccggcgccgacagcgccgagggcgacgtgggcgacggcgacggcgacttcggcgccggcgtgaacaaggacggcggcagcagagtggtggtgcagatggaggaggtggccagaaccgtgaacgtggtgatggtgctggtgcccctgctgctgctgctgtgcgtgctgggcctgacctacgccctggtgcagatgcagagaaagggcgcccccagagtgctgctgtactgcaagagaagcctgcaggagtgggtgtag

SEQ ID NO: 76829 - DNA, 561 bp, Artificial Sequence
  Description of Artificial Sequence: Synthetic coding sequence
atgagcgccgcccccctggtgggctacagcagcagcggcagcgaggacgagagcgaggacggcatgagaaccagacccggcgacggcagccacagaagaggccagagccccctgcccagacagagattccccgtgcccgacagcgtgctgaacatgttccccggcaccgaggagggccccgaggacgacagcaccaagcacggcggcagagtgagaaccttcccccacgagagaggcaactgggccacccacgtgtacgtgccctacgaggccaaggaggagttcctggacctgctggacgtgctgctgccccacgcccagacctacgtgcccagactggtgagaatgaaggtgttccacctgagcctgagccagagcgtggtgctgagacaccactggatcctgcccttcgtgcaggccctgaaggccagaatgaccagcttccacagcccccaccccggcccccactgcctgatcggcaccaaggacgcccccgtgacccaggagatccccaaggacctgggcgccctgagacaggagcccggcagccagaccagatag

SEQ ID NO: 76830 - DNA, 744 bp, Artificial Sequence
  Description of Artificial Sequence: Synthetic coding sequence
atgagcgccgcccccctggtgggctacagcagcagcggcagcgaggacgagagcgaggacggcatgagaaccagacccggcgacggcagccacagaagaggccagagccccctgcccagacagagattccccgtgcccgacagcgtgctgaacatgttccccggcaccgaggagggccccgaggacgacagcaccaagcacggcggcagagtgagaaccttcccccacgagagaggcaactgggccacccacgtgtacgtgccctacgaggccaaggaggagttcctggacctgctggacgtgctgctgccccacgcccagacctacgtgcccagactggtgagaatgaaggtgttccacctgagcctgagccagagcgtggtgctgagacaccactggatcctgcccttcgtgcaggccctgaaggccagaatgaccagcttccacagaaccttcatcggcctggaggtgaccagcggccacgcccagttcctggacctggtgagcgaggtggacagagtgatggaggagttcaacctgaccaccttctaccaggaccccagcttccacctgagcctggcctggtgcgtgggcgacgccagactgcagctggagggccagtgcctgcaggagctgcaggccatcgtggacggcttcgaggacgccgaggtgctgctgagagtgcacaccgagcaggtgagatgcaagagcggcaacaagttcttcagcatgcccctgaagtag

SEQ ID NO: 76831 - DNA, 642 bp, Artificial Sequence
  Description of Artificial Sequence: Synthetic coding sequence
atgagccccctgcccagacagagattccccgtgcccgacagcgtgctgaacatgttccccggcaccgaggagggccccgaggacgacagcaccaagcacggcggcagagtgagaaccttcccccacgagagaggcaactgggccacccacgtgtacgtgccctacgaggccaaggaggagttcctggacctgctggacgtgctgctgccccacgcccagagcgtggtgctgagacaccactggatcctgcccttcgtgcaggccctgaaggccagaatgaccagcttccacagattcttcttcaccgccaaccaggtgaagatctacaccaaccaggagaagaccagaaccttcatcggcctggaggtgaccagcggccacgcccagttcctggacctggtgagcgaggtggacagagtgatggaggagttcaacctgaccaccttctaccaggaccccagcttccacctgagcctggcctggtgcgtgggcgacgccagactgcagctggagggccagtgcctgcaggagctgcaggccatcgtggacggcttcgaggacgccgaggtgctgctgagagtgcacaccgagcaggtgagatgcaagagcggcaacaagttcttcagcatgcccctgaagtag

SEQ ID NO: 76832 - DNA, 1683 bp, Artificial Sequence
  Description of Artificial Sequence: Synthetic coding sequence
atgggcagcaccgacagcaagctgaacttcagaaaggccgtgatccagctgaccaccaagacccagcccgtggaggccaccgacgacgcctacgaccccgtgggctacggcatcccctacaaccacctgctgttcagcgactacagagagcccctggtggaggaggccgcccaggtgctgatcgtgaccctggaccacgacagcgccagcagcgccagccccaccgtggacggcaccaccaccggcaccgccatggacgacgccgacccccccggccccgagaacctgttcgtgaactacctgagcagaatccacagagaggaggacttccagttcatcctgaagggcatcgccagactgctgagcaaccccctgctgcagacctacctgcccaacagcaccaagaagatccagttccaccaggagctgctggtgctgttctggaagctgtgcgacttcaacaagaagttcctgttcttcgtgctgaagagcagcgacgtgctggacatcctggtgcccatcctgttcttcctgaacgacgccagagccgaccagagcagagtgggcctgatgcacatcggcgtgttcatcctgctgctgctgagcggcgagagaaacttcggcgtgagactgaacaagccctacagcatcagagtgcccatggacatccccgtgttcaccggcacccacgccgacctgctgatcgtggtgttccacaagatcatcaccagcggccaccagagactgcagcccctgttcgactgcctgctgaccatcgtggtgaacgtgagcccctacctgaagagcctgagcatggtgaccgccaacaagctgctgcacctgctggaggccttcagcaccacctggttcctgttcagcgccgcccagaaccaccacctggtgttcttcctgctggaggtgttcaacaacatcatccagtaccagttcgacggcaacagcaacctggtgtacgccatcatcagaaagagaagcatcttccaccagctggccaacctgcccaccgacccccccaccatccacaaggccctgcagagaagaagaagaacccccgagcccctgagcagaaccggcagccaggagggcaccagcatggagggcagcagacccgccgcccccgccgagcccggcaccctgaagaccagcctggtggccacccccggcatcgacaagctgaccgagaagagccaggtgagcgaggacggcaccctgagaagcctggagcccgagccccagcagagcctggaggacggcagccccgccaagggcgagcccagccaggcctggagagagcagagaagacccagcaccagcagcgccagcggccagtggagccccacccccgagtgggtgctgagctggaagagcaagctgcccctgcagaccatcatgagactgctgcaggtgctggtgccccaggtggagaagatctgcatcgacaagggcctgaccgacgagagcgagatcctgagattcctgcagcacggcaccctggtgggcctgctgcccgtgccccaccccatcctgatcagaaagtaccaggccaacagcggcaccgccatgtggttcagaacctacatgtggggcgtgatctacctgagaaacgtggacccccccgtgtggtacgacaccgacgtgaagctgttcgagatccagagagtgtag

SEQ ID NO: 76833 - DNA, 2367 bp, Artificial Sequence
  Description of Artificial Sequence: Synthetic coding sequence
atgggcagcaccgacagcaagctgaacttcagaaaggccgtgatccagctgaccaccaagacccagcccgtggaggccaccgacgacgccttctgggaccagttctgggccgacaccgccaccagcgtgcaggacgtgttcgccctggtgcccgccgccgagatcagagccgtgagagaggagagccccagcaacctggccaccctgtgctacaaggccgtggagaagctggtgcagggcgccgagagcggctgccacagcgagaaggagaagcagatcgtgctgaactgcagcagactgctgaccagagtgctgccctacatcttcgaggaccccgactggagaggcttcttctggagcaccgtgcccggcgccggcagaggcggccagggcgaggaggacgacgagcacgccagacccctggccgagagcctgctgctggccatcgccgacctgctgttctgccccgacttcaccgtgcagagccacagaagaagcaccgtggacagcgccgaggacgtgcacagcctggacagctgcgagtacatctgggaggccggcgtgggcttcgcccacagcccccagcccaactacatccacgacatgaacagaatggagctgctgaagctgctgctgacctgcttcagcgaggccatgtacctgccccccgcccccgagagcggcagcaccaacccctgggtgcagttcttctgcagcaccgagaacagacacgccctgcccctgttcaccagcctgctgaacaccgtgtgcgcctacgaccccgtgggctacggcatcccctacaaccacctgctgttcagcgactacagagagcccctggtggaggaggccgcccaggtgctgatcgtgaccctggaccacgacagcgccagcagcgccagccccaccgtggacggcaccaccaccggcaccgccatggacgacgccgacccccccggccccgagaacctgttcgtgaactacctgagcagaatccacagagaggaggacttccagttcatcctgaagggcatcgccagactgctgagcaaccccctgctgcagacctacctgcccaacagcaccaagaagatccagttccaccaggagctgctggtgctgttctggaagctgtgcgacttcaacaagaagttcctgttcttcgtgctgaagagcagcgacgtgctggacatcctggtgcccatcctgttcttcctgaacgacgccagagccgaccagagcagagtgggcctgatgcacatcggcgtgttcatcctgctgctgctgagcggcgagagaaacttcggcgtgagactgaacaagccctacagcatcagagtgcccatggacatccccgtgttcaccggcacccacgccgacctgctgatcgtggtgttccacaagatcatcaccagcggccaccagagactgcagcccctgttcgactgcctgctgaccatcgtggtgaacgtgagcccctacctgaagagcctgagcatggtgaccgccaacaagctgctgcacctgctggaggccttcagcaccacctggttcctgttcagcgccgcccagaaccaccacctggtgttcttcctgctggaggtgttcaacaacatcatccagtaccagttcgacggcaacagcaacctggtgtacgccatcatcagaaagagaagcatcttccaccagctggccaacctgcccaccgacccccccaccatccacaaggccctgcagagaagaagaagaacccccgagcccctgagcagaaccggcagccaggagggcaccagcatggagggcagcagacccgccgcccccgccgagcccggcaccctgaagaccagcctggtggccacccccggcatcgacaagctgaccgagaagagccaggtgagcgaggacggcaccctgagaagcctggagcccgagccccagcagagcctggaggacggcagccccgccaagggcgagcccagccaggcctggagagagcagagaagacccagcaccagcagcgccagcggccagtggagccccacccccgagtgggtgctgagctggaagagcaagctgcccctgcagaccatcatgagactgctgcaggtgctggtgccccaggtggagaagatctgcatcgacaagggcctgaccgacgagagcgagatcctgagattcctgcagcacggcaccctggtgggcctgctgcccgtgccccaccccatcctgatcagaaagtaccaggccaacagcggcaccgccatgtggttcagaacctacatgtggggcgtgatctacctgagaaacgtggacccccccgtgtggtacgacaccgacgtgaagctgttcgagatccagagagtgtag

SEQ ID NO: 76834 - DNA, 810 bp, Artificial Sequence
  Description of Artificial Sequence: Synthetic coding sequence
atgagcagcgaccacctgaacaacagcaccctgaaggaggcccagttcaaggacctgttcctgaagaaggccgagctggagttcgcccagatcatcatcatcgtggtggtggtgaccgtgatggtggtggtgatcgtgtgcctgctgaaccactacaaggtgagcaccagaagcttcatcaacagacccaaccagagcagaagaagagaggacggcctgccccaggagggctgcctgtggcccagcgacagcgccgcccccagactgggcgccagcgagatcatgcacgcccccagaagcagagacagattcaccgcccccagcttcatccagagagacagattcagcagattccagcccacctacccctacgtgcagcacgagatcgacctgccccccaccatcagcctgagcgacggcgaggagccccccccctaccagggcccctgcaccctgcagctgagagaccccgagcagcagatggagctgaacagagagagcgtgagagccccccccaacagaaccatcttcgacagcgacctgatcgacatcgccatgtacagcggcggcccctgcccccccagcagcaacagcggcatcagcgccagcacctgcagcagcaacggcagaatggagggccccccccccacctacagcgaggtgatgggccaccaccccggcgccagcttcctgcaccaccagagaagcaacgcccacagaggcagcagactgcagttccagcagaacaacgccgagagcaccatcgtgcccatcaagggcaaggacagaaagcccggcaacctggtgtag

SEQ ID NO: 76835 - DNA, 921 bp, Artificial Sequence
  Description of Artificial Sequence: Synthetic coding sequence
atgcccgaggccggcttccaggccaccaacgccttcaccgagtgcaagttcacctgcaccagcggcaagtgcctgtacctgggcagcctggtgtgcaaccagcagaacgactgcggcgacaacagcgacgaggagaactgcctgctggtgaccgagcaccccccccccggcatcttcaacagcgagctggagttcgcccagatcatcatcatcgtggtggtggtgaccgtgatggtggtggtgatcgtgtgcctgctgaaccactacaaggtgagcaccagaagcttcatcaacagacccaaccagagcagaagaagagaggacggcctgccccaggagggctgcctgtggcccagcgacagcgccgcccccagactgggcgccagcgagatcatgcacgcccccagaagcagagacagattcaccgcccccagcttcatccagagagacagattcagcagattccagcccacctacccctacgtgcagcacgagatcgacctgccccccaccatcagcctgagcgacggcgaggagccccccccctaccagggcccctgcaccctgcagctgagagaccccgagcagcagatggagctgaacagagagagcgtgagagccccccccaacagaaccatcttcgacagcgacctgatcgacatcgccatgtacagcggcggcccctgcccccccagcagcaacagcggcatcagcgccagcacctgcagcagcaacggcagaatggagggccccccccccacctacagcgaggtgatgggccaccaccccggcgccagcttcctgcaccaccagagaagcaacgcccacagaggcagcagactgcagttccagcagaacaacgccgagagcaccatcgtgcccatcaagggcaaggacagaaagcccggcaacctggtgtag

SEQ ID NO: 76836 - DNA, 747 bp, Artificial Sequence
  Description of Artificial Sequence: Synthetic coding sequence
atggccgccgagctggagttcgcccagatcatcatcatcgtggtggtggtgaccgtgatggtggtggtgatcgtgtgcctgctgaaccactacaaggtgagcaccagaagcttcatcaacagacccaaccagagcagaagaagagaggacggcctgccccaggagggctgcctgtggcccagcgacagcgccgcccccagactgggcgccagcgagatcatgcacgcccccagaagcagagacagattcaccgcccccagcttcatccagagagacagattcagcagattccagcccacctacccctacgtgcagcacgagatcgacctgccccccaccatcagcctgagcgacggcgaggagccccccccctaccagggcccctgcaccctgcagctgagagaccccgagcagcagatggagctgaacagagagagcgtgagagccccccccaacagaaccatcttcgacagcgacctgatcgacatcgccatgtacagcggcggcccctgcccccccagcagcaacagcggcatcagcgccagcacctgcagcagcaacggcagaatggagggccccccccccacctacagcgaggtgatgggccaccaccccggcgccagcttcctgcaccaccagagaagcaacgcccacagaggcagcagactgcagttccagcagaacaacgccgagagcaccatcgtgcccatcaagggcaaggacagaaagcccggcaacctggtgtag

SEQ ID NO: 76837 - DNA, 756 bp, Artificial Sequence
  Description of Artificial Sequence: Synthetic coding sequence
atgagcagcgaccacctgaacaacagcaccctgaaggaggcccagttcaaggacctgttcctgaagaaggccgagctggagttcgcccagatcatcatcatcgtggtggtggtgaccgtgatggtggtggtgatcgtgtgcctgctgaaccactacaaggtgagcaccagaagcttcatcaacagacccaaccagagcagaagaagagaggacggcctgccccagatcatgcacgcccccagaagcagagacagattcaccgcccccagcttcatccagagagacagattcagcagattccagcccacctacccctacgtgcagcacgagatcgacctgccccccaccatcagcctgagcgacggcgaggagccccccccctaccagggcccctgcaccctgcagctgagagaccccgagcagcagatggagctgaacagagagagcgtgagagccccccccaacagaaccatcttcgacagcgacctgatcgacatcgccatgtacagcggcggcccctgcccccccagcagcaacagcggcatcagcgccagcacctgcagcagcaacggcagaatggagggccccccccccacctacagcgaggtgatgggccaccaccccggcgccagcttcctgcaccaccagagaagcaacgcccacagaggcagcagactgcagttccagcagaacaacgccgagagcaccatcgtgcccatcaagggcaaggacagaaagcccggcaacctggtgtag

SEQ ID NO: 76838 - DNA, 867 bp, Artificial Sequence
  Description of Artificial Sequence: Synthetic coding sequence
atgcccgaggccggcttccaggccaccaacgccttcaccgagtgcaagttcacctgcaccagcggcaagtgcctgtacctgggcagcctggtgtgcaaccagcagaacgactgcggcgacaacagcgacgaggagaactgcctgctggtgaccgagcaccccccccccggcatcttcaacagcgagctggagttcgcccagatcatcatcatcgtggtggtggtgaccgtgatggtggtggtgatcgtgtgcctgctgaaccactacaaggtgagcaccagaagcttcatcaacagacccaaccagagcagaagaagagaggacggcctgccccagatcatgcacgcccccagaagcagagacagattcaccgcccccagcttcatccagagagacagattcagcagattccagcccacctacccctacgtgcagcacgagatcgacctgccccccaccatcagcctgagcgacggcgaggagccccccccctaccagggcccctgcaccctgcagctgagagaccccgagcagcagatggagctgaacagagagagcgtgagagccccccccaacagaaccatcttcgacagcgacctgatcgacatcgccatgtacagcggcggcccctgcccccccagcagcaacagcggcatcagcgccagcacctgcagcagcaacggcagaatggagggccccccccccacctacagcgaggtgatgggccaccaccccggcgccagcttcctgcaccaccagagaagcaacgcccacagaggcagcagactgcagttccagcagaacaacgccgagagcaccatcgtgcccatcaagggcaaggacagaaagcccggcaacctggtgtag

SEQ ID NO: 76839 - DNA, 693 bp, Artificial Sequence
  Description of Artificial Sequence: Synthetic coding sequence
atggccgccgagctggagttcgcccagatcatcatcatcgtggtggtggtgaccgtgatggtggtggtgatcgtgtgcctgctgaaccactacaaggtgagcaccagaagcttcatcaacagacccaaccagagcagaagaagagaggacggcctgccccagatcatgcacgcccccagaagcagagacagattcaccgcccccagcttcatccagagagacagattcagcagattccagcccacctacccctacgtgcagcacgagatcgacctgccccccaccatcagcctgagcgacggcgaggagccccccccctaccagggcccctgcaccctgcagctgagagaccccgagcagcagatggagctgaacagagagagcgtgagagccccccccaacagaaccatcttcgacagcgacctgatcgacatcgccatgtacagcggcggcccctgcccccccagcagcaacagcggcatcagcgccagcacctgcagcagcaacggcagaatggagggccccccccccacctacagcgaggtgatgggccaccaccccggcgccagcttcctgcaccaccagagaagcaacgcccacagaggcagcagactgcagttccagcagaacaacgccgagagcaccatcgtgcccatcaagggcaaggacagaaagcccggcaacctggtgtag

SEQ ID NO: 76840 - DNA, 1119 bp, Artificial Sequence
  Description of Artificial Sequence: Synthetic coding sequence
atggccaagagcaagaccaagcacagactgtgcagccaggagagcagcgtgagcgccctgctggccagctgcaccctgagcggcagcaacagcagcaacagcgacggcagcttccactacaaggacaagctgtacagaagcgccagccaggccctgcaggcctacatcgacgacttcgacctgggccagatctaccccggcgccagcaccggcaagatcaacatcgacgaggacttcaccaacatgagccagttctgcaactacatctacaagcccaacaacgccttcgagaacctggaccacaagaagcacagcaacttcatcagctgcagaagacacaccgtgaacgacatcgacagcatgagcctgaccaccgacgacctgctgagactgcccgccgacggcagcttcagctacacctacgtgggccccagccacagaaccagcaagaagaacaagaagtgcagaggcagactgggcagcctggacatcgagaagaacccccacttccagggcccctacaccagcatgggcaaggacaacttcgtgacccccgtgatcagaagcaacatcaacggcaagcagtgcggcgacaagatcgagctgctgatcctgaaggccaagagaaacctggagcagtgcaccgaggagctgcccaagagcatgaagaaggacgacagcccctgcagcctggacaagctggaggccgacagaagctgggagaacatccccgtgaccttcaagagccccgtgcccgtgaacagcgacgacagcccccagcagaccagcagagccaagagcgccaagggcgtgctggaggacttcctgaacaacgacaaccagagctgcaccctgagcggcggcaagcaccacggccccgtggaggccctgaagcagatgctgttcaacctgcaggccgtgcaggagagattcaaccagaacaagaccaccgaccccaaggaggagatcaagcaggtgagcgaggacgacttcagcaagctgcagctgaaggagagcatgatccccatcaccagaagcctgcagaaggccctgcaccacctgagcagactgagagacctggtggacgacaccaacggcgagagaagccccaagatgtag

SEQ ID NO: 76841 - DNA, 1602 bp, Artificial Sequence
  Description of Artificial Sequence: Synthetic coding sequence
atggccaagagcaagaccaagcacagactgtgcagccaggagagcagcgtgagcgccctgctggccagctgcaccctgagcggcagcaacagcagcaacagcgacggcagcttccactacaaggacaagctgtacagaagcgccagccaggccctgcaggcctacatcgacgacttcgacctgggccagatctaccccggcgccagcaccggcaagatcaacatcgacgaggacttcaccaacatgagccagttctgcaactacatctacaagcccaacaacgccttcgagaacctggaccacaagaagcacagcaacttcatcagctgcagaagacacaccgtgaacgacatcgacagcatgagcctgaccaccgacgacctgctgagactgcccgccgacggcagcttcagctacacctacgtgggccccagccacagaaccagcaagaagaacaagaagtgcagaggcagactgggcagcctggacatcgagaagaacccccacttccagggcccctacaccagcatgggcaaggacaacttcgtgacccccgtgatcagaagcaacatcaacggcaagcagtgcggcagactgaagaaccccaagctgatgaacagaaccaacaactgcatcagcgagagcagcctgagcttccccaagaagagcagcttcaaggacagcagcgagcacagcctggagaagaactaccccagatggctgaccagccagaagagcgacctgaacgtgagcggcatcaccagcatccccgacttcaagtaccccgtgtggctgcacaaccaggacctgctgcccgacgccaacagccagagagtgtaccagatcttcaaggacgaccagtgcagccccagacacagccaccaggcccagggcaccagcagactgatcaacaagctggactgcttcgagtacgccttcgagcccagcaacttcagcaacagcctgagcgacgacaaggagctggtgaacgagtacaagtgcgacttcgagcacagccagtgccagtgcgagaaccccctgctgcccggccagagcaccaagcccttcagcggcgacaagatcgagctgctgatcctgaaggccaagagaaacctggagcagtgcaccgaggagctgcccaagagcatgaagaaggacgacagcccctgcagcctggacaagctggaggccgacagaagctgggagaacatccccgtgaccttcaagagccccgtgcccgtgaacagcgacgacagcccccagcagaccagcagagccaagagcgccaagggcgtgctggaggacttcctgaacaacgacaaccagagctgcaccctgagcggcggcaagcaccacggccccgtggaggccctgaagcagatgctgttcaacctgcaggccgtgcaggagagattcaaccagaacaagaccaccgaccccaaggaggagatcaagcaggtgagcgaggacgacttcagcaagctgcagctgaaggagagcatgatccccatcaccagaagcctgcagaaggccctgcaccacctgagcagactgagagacctggtggacgacaccaacggcgagagaagccccaagatgtag

SEQ ID NO: 76842 - DNA, 522 bp, Artificial Sequence
  Description of Artificial Sequence: Synthetic coding sequence
atggccgcccccagcggcggctggaacggcgtgggcgccagcctgtgggccgccctgctgctgggcgccgtggccctgagacccgccgaggccgtgagcgagcccaccaccgtggccttcgacgtgagacccggcggcgtggtgcacagcttcagccacaacgtgggccccggcgacaagtacacctgcatgttcacctacgccagccagggcggcaccaacgagcagtggcagatgagcctgggcaccagcgaggaccaccagcacttcacctgcaccatctggagaccccagggcaagagctacctgtacttcacccagttcaaggccgaggtgagaggcgccgagatcgagtacgccatggcctacagcaaggccgccttcgagagagagagcgacgtgcccctgaagaccgaggagttcgaggtgaccaagaccgccgtggcccacagacccggcgccttcaaggccgagctgagcaagctggtgatcgtggccaaggccagcagaaccgagctgtag

SEQ ID NO: 76843 - DNA, 426 bp, Artificial Sequence
  Description of Artificial Sequence: Synthetic coding sequence
atgaccatcatggtggaggacatcatgaagctgctgtgcagcctgagcggcgagagaaagatgaaggccgccgtgaagcacagcggcaagggcgccctggtgaccggcgccatggccttcgtgggcggcctggtgggcggcccccccggcctggccgtgggcggcgccgtgggcggcctgctgggcgcctggatgaccagcggccagttcaagcccgtgccccagatcctgatggagctgccccccgccgagcagcagagactgttcaacgaggccgccgccatcatcagacacctggagtggaccgacgccgtgcagctgaccgccctggtgatgggcagcgaggccctgcagcagcagctgctggccatgctggtgaactacgtgaccaaggagctgagagccgagatccagtacgacgactag

SEQ ID NO: 76844 - DNA, 324 bp, Artificial Sequence
  Description of Artificial Sequence: Synthetic coding sequence
atgaccatcatggtggaggacatcatgaagctgctgtgcagcctgagcggcgagagaaagatgaaggccgccgtgaagcacagcggcaagggcgccctggtgaccggcgccatggccttcgtgggcggcctggtgggcggcccccccggcctggccgtgggcggcgccgtgggcggcctgctgggcgcctggatgaccagcggccagttcaagcccgtgccccagatcctgatggagctgccccccgccgagcagcagagactgttcaacgaggccgccgccatcaccagaccctgcagcagcagctgctggccctgctggtag

SEQ ID NO: 76845 - DNA, 459 bp, Artificial Sequence
  Description of Artificial Sequence: Synthetic coding sequence
atggagagactgaagagccacaagcccgccaccatgaccatcatggtggaggacatcatgaagctgctgtgcagcctgagcggcgagagaaagatgaaggccgccgtgaagcacagcggcaagggcgccctggtgaccggcgccatggccttcgtgggcggcctggtgggcggcccccccggcctggccgtgggcggcgccgtgggcggcctgctgggcgcctggatgaccagcggccagttcaagcccgtgccccagatcctgatggagctgccccccgccgagcagcagagactgttcaacgaggccgccgccatcatcagacacctggagtggaccgacgccgtgcagctgaccgccctggtgatgggcagcgaggccctgcagcagcagctgctggccatgctggtgaactacgtgaccaaggagctgagagccgagatccagtacgacgactag

SEQ ID NO: 76846 - DNA, 648 bp, Artificial Sequence
  Description of Artificial Sequence: Synthetic coding sequence
atggagaagaacccccccgacgacaccggccccgtgcacgtgcccctgggccacatcgtggccaacgagaagtggagaggcagccagctggcccaggagatgcagggcaagatcaagctgatcttcgaggacggcctgacccccgacttctacctgagcaacagatgctgcatcctgtacgtgaccgaggccgacctggtggccggcaacggctacagaaagagactggtgagagtgagaaacagcaacaacctgaagggcatcgtggtggtggagaagaccagaatgagcgagcagtacttccccgccctgcagaagttcaccgtgctggacctgggcatggtgctgctgcccgtggccagccagatggaggccagctgcctggtgatccagctggtgcaggagcagaccaaggagcccagcaagaaccccctgctgggcaagaagagagccctgctgctgagcgagcccagcctgctgagaaccgtgcagcagatccccggcgtgggcaaggtgaaggcccccctgctgctgcagaagttccccagcatccagcagctgagcaacgccagcatcggcgagctggagcaggtggtgggccaggccgtggcccagcagatccacgccttcttcacccagcccagatag

SEQ ID NO: 76847 - DNA, 648 bp, Artificial Sequence; identical to SEQ ID NO: 76846
  Description of Artificial Sequence: Synthetic coding sequence

SEQ ID NO: 76848 - DNA, 1227 bp, Artificial Sequence
  Description of Artificial Sequence: Synthetic coding sequence
atgagcgagcacgtggagcccgccgcccccggccccggccccaacggcggcggcggcggccccgcccccgccagaggccccagaacccccaacctgaaccccaaccccctgatcaacgtgagagacagactgttccacgccctgttcttcaagatggccgtgacctacagcagactgttcccccccgccttcagaagactgttcgagttcttcgtgctgctgaaggccctgttcgtgctgttcgtgctggcctacatccacatcgtgttcagcagaagccccatcaactgcctggagcacgtgagagacaagtggcccagagagggcatcctgagagtggaggtgagacacaacagcagcagagcccccgtgttcctgcagttctgcgacagcggcggcagaggcagcttccccggcctggccgtggagcccggcagcaacctggacatggaggacgaggaggaggaggagctgaccatggagatgttcggcaacagcagcatcaagttcgagctggacatcgagcccaaggtgttcaagccccccagcagcaccgaggccctgaacgacagccaggagttccccttccccgagacccccaccaaggtgtggccccaggacgagtacatcgtggagtacagcctggagtacggcttcctgagactgagccaggccaccagacagagactgagcatccccgtgatggtggtgaccctggaccccaccagagaccagtgcttcggcgacagattcagcagactgctgctggacgagttcctgggctacgacgacatcctgatgagcagcgtgaagggcctggccgagaacgaggagaacaagggcttcctgagaaacgtggtgagcggcgagcactacagattcgtgagcatgtggatggccagaaccagctacctggccgccttcgccatcatggtgatcttcaccctgagcgtgagcatgctgctgagatacagccaccaccagatcttcgtgttcatcgtggacctgctgcagatgctggagatgaacatggccatcgccttccccgccgcccccctgctgaccgtgatcctggccctggtgggcatggaggccatcatgagcgagttcttcaacgacaccaccaccgccttctacatcatcctgatcgtgtggctggccgaccagtacgacgccatctgctgccacaccagcaccagcaagagacactggctgagaatcccctag

SEQ ID NO: 76849 - DNA, 1863 bp, Artificial Sequence
  Description of Artificial Sequence: Synthetic coding sequence
atgagcgagcacgtggagcccgccgcccccggccccggccccaacggcggcggcggcggccccgcccccgccagaggccccagaacccccaacctgaaccccaaccccctgatcaacgtgagagacagactgttccacgccctgttcttcaagatggccgtgacctacagcagactgttcccccccgccttcagaagactgttcgagttcttcgtgctgctgaaggccctgttcgtgctgttcgtgctggcctacatccacatcgtgttcagcagaagccccatcaactgcctggagcacgtgagagacaagtggcccagagagggcatcctgagagtggaggtgagacacaacagcagcagagcccccgtgttcctgcagttctgcgacagcggcggcagaggcagcttccccggcctggccgtggagcccggcagcaacctggacatggaggacgaggaggaggaggagctgaccatggagatgttcggcaacagcagcatcaagttcgagctggacatcgagcccaaggtgttcaagccccccagcagcaccgaggccctgaacgacagccaggagttccccttccccgagacccccaccaaggtgtggccccaggacgagtacatcgtggagtacagcctggagtacggcttcctgagactgagccaggccaccagacagagactgagcatccccgtgatggtggtgaccctggaccccaccagagaccagtgcttcggcgacagattcagcagactgctgctggacgagttcctgggctacgacgacatcctgatgagcagcgtgaagggcctggccgagaacgaggagaacaagggcttcctgagaaacgtggtgagcggcgagcactacagattcgtgagcatgtggatggccagaaccagctacctggccgccttcgccatcatggtgatcttcaccctgagcgtgagcatgctgctgagatacagccaccaccagatcttcgtgttcatcgtggacctgctgcagatgctggagatgaacatggccatcgccttccccgccgcccccctgctgaccgtgatcctggccctggtgggcatggaggccatcatgagcgagttcttcaacgacaccaccaccgccttctacatcatcctgatcgtgtggctggccgaccagtacgacgccatctgctgccacaccagcaccagcaagagacactggctgagattcttctacctgtaccacttcgccttctacgcctaccactacagattcaacggccagtacagcagcctggccctggtgaccagctggctgttcatccagcacagcatgatctacttcttccaccactacgagctgcccgccatcctgcagcaggtgagaatccaggagatgctgctgcaggccccccccctgggccccggcacccccaccgccctgcccgacgacatgaacaacaacagcggcgcccccgccaccgcccccgacagcgccggccagccccccgccctgggccccgtgagccccggcgccagcggcagccccggccccgtggccgccgcccccagcagcctggtggccgccgccgccagcgtggccgccgccgccggcggcgacctgggctggatggccgagaccgccgccatcatcaccgacgccagcttcctgagcggcctgagcgccagcctgctggagagaagacccgccagccccctgggccccgccggcggcctgccccacgccccccaggacagcgtgccccccagcgacagcgccgccagcgacaccacccccctgggcgccgccgtgggcggccccagccccgccagcatggcccccaccgaggcccccagcgaggtgggcagctag

SEQ ID NO: 76850 - DNA, 447 bp, Artificial Sequence
  Description of Artificial Sequence: Synthetic coding sequence
atggccgccagccccgccagacccgccgtgctggccctgaccggcctggccctgctgctgctgctgtgctggggccccggcggcatcagcggcaacaagctgaagctgatgctgcagaagagagaggcccccgtgcccaccaagaccaaggtggccgtggacgagaacaaggccaaggagttcctgggcagcctgaagagacagaagagacagctgtgggacagaaccagacccgaggtgcagcagtggtaccagcagttcctgtacatgggcttcgacgaggccaagttcgaggacgacatcacctactggctgaacagagacagaaacggccacgagtactacggcgactactaccagagacactacgacgaggacagcgccatcggccccagaagcccctacggcttcagacacggcgccagcgtgaactacgacgactactag

SEQ ID NO: 76851 - DNA, 2964 bp, Artificial Sequence
  Description of Artificial Sequence: Synthetic coding sequence
atgacccccgccctgagagaggccaccgccaagggcatcagcttcagcagcctgcccagcaccatggagagcgacaagatgctgtacatggagagccccagaaccgtggacgagaagctgaagggcgacaccttcagccagatgctgggcttccccacccccgagcccaccctgaacaccaacttcgtgaacctgaagcacttcggcagcccccagagcagcaagcactaccagaccgtgttcctgatgagaagcaacagcaccctgaacaagcacaacgagaactacaagcagaagaagctgggcgagcccagctgcaacaagctgaagaacatcctgtacaacggcagcaacatccagctgagcaagatctgcctgagccacagcgaggagttcatcaagaaggagcccctgagcgacaccaccagccagtgcatgaaggacgtgcagatcatcctggacagcaacatcaccaaggacaccaacgtggacaaggtgcagctgcagaactgcaagtggtaccaggagaacgccctgctggacaaggtgaccgacgccgagatcaagaagggcctgctgcactgcacccagaagaagatcgtgcccggccacagcaacgtgcccgtgagcagcagcgccgccgagaaggaggaggaggtgcacgccagactgctgcactgcgtgagcaagcagaagatcctgctgagccaggccagaagaacccagaagcacctgcagatgctgctggccaagcacgtggtgaagcactacggccagcagatgaagctgagcatgaagcaccagctgcccaagatgaagaccttccacgagcccaccaccatcctgggcaacagcctgcccaagtgcaccgagatcaagcccgaggtgaacaccctgaccgccgagaacaagctgtgggacgacgccaagaacggcttcgccagatgcaccgccgccgagatccagagattcgccttcagcgccaccggcctgctgagccacgtggaggagggcctggacagcgacgccaccgacagcagcagcgacgacgacctggacgagtacaccctgagaaagaacgtggccgtgaactgcagcaccgagtggaagtggctggtggacagagccagagtgggcagcagatggacctggctgcaggcccagatcagcgacctggagtgcaagatccagcagctgaccgacatccacagacagatcagagccagcaagggcatcgtggtgctggaggagtgccagctgcccaaggacatcctgaagaagcagatgcagttcgccgaccaggccgccagcctgaacatcctgggcaacccccaggtgccccaggagtgccaggaccccgtgcccgagcaggacttcgagatgagccccagcagccccaccctgctgctgagaaacatcgagaagcagagcgcccagctgaccgagatcatcaacagcctgatcgcccccctgaacctgagccccaccagcagccccctgagcagcaagagctgcagccacaagtgcctggccaacggcatctacagaagcgccagcgagaacctggacgagctgagcagcagcagcagctggctgctgaaccagaagcacagcaagaagaagagaaaggacagaaccagactgaagagcagcagcctgaccttcatgagcaccagcgccagaaccagacccctgcagagcttccacaagagaaagctgtacagactgagccccaccttctactggaccccccagaccctgcccagcaaggagaccgccttcctgaacaccacccagatgccctgcctgcagagcgccagcacctggagcagctacgagcacaacagcgagagctacctgctgagagagcacgtgagcgagctggacagcagcttccacagcgtgctgagcctgcccagcgacgtgcccctgcacttccacttcgagaccctgctgaagaagaccgagatcaagggcaacctggccgagaacaagttcgtggacgagtacatcatcagccccagccccgtgcacagcaccctgaaccagtggagaaacggctacagccccatctgcaagccccagatcagaagcgagagcagcgcccagctgctgcagggcagaaagaagagacacctgagcgagaccgccctgggcgagagaaccaagctggaggagagcgacttccagcacaccgagagcggcagccacagcaacttcaccgccgtgagcaacgtgaacgtgctgagcagaatccagaacagcagcagaaacaccgccagaagaagactgagaagcgagagcagctacgacatcgacaacatcgtgatccccatgagcctggtggcccccgccaagctggagaagctgcagtacaaggagatcctgacccccagctggagaatggtggtgctgcagcccctggacgagtacaacctgggcaaggaggagatcgaggacctgagcgacgaggtgttcagcctgagacacaagaagtacgaggagagagagcaggccagatggagcctgtgggagcagagcaagtggcacagaagaaacagcagagcctacagcaagaacgtggagggccaggacctgctgctgaaggagtaccccaacaacttcagcagcagccagcagtgcgccgccgccagcccccccggcctgcccagcgagaaccaggacctgtgcgcctacggcctgcccagcctgaaccagagccaggagaccaagagcctgtggtgggagagaagagccttccccctgaagggcgaggacatggccgccctgctgtgccaggacgagaagaaggaccaggtggagagaagcagcaccgccttccacggcgagatcttcggcaccagcgtgcccgagaacggccaccaccccaagaagcagagcgacggcatggaggagtacaagaccttcggcctgggcctgaccaacgtgaagaagaacagatag

SEQ ID NO: 76852 - DNA, 687 bp, Artificial Sequence
  Description of Artificial Sequence: Synthetic coding sequence
atgagctacgccgagaagcccgacgagatcaccaaggacgagtggatggagaagctgaacaacctgcacgtgcagagagccgacatgaacagactgatcatgaactacctggtgaccgagggcttcaaggaggccgccgagaagttcagaatggagagcggcatcgagcccagcgtggacctggagaccctggacgagagaatcaagatcagagagatgatcctgaagggccagatccaggaggccatcgccctgatcaacagcctgcaccccgagctgctggacaccaacagatacctgtacttccacctgcagcagcagcacctgatcgagctgatcagacagagagagaccgaggccgccctggagttcgcccagacccagctggccgagcagggcgaggagagcagagagtgcctgaccgagatggagagaaccctggccctgctggccttcgacagccccgaggagagccccttcggcgacctgctgcacaccatgcagagacagaaggtgtggagcgaggtgaaccaggccgtgctggactacgagaacagagagagcacccccaagctggccaagctgctgaagctgctgctgtgggcccagaacgagctggaccagaagaaggtgaagtaccccaagatgaccgacctgagcaagggcgtgatcgaggagcccaagtag

SEQ ID NO: 76853 - DNA, 468 bp, Artificial Sequence
  Description of Artificial Sequence: Synthetic coding sequence
atgagctacgccgagaagcccgacgagatcaccaaggacgagtggatggagaagctgaacaacctgcacgtgcagagagccgacatgaacagactgatcatgaactacctggtgaccgagggcttcaaggaggccgccgagaagttcagaatggagagcggcatcgagcccagcgtggacctggagaccctggacgagagaatcaagatcagagagatgatcctgaagggccagatccagcaggtggtgcacgactgctggagaaaggagagagtgttcatcctgagcgacctgcccagcagcatcagcgccgccagccacccccccagcagcgccggcagcgccgacgtgctgctgctgttcacccacagaaccgtgccctgcagcgtggtgggcagaagagaggtggtgcagggctgcgtgcactgcctgagagtgggcaccgtggacggccacatggccctgtag

SEQ ID NO: 76854 - DNA, 3534 bp, Artificial Sequence
  Description of Artificial Sequence: Synthetic coding sequence
atggacgtgtacccccccagaagacagggcctgcccagagccagaagccccggcggcagcagcagaggcagccccagcgtgagctgcagcagactgagacaggtgcagagcatcctgacccagagcagcaagagcagacccgacggcatcctgtgcatcctgggcatcgacagcagatacaacgagggctgcagagagctggccaactacctgctgttcggcctgtacaaccagaacaccagcgacttcgagaagaccggcttcagcgaggaggtgctggacgacgtgatcatcctgatcaagagcgacagcgtgcacctgtactgcaaccccgtgaacttcagatacctgctgccctacgtggcccactggagaaacctgcacttccactgcatgaccgagaacgagtacgaggacgaggaggccgccgaggagttcaagatcaccagcttcgtggacatggtgagagactgcagcagaatcggcatcccctacagcagccagggccacctgcagatcttcgacatgttcgtggtggagaagtggcccatcgtgcaggccttcgccctggagggcatcggcggcgacggcttcttcaccatgaagtacgagctgcaggacgtgagcctgaacctgtggaacgtgtacagcaagatggaccccatgagcctggagagcctgctgagcgacgacctggtggccttcgagcaccagtggaccagcttcttcgccaacttcgacaccgagatccccttcctgctggagctgagcgagagccaggccggcgagcccttcagaagctacttcagccacggcatgatcagcagccacatcaccgagaacagccccaacagacagcccttcgtgctgttcggcaaccacagcaccagagagaacctgaacgccggcaacttcaacttccccagcgagggccacctggtgagaagcaccggccccggcggcagcttcgccaagcacatggtggcccagtgcgtgagccccaagggccccctggcctgcagcagaacctacttcttcggcgccacccacgtgccctacctgggcggcgacagcaagctgcccaagaagaccgagcagatcagactgctgagccagatctacgccgccgtgatcgaggccgtgctggccggcatcgcctgctacgccaagaccagcagcctgaccaaggccaaggaggtggccgagcagaccctgggcagcggcctggacagcttcgagctgatccccttcaaggccgccctgagaagcaagatgaccttccacatccacgccgtgaacaaccagggcagaatcgtgcccctggacagcgaggacagcctgagcttcgtgaagaccgcctgcatggccgtgtacgacatccccgacctgctgggcggcaacggctgcctgggcagcgtggtgttcagcgagagcttcctgaccagccagatcctggtgaaggagaaggacggcaccgtgaccaccgagaccagcagcgtggtgctgaccgccgccgtgcccagattctgcagctggctggtggaggacaacgaggtgaagctgagcgagaagacccagcaggccgtgagaggcgacgagagcttcctgggcacctacctgaccggcggcgagggcgcctacctgtacagcagcaacctgcagagctggcccgaggagggcaacgtgcacttcttcagcagcggcctgctgttcagccactgcagacacagaagcatcatcatcagcaaggaccacatgaacagcatcagcttctacgacggcgacagcaccagcaccgtggccgccctgctgatcgacttcaagagcagcctgctgccccacctgcccgtgcacttccacggcagcagcaacttcctgatgatcgccctgttccccaagagcaagatctaccaggccttctacagcgaggtgttcagcctgtggaagcagcaggacaacagcggcatcagcctgaaggtgatccaggaggacggcctgagcgtggagcagaagagactgcacagcagcgcccagaagctgttcagcgccctgagccagcccgccggcgagaagagaagcagcctgaagctgctgagcgccaagctgcccgagctggactggttcctgcagcacttcgccatcagcagcatcagccaggagcccgtgatgagaacccacctgcccgtgctgctgcagcaggccgagatcaacaccacccacagaatcgagagcgacaaggtgatcatcagcatcgtgaccggcctgcccggctgccacgccagcgagctgtgcgccttcctggtgaccctgcacaaggagtgcggcagatggatggtgtacagacagatcatggacagcagcgagtgcttccacgccgcccacttccagagatacctgagcagcgccctggaggcccagcagaacagaagcgccagacagagcgcctacatcagaaagaagaccagactgctggtggtgctgcagggctacaccgacgtgatcgacgtggtgcaggccctgcagacccaccccgacagcaacgtgaaggccagcttcaccatcggcgccatcaccgcctgcgtggagcccatgagctgctacatggagcacagattcctgttccccaagtgcctggaccagtgcagccagggcctggtgagcaacgtggtgttcaccagccacaccaccgagcagagacaccccctgctggtgcagctgcagagcctgatcagagccgccaaccccgccgccgccttcatcctggccgagaacggcatcgtgaccagaaacgaggacatcgagctgatcctgagcgagaacagcttcagcagccccgagatgctgagaagcagatacctgatgtaccccggctggtacgagggcaagctgaacgccggcagcgtgtaccccctgatggtgcagatctgcgtgtggttcggcagacccctggagaagaccagattcgtggccaagtgcaaggccatccagagcagcatcaagcccagccccttcagcggcaacatctaccacatcctgggcaaggtgaagttcagcgacagcgagagaaccatggaggtgtgctacaacaccctggccaacagcctgagcatcatgcccgtgctggagggccccacccccccccccgacagcaagagcgtgagccaggacagcagcggccagcaggagtgctacctggtgttcatcggctgcagcctgaaggaggacagcatcaaggactggctgagacagagcgccaagcagaagccccagagaaaggccctgaagaccagaggcatgctgacccagcaggagatcagaagcatccacgtgaagagacacctggagcccctgcccgccggctacttctacaacggcacccagttcgtgaacttcttcggcgacaagaccgacttccaccccctgatggaccagttcatgaacgactacgtggaggaggccaacagagagatcgagaagtacaaccaggagctggagcagcaggagtaccacgacctgttcgagctgaagccctag

SEQ ID NO: 76855 - DNA, 1488 bp, Artificial Sequence
  Description of Artificial Sequence: Synthetic coding sequence
atggagggctgcctgggccaggagctgttcagcaaccacatgttcctgaccagcctgagcagccccaacagacagcccttcgtgctgttcggcaaccacagcaccagagagaacctgaacgccggcaacttcaacttccccagcgagggccacctggtgagaagcaccggccccggcggcagcttcgccaagcacatggtggcccagtgcgtgagccccaagggccccctggcctgcagcagaacctacttcttcggcgccacccacgtgccctacctgggcggcgacagcaagctgcccaagaagaccgagcagatgctgctgagccagatctacgccgccgtgatcgaggccgtgctggccggcatcgcctgctacgccaagaccagcagcctgaccaaggccaaggaggtggccgagcagaccctgggcagcggcctggacagcttcgagctgatccccttcaaggccgccctgagaagcaagatgaccttccacatccacgccgtgaacaaccagggcagaatcgtgcccctggacagcgaggacagcctgagcttcgtgaagaccgcctgcatggccgtgtacgacatccccgacctgctgggcggcaacggctgcctgggcagcgtggtgttcagcgagagcttcctgaccagccagatcctggtgaaggagaaggacggcaccgtgaccaccgagaccagcagcgtggtgctgaccgccgccgtgcccagattctgcagctggctggtggaggacaacgaggtgaagctgagcgagaagacccagcaggccgtgagaggcgacgagagcttcctgggcacctacctgaccggcggcgagggcgcctacctgtacagcagcaacctgcagagctggcccgaggagggcaacgtgcacttcttcagcagcggcctgctgttcagccactgcagacacagaagcatcatcatcagcaaggaccacatgaacagcatcagcttctacgacggcgacagcaccagcaccgtggccgccctgctgatcgacttcaagagcagcctgctgccccacctgcccgtgcacttccacggcagcagcaacttcctgatgatcgccctgttccccaagagcaagatctaccaggccttctacagcgaggtgttcagcctgtggaagcagcaggacaacagcggcatcagcctgaaggtgatccaggaggacggcctgagcgtggagcagaagagactgcacagcagcgcccagaagctgttcagcgccctgagccagcccgccggcgagaagagaagcagcctgaagctgctgagcgccaagctgcccgagctggactggttcctgcagcacttcgccatcagcagcatcagccaggagcccgtgatgagaacccacctgcccgtgctgctgcagcaggccgagatcaacaccacccacagaatcgagagcgacaagatggacggcgtgagccccaaccacggccagctgtag

SEQ ID NO: 76856 - DNA, 615 bp, Artificial Sequence
  Description of Artificial Sequence: Synthetic coding sequence
atgggcgaggccgaggtgggcggcggcggcgccgccggcgacaagggccccggcgaggccgccaccagccccgccgaggagaccgtggtgtggagccccgaggtggaggtgtgcctgttccacgccatgctgggccacaagcccgtgggcgtgaacagacacttccacatgatctgcatcagagacaagttcagccagaacatcggcagacaggtgcccagcaaggtgatctgggaccacctgagcaccatgtacgacatgcaggccctgcacgagagcgagatcctgcccttccccaaccccgagagaaacttcgtgctgcccgaggagatcatccaggaggtgagagagggcaaggtgatgatcgaggaggagatgaaggaggagatgaaggaggacgtggacccccacaacggcgccgacgacgtgttcagcagcagcggcagcctgggcaaggccagcgagaagagcagcaaggacaaggagaagaacagcagcgacctgggctgcaaggagggcgccgacaagagaaagagaagcagagtgaccgacaaggtgctgaccgccaacagcaaccccagcagccccagcgccgccaagagaagaagaacctag

SEQ ID NO: 76857 - DNA, 1278 bp, Artificial Sequence
  Description of Artificial Sequence: Synthetic coding sequence
atgtaccccagcaacaagaagaagaaggtgtggagagaggagaaggagagactgctgaagatgaccctggaggagagaagaaaggagtacctgagagactacatccccctgaacagcatcctgagctggaaggaggagatgaagggcaagggccagaacgacgaggagaacacccaggagaccagccaggtgaagaagagcctgaccgagaaggtgagcctgtacagaggcgacatcaccctgctggaggtggacgccatcgtgaacgccgccaacgccagcctgctgggcggcggcggcgtggacggctgcatccacagagccgccggcccctgcctgctggccgagtgcagaaacctgaacggctgcgacaccggccacgccaagatcacctgcggctacgacctgcccgccaagtacgtgatccacaccgtgggccccatcgccagaggccacatcaacggcagccacaaggaggacctggccaactgctacaagagcagcctgaagctggtgaaggagaacaacatcagaagcgtggccttcccctgcatcagcaccggcatctacggcttccccaacgagcccgccgccgtgatcgccctgaacaccatcaaggagtggctggccaagaaccaccacgaggtggacagaatcatcttctgcgtgttcctggaggtggacttcaagatctacaagaagaagatgaacgagttcttcagcgtggacgacaacaacgaggaggaggaggacgtggagatgaaggaggacagcgacgagaacggccccgaggagaagcagagcgtggaggagatggaggagcagagccaggacgccgacggcgtgaacaccgtgaccgtgcccggccccgccagcgaggaggccgtggaggactgcaaggacgaggacttcgccaaggacgagaacatcaccaagggcggcgaggtgaccgaccacagcgtgagagaccaggaccaccccgacggccaggagaacgacagcaccaagaacgagatcaagatcgagaccgagagccagagcagctacatggagaccgaggagctgagcagcaaccaggaggacgccgtgatcgtggagcagcccgaggtgatccccctgaccgaggaccaggaggagaaggagggcgagaaggcccccggcgaggacacccccagaatgcccggcaagagcgagggcagcagcgacctggagaacacccccggccccgacgccggcgcccaggacgaggccaaggagcagagaaacggcaccaagtag

SEQ ID NO: 76858 - DNA, 1248 bp, Artificial Sequence
  Description of Artificial Sequence: Synthetic coding sequence
atggccttcctgatgcacctgctggtgtgcgtgttcggcatgggcagctgggtgaccatcaacggcctgtgggtggagctgcccctgctggtgatggagctgcccgagggctggtacctgcccagctacctgaccgtggtgatccagctggccaacatcggccccctgctggtgaccctgctgcaccacttcagacccagctgcctgagcgaggtgcccatcatcttcaccctgctgggcgtgggcaccgtgacctgcatcatcttcgccttcctgtggaacatgaccagctgggtgctggacggccaccacagcatcgccttcctggtgctgaccttcttcctggccctggtggactgcaccagcagcgtgaccttcctgcccttcatgagcagactgcccacctactacctgaccaccttcttcgtgggcgagggcctgagcggcctgctgcccgccctggtggccctggcccagggcagcggcctgaccacctgcgtgaacgtgaccgagatcagcgacagcgtgcccagccccgtgcccaccagagagaccgacatcgcccagggcgtgcccagagccctggtgagcgccctgcccggcatggaggcccccctgagccacctggagagcagatacctgcccgcccacttcagccccctggtgttcttcctgctgctgagcatcatgatggcctgctgcctggtggccttcttcgtgctgcagagacagcccagatgctgggaggccagcgtggaggacctgctgaacgaccaggtgaccctgcacagcatcagacccagagaggagaacgacctgggccccgccggcaccgtggacagcagccagggccagggctacctggaggagaaggccgccccctgctgccccgcccacctggccttcatctacaccctggtggccttcgtgaacgccctgaccaacggcatgctgcccagcgtgcagacctacagctgcctgagctacggccccgtggcctaccacctggccgccaccctgagcatcgtggccaaccccctggccagcctggtgagcatgttcctgcccaacagaagcctgctgttcctgggcgtgctgagcgtgctgggcacctgcttcggcggctacaacatggccatggccgtgatgagcccctgccccctgctgcagggccactggggcggcgaggtgctgatcgtgagcatcagacccgtgggcctgctgcccctgagaaccccccacccctag

SEQ ID NO: 76859 - DNA, 1038 bp, Artificial Sequence
  Description of Artificial Sequence: Synthetic coding sequence
atgctgagacccgccggcctgtggagactgtgcagaagaccctgggccgccagagtgcccgccgagaacctgggcagaagagaggtgaccagcggcgtgagccccagaggcagcaccagccccagaaccctgaacatcttcgacagagacctgaagagaaagcagaagaactgggccgccagacagcccgagcccaccaagttcgactacctgaaggaggaggtgggcagcagaatcgccgacagagtgtacgacatccccagaaacttccccctggccctggacctgggctgcggcagaggctacatcgcccagtacctgaacaaggagaccatcggcaagttcttccaggccgacatcgccgagaacgccctgaagaacagcagcgagaccgagatccccaccgtgagcgtgctggccgacgaggagttcctgcccttcaaggagaacaccttcgacctggtggtgagcagcctgagcctgcactgggtgaacgacctgcccagagccctggagcagatccactacatcctgaagcccgacggcgtgttcatcggcgccatgttcggcggcgacaccctgtacgagctgagatgcagcctgcagctggccgagaccgagagagagggcggcttcagcccccacatcagccccttcaccgccgtgaacgacctgggccacctgctgggcagagccggcttcaacaccctgaccgtggacaccgacgagatccaggtgaactaccccggcatgttcgagctgatggaggacctgcagggcatgggcgagagcaactgcgcctggaacagaaaggccctgctgcacagagacaccatgctggccgccgccgccgtgtacagagagatgtacagaaacgaggacggcagcgtgcccgccacctaccagatctactacatgatcggctggaagtaccacgagagccaggccagacccgccgagagaggcagcgccaccgtgagcttcggcgagctgggcaagatcaacaacctgatgccccccggcaagaagagccagtag

SEQ ID NO: 76860 - DNA, 954 bp, Artificial Sequence
  Description of Artificial Sequence: Synthetic coding sequence
atgctgagacccgccggcctgtggagactgtgcagaagaccctgggccgccagagtgcccgccgagaacctgggcagaagagaggtgaccagcggcgtgagccccagaggcagcaccagccccagaaccctgaacatcttcgacagagacctgaagagaaagcagaagaactgggccgccagacagcccgagcccaccaagttcgactacctgaaggaggaggtgggcagcagaatcgccgacagagtgtacgacatccccagaaacttccccctggccctggacctgggctgcggcagaggctacatcgcccagtacctgaacaagctgcagctgttccactgcagaaagctgctggagagcttcagcaagctgaccctgcagaagatgctgtgcctgcactgggtgaacgacctgcccagagccctggagcagatccactacatcctgaagcccgacggcgtgttcatcggcgccatgttcggcggcgacaccctgtacgagctgagatgcagcctgcagctggccgagaccgagagagagggcggcttcagcccccacatcagccccttcaccgccgtgaacgacctgggccacctgctgggcagagccggcttcaacaccctgaccgtggacaccgacgagatccaggtgaactaccccggcatgttcgagctgatggaggacctgcagggcatgggcgagagcaactgcgcctggaacagaaaggccctgctgcacagagacaccatgctggccgccgccgccgtgtacagagagatgtacagaaacgaggacggcagcgtgcccgccacctaccagatctactacatgatcggctggaagtaccacgagagccaggccagacccgccgagagaggcagcgccaccgtgagcttcggcgagctgggcaagatcaacaacctgatgccccccggcaagaagagccagtag

SEQ ID NO: 76861 - DNA, 804 bp, Artificial Sequence
  Description of Artificial Sequence: Synthetic coding sequence
atgctgagacccgccggcctgtggagactgtgcagaagaccctgggccgccagagtgcccgccgagaacctgggcagaagagaggtgaccagcggcgtgagccccagaggcagcaccagccccagaaccctgaacatcttcgacagagacctgaagagaaagcagaagaactgggccgccagacagcccgagcccaccaagttcgactacctgaaggaggaggtgggcagcagaatcgccgacagagtgtacgacatccccagaaacttccccctggccctggacctgggctgcggcagaggctacatcgcccagtacctgaacaaggagaccatcggcaagttcttccaggccgacatcgccgagaacgccctgaagaacagcagcgagaccgagatccccaccgtgagcgtgctggccgacgaggagttcctgcccttcaaggagaacaccttcgacctggtggtgagcagcctgagcctgcactgggtgaacgacctgcccagagccctggagcagatccactacatcctgaagcccgacggcgtgttcatcggcgccatgttcggcggcgacaccctgtacgagctgagatgcagcctgcagctggccgagaccgagagagagggcggcttcagcccccacatcagccccttcaccgccgtgaacgacctgggccacctgctgggcagagccggcttcaacaccctgaccgtggacaccgacgagatccaggtgaactaccccggcatgttcgagctgatggaggacctgcaggagcagaagagcagaatgctgacctag

SEQ ID NO: 76862 - DNA, 771 bp, Artificial Sequence
  Description of Artificial Sequence: Synthetic coding sequence
atgaagctgaccagaaagatggtgctgaccagagccaaggccagcgagctgcacagcgtgagaaagctgaactgctggggcagcagactgaccgacatcagcatctgccaggagatgcccagcctggaggtgatcaccctgagcgtgaacagcatcagcaccctggagcccgtgagcagatgccagagactgagcgagctgtacctgagaagaaacagaatccccagcctggccgagctgttctacctgaagggcctgcccagactgagagtgctgtggctggccgagaacccctgctgcggcaccagcccccacagatacagaatgaccgtgctgagaaccctgcccagactgcagaagctggacaaccaggccgtgaccgaggaggagctgagcagagccctgagcgagggcgaggagatcaccgccgcccccgagagagagggcaccggccacggcggccccaagctgtgctgcaccctgagcagcctgagcagcgccgccgagaccggcagagaccccctggacagcgaggaggaggccaccagcggcgcccaggacgagagaggcctgaagccccccagcagaggccagttccccagcctgagcgccagagacgccagcagcagccacagaggcagaaacgtgctgaccgccatcctgctgctgctgagagagctggacgccgagggcctggaggccgtgcagcagaccgtgggcagcagactgcaggccctgagaggcgaggaggtgcaggagcacgccgagtag

SEQ ID NO: 76863 - DNA, 654 bp, Artificial Sequence
  Description of Artificial Sequence: Synthetic coding sequence
gtgacccagggcccccagggcctgagagccagcggcagaagctgcgtgggccccttcctgagccacctgggcagagacagaacccccggcgtgctgaccgagctgagatgcgtggtgcccgccagactgaccgccctggagagaagcagaaagcccagaggcagaggcagaggcagatacatcaccctgctgcccgtgcccgaggccgaccccatcctggagagagtgccccagcccgagttctgcagctgcgtgaacagcatcagcaccctggagcccgtgagcagatgccagagactgagcgagctgtacctgagaagaaacagaatccccagcctggccgagctgttctacctgaagggcctgcccagactgagagtgctgtggctggccgagaacccctgctgcggcaccagcccccacagatacagaatgaccgtgctgagaaccctgcccagactgcagaagctggacaaccaggccgtgaccgaggaggagctgagcagagccctgagcgagggcgaggagatcaccgccgcccccgagagagagggcaccggccacggcggccccaagctgtgctgcaccctgagcagcctgagcagcgccgccgagaccggcagagaccccctggacagcgaggaggaggcctag

SEQ ID NO: 76864 - DNA, 1128 bp, Artificial Sequence
  Description of Artificial Sequence: Synthetic coding sequence
atgaagctgaccagaaagatggtgctgaccagagccaaggccagcgagctgcacagcgtgagaaagctgaactgctggggcagcagactgaccgacatcagcatctgccaggagatgcccagcctggaggtgatcaccctgagcgtgaacagcatcagcaccctggagcccgtgagcagatgccagagactgagcgagctgtacctgagaagaaacagaatccccagcctggccgagctgttctacctgaagggcctgcccagactgagagtgctgtggctggccgagaacccctgctgcggcaccagcccccacagatacagaatgaccgtgctgagaaccctgcccagactgcagaagctggacaaccaggccgtgaccgaggaggagctgagcagagccctgagcgagggcgaggagatcaccgccgcccccgagagagagggcaccggccacggcggccccaagctgtgctgcaccctgagcagcctgagcagcgccgccgagaccggcagagaccccctggacagcgaggaggaggccaccggcgcccaggacgagagaggcctgaagccccccagcagaggccagttccccagcctgagcgccagagacgccagcagcagccacagaggcagagtgagcggcggccccctgggcgccgccgccgccagcgcccactgcacccactgcaccgagaccgtgggcagagagcacggcgccagccagggccccgtgggcagagagcacggcgccagccagggcctggaggagctgtgccccagaggcagctgcgtgtgcggcagcgtgaacgcccacaccagagtgaccagagccccccacggcgccgtgctggccccccagcccctgctgctgagctggagcgtggagtgcggccccggcccctgctgggccgagggcaacagaagccacgtggaggaggtgccccacaccagaccccaggccggcctgctgtgcagcgacagccccagcgtgcccaacgtgctgaccgccatcctgctgctgctgagagagctggacgccgagggcctggaggccgtgcagcagaccgtgggcagcagactgcaggccctgagaggcgaggaggtgcaggagcacgccgagtag

SEQ ID NO: 76865 - DNA, 807 bp, Artificial Sequence
  Description of Artificial Sequence: Synthetic coding sequence
atggccgccgtgagagtgctggtggccagcagactggccgccgccagcgccttcaccagcctgagccccggcggcagaacccccagccagagagccgccctgcacctgagcgtgcccagacccgccgccagagtggccctggtgctgagcggctgcggcgtgtacgacggcaccgagatccacgaggccagcgccatcctggtgcacctgagcagaggcggcgccgaggtgcagatcttcgcccccgacgtgccccagatgcacgtgatcgaccacaccaagggccagcccagcgagggcgagagcagaaacgtgctgaccgagagcgccagaatcgccagaggcaagatcaccgacctggccaacctgagcgccgccaaccacgacgccgccatcttccccggcggcttcggcgccgccaagaacctgagcaccttcgccgtggacggcaaggactgcaaggtgaacaaggaggtggagagagtgctgaaggagttccaccaggccggcaagcccatcggcctgtgctgcatcgcccccgtgctggccgccaaggtgctgagaggcgtggaggtgaccgtgggccacgagcaggaggagggcggcaagtggccctacgccggcaccgccgaggccatcaaggccctgggcgccaagcactgcgtgaaggaggtggtggaggcccacgtggaccagaagaacaaggtggtgaccacccccgccttcatgtgcgagaccgccctgcactacatccacgacggcatcggcgccatggtgagaaaggtgctggagctgaccggcaagtag

SEQ ID NO: 76866 - DNA, 714 bp, Artificial Sequence
  Description of Artificial Sequence: Synthetic coding sequence
atggccgccgtgagagtgctggtggccagcagactggccgccgccagcgccttcaccagcctgagccccggcggcagaacccccagccagagagccgccctgcacctgagcgtgcccagacccgccgccagagtggccctggtgctgagcggctgcggcgtgtacgacggcaccgagatccacgaggccagcgccatcctggtgcacctgagcagaggcggcgccgaggtgcagatcttcgcccccgacgtgccccagatgcacgtgatcgaccacaccaagggccagcccagcgagggcgagagcagaaacgtgctgaccgagagcgccagaatcgccagaggcaagatcaccgacctggccaacctgagcgccgccaaccacgacgccgccatcttccccggcggcttcggcgccgccaagaacctgctgtgctgcatcgcccccgtgctggccgccaaggtgctgagaggcgtggaggtgaccgtgggccacgagcaggaggagggcggcaagtggccctacgccggcaccgccgaggccatcaaggccctgggcgccaagcactgcgtgaaggaggtggtggaggcccacgtggaccagaagaacaaggtggtgaccacccccgccttcatgtgcgagaccgccctgcactacatccacgacggcatcggcgccatggtgagaaaggtgctggagctgaccggcaagtag

SEQ ID NO: 76867 - DNA, 1023 bp, Artificial Sequence
  Description of Artificial Sequence: Synthetic coding sequence
atggccgagggcggcgagctgatgagcagactgctgagcgagaacgccgacctgaagaagcaggtgagactgctgaaggagaaccagatgctgagaagactgctgagccagagctgccaggagggcggcggccacgacctgctgccccccagagcccacgcctaccccgaggccggcagccccggcagcggcgtgcccgacttcggcagattcaccagcgtggccgacacccccagccagctgcagaccagcagcctggaggacctgctgtgcagccacgcccccctgagcagcgaggacgacaccagccccggctgcgccgcccccagccaggcccccttcaaggccttcctgagcccccccgagccccacagccacagaggcaccgacagaaagctgagccccctgctgagccccctgcaggacagcctggtggacaagaccctgctggagcccagagagatggtgagacccaagaaggtgtgcttcagcgagagcagcctgcccaccggcgacagaaccagaagaagctactacctgaacgagatccagagcttcgccggcgccgagaaggacgccagagtggtgggcgagatcgccttccagctggacagaagaatcctggcctacgtgttccccggcgtgaccagactgtacggcttcaccgtggccaacatccccgagaagatcgagcagaccagcaccaagagcctggacggcagcgtggacgagagaaagctgagagagctgacccagagatacctggccctgagcgccagactggagaagctgggctacagcagagacgtgcaccccgccttcagcgagttcctgatcaacacctacggcatcctgaagcagagacccgacctgagagccaaccccctgcacagcagccccgccgccctgagaaagctggtgatcgacgtggtgccccccaagttcctgggcgacagcctgctgctgctgaactgcctgtgcgagctgagcaaggaggacggcaagcccctgttcgcctggtag

SEQ ID NO: 76868 - DNA, 561 bp, Artificial Sequence
  Description of Artificial Sequence: Synthetic coding sequence
atggtgagacccaagaaggtgtgcttcagcgagagcagcctgcccaccggcgacagaaccagaagaagctactacctgaacgagatccagagcttcgccggcgccgagaaggacgccagagtggtgggcgagatcgccttccagctggacagaagaatcctggcctacgtgttccccggcgtgaccagactgtacggcttcaccgtggccaacatccccgagaagatcgagcagaccagcaccaagagcctggacggcagcgtggacgagagaaagctgagagagctgacccagagatacctggccctgagcgccagactggagaagctgggctacagcagagacgtgcaccccgccttcagcgagttcctgatcaacacctacggcatcctgaagcagagacccgacctgagagccaaccccctgcacagcagccccgccgccctgagaaagctggtgatcgacgtggtgccccccaagttcctgggcgacagcctgctgctgctgaactgcctgtgcgagctgagcaaggaggacggcaagcccctgttcgcctggtag

SEQ ID NO: 76869 - DNA, 438 bp, Artificial Sequence
  Description of Artificial Sequence: Synthetic coding sequence
atggtgcagctgatcgcccccctggaggtgatgtggaacgaggccgccgacctgaagcccctggccctgagcagaagactggagtgcagcggcggcatcatggcccactacagccccgacctgctgggccccgagatggagagcagatacttcgcccaggtgggcctggagcacctggccagcagcagcccccccgccttcggcttcctgaagtgcctggactacagcatcagcgtgctgtgcagcgccaccagcctggccatgctggaggacaaccccaaggtgagcaagctggccaccggcgactggatgctgaccctgaagcccaagagcatcaccgtgcccgtggagatccccagcagccccctggccggcagacccagaagaagaagaagactgagatgcccccacgaccagcacagccagggcacctgctag

SEQ ID NO: 76870 - DNA, 429 bp, Artificial Sequence
  Description of Artificial Sequence: Synthetic coding sequence
atgatcagcaccgccagagtgcccgccgacaagcccgtgagaatcgccttcagcctgaacgacgccagcgacgacaccccccccgaggacagcatccccctggtgttccccgagctggaccagcagctgcagcccctgcccccctgccacgacagcgaggagagcatggaggtgttcaagcagcactgccagatcgccgaggagtaccacgaggtgaagaaggagatcaccctgctggagcagagaaagaaggagctgatcgccaagctggaccaggccgagaaggagaaggtggacgccgccgagctggtgagagagttcgaggccctgaccgaggagaacagaaccctgagactggcccagagccagtgcgtggagcagctggagaagctgagaatccagtaccagaagagacagggcagcagctag

SEQ ID NO: 76871 - DNA, 729 bp, Artificial Sequence
  Description of Artificial Sequence: Synthetic coding sequence
atggtgcagctgatcgcccccctggaggtgatgtggaacgaggccgccgacctgaagcccctggccctgagcagaagactggagtgcagcggcggcatcatggcccactacagccccgacctgctgggccccgagatggagagcagatacttcgcccaggtgggcctggagcacctggccagcagcagcccccccgccttcggcttcctgaagtgcctggactacagcatcagcgtgctgtgcagcgccaccagcctggccatgctggaggacaaccccaaggtgagcaagctggccaccggcgactggatgctgaccctgaagcccaagagcatcaccgtgcccgtggagatccccagcagccccctggacgacaccccccccgaggacagcatccccctggtgttccccgagctggaccagcagctgcagcccctgcccccctgccacgacagcgaggagagcatggaggtgttcaagcagcactgccagatcgccgaggagtaccacgaggtgaagaaggagatcaccctgctggagcagagaaagaaggagctgatcgccaagctggaccaggccgagaaggagaaggtggacgccgccgagctggtgagagagttcgaggccctgaccgaggagaacagaaccctgagactggcccagagccagtgcgtggagcagctggagaagctgagaatccagtaccagaagagacagggcagcagctag

SEQ ID NO: 76872 - DNA, 429 bp, Artificial Sequence; identical to SEQ ID NO: 76870
  Description of Artificial Sequence: Synthetic coding sequence

SEQ ID NO: 76873 - DNA, 429 bp, Artificial Sequence; identical to SEQ ID NO: 76870
  Description of Artificial Sequence: Synthetic coding sequence

SEQ ID NO: 76874 - DNA, 429 bp, Artificial Sequence; identical to SEQ ID NO: 76870
  Description of Artificial Sequence: Synthetic coding sequence

SEQ ID NO: 76875 - DNA, 429 bp, Artificial Sequence; identical to SEQ ID NO: 76870
  Description of Artificial Sequence: Synthetic coding sequence

SEQ ID NO: 76876 - DNA, 429 bp, Artificial Sequence; identical to SEQ ID NO: 76870
  Description of Artificial Sequence: Synthetic coding sequence

SEQ ID NO: 76877 - DNA, 729 bp, Artificial Sequence; identical to SEQ ID NO: 76871
  Description of Artificial Sequence: Synthetic coding sequence

SEQ ID NO: 76878 - DNA, 135 bp, Artificial Sequence
  Description of Artificial Sequence: Synthetic coding sequence
atggtgcagctgatcgcccccctggaggtgatgtggaacgaggccgccgacctgaagcccctggccctgagcagaagactggagtgcagcggcggcatcatggcccactacagccccgacctgctgggcccctag

SEQ ID NO: 76879 - DNA, 285 bp, Artificial Sequence
  Description of Artificial Sequence: Synthetic coding sequence
atgatcagcaccgccagagtgcccgccgacaagcccgtgagaatcgccttcagcctgaacgacgccagcgacgacaccccccccgaggacagcatccccctggtgttccccgagctggaccagcagctgcagcccctgcccccctgccacgacagcgaggagagcatggaggtgttcaagcagcactgccagatcgccgaggagtaccacgaggtgaagaaggagatcaccctgctggagcagagaaagaaggagctgatcgccaagctggaccaggccgagtag

SEQ ID NO: 76880 - DNA, 411 bp, Artificial Sequence
  Description of Artificial Sequence: Synthetic coding sequence
atgctggtgagcagcagcagcctgacccccttcccccccgtgagaaccgccgacgacaccccccccgaggacagcatccccctggtgttccccgagctggaccagcagctgcagcccctgcccccctgccacgacagcgaggagagcatggaggtgttcaagcagcactgccagatcgccgaggagtaccacgaggtgaagaaggagatcaccctgctggagcagagaaagaaggagctgatcgccaagctggaccaggccgagaaggagaaggtggacgccgccgagctggtgagagagttcgaggccctgaccgaggagaacagaaccctgagactggcccagagccagtgcgtggagcagctggagaagctgagaatccagtaccagaagagacagggcagcagctag

SEQ ID NO: 76881 - DNA, 786 bp, Artificial Sequence
  Description of Artificial Sequence: Synthetic coding sequence
atggtggtggtggccgccgcccccaaccccgccgacggcacccccaaggtgctgctgctgagcggccagcccgccagcgccgccggcgcccccgccggccaggccctgcccctgatggtgcccgcccagagaggcgccagccccgaggccgccagcggcggcctgccccaggccagaaagagacagagactgacccacctgagccccgaggagaaggccctgagaagaaagctgaagaacagagtggccgcccagaccgccagagacagaaagaaggccagaatgagcgagctggagcagcaggtggtggacctggaggaggagaaccagaagctgctgctggagaaccagctgctgagagagaagacccacggcctggtggtggagaaccaggagctgagacagagactgggcatggacgccctggtggccgaggaggaggccgaggccaagggcaacgaggtgagacccgtggccggcagcgccgagagcgccgccctgagactgagagcccccctgcagcaggtgcaggcccagctgagccccctgcagaacatcagcccctggatcctggccgtgctgaccctgcagatccagagcctgatcagctgctgggccttctggaccacctggacccagagctgcagcagcaacgccctgccccagagcctgcccgcctggagaagcagccagagaagcacccagaaggaccccgtgccctaccagccccccttcctgtgccagtggggcagacaccagcccagctggaagcccctgatgaactag

SEQ ID NO: 76882 - DNA, 528 bp, Artificial Sequence
  Description of Artificial Sequence: Synthetic coding sequence
atgagcagaagctacaacgacgagctgcagttcctggagaagatcaacaagaactgctggagaatcaagaagggcttcgtgcccaacatgcaggtggagggcgtgttctacgtgaacgacgccctggagaagctgatgttcgaggagctgagaaacgcctgcagaggcggcggcgtgggcggcttcctgcccgccatgaagcagatcggcaacgtggccgccctgcccggcatcgtgcacagaagcatcggcctgcccgacgtgcacagcggctacggcttcgccatcggcaacatggccgccttcgacatgaacgaccccgaggccgtggtgagccccggcggcgtgggcttcgacatcaactgcggcgtgagactgctgagaaccaacctggacgagagcgacgtgcagcccgtgaaggagcagctggcccaggccatgttcgaccacatccccgtgggcgtgggcagcaagggcgacatgatgagagccgtgcactgccccgagcagaacctggacgtgatctag

SEQ ID NO: 76883 - DNA, 2304 bp, Artificial Sequence
  Description of Artificial Sequence: Synthetic coding sequence
atgagccacgccgtgaccatcgaggagccccaggcccagccccaggtgagccagaccagatacagagagagaagcagagccggcagccacatcagcagcaacagagcctacgacttcctgtacgaccccctgttcatcgtgagcagcgagaaggaccacacccaggccaacatccaggccaccctgatcagaagcagactgagaaaggtgcccagattcaagaccatgttcagcaacctgatccactaccccagatacagcctgtactggagcaagagcgaccccgtgccccccttcatcagcagagagtggaagggccacaaggagaagcacagagaggccctgagacagctgaccaccaccgacgccagcttccagatgcccaaggaggtgtacgaggaccccgaggtgaccggcaagaacagatacaagtacttcgagagacccttcctgcccttcttccagcagatgcccttcaacgtggtgtacgccgtgagcaaggccgagccctacaccttcccccccaccagcaccaagcacctgagcatccccagcaagagcaccgtgggcacccagaccgactacagagacgccgacgtgcagaccgacccctacagcgccgagtacgtggtgtgccaggacagcatccccgagctgctgaccctggccaccctgacctggggcagaggcctgcccgccggccaggccgaggtggagatgatcgagagagccagagagaagagagcctgggaggccagcctgcccgccctgagcgacaccagccagttcgagaagagaagaaagatgatgaacgagatggagagaaaggagtgggccttcagagagcaggagatcgagaagctgcaggagatcagactggaggtgctgaaggagctgctgagaaagagagaggagaaccagaacgaggtgaacatgaagcacctgaacgccagatggagcaagctgcaggagggcaaggaggccaagatggccaagatccagagaacccacgtgagcaccatcagaaagctggtgggcaagagaaagaacatcgagggcaagctggagagaagaaacatcatcaaggactacagcgactacgccagccaggtgtacggccccctgagcagactgggctgcttccccgacaacaacagcgaggacttcgtggtgaagaactactacctgaacacctacgagggcctggtggagctggagagctgcctgcccgacttcgtgacccagccccagatcagagcccccaagcccaaggtgatcaccaccaaggccggcttcctgaagagagccgccagactggactacgagctggccgaggtgcacaaggccctgctggacaagaagaacaaggtgctggaggtgaagaagccccccagattcctgcagagaaaccccatcccccagcccagactgcccacccccaccctggagatgaccagcaacgaggaggaggagatggagatggccgtgatctacctgcagaagctgctgagaggcagagtggtgcagaacatgatgttcgagggcaaggagaagagactggagctgatccaggagctgagaacctgccacgccctgcaggaggacgagaagctggtgaagaaggccgagaagcaggtgaccctggccctgcagagacagagaaacctgcacgagcacaaggtgagcctggtggagaaccacctggccggcctggagggcagagccctggccgacatgttcgacttcctgagcaaggagctggtgagactgcaggaggagagaagaatccacgccttcgtgatgctggccgagagacagagaagagtgagagaggccgaggagagcggcagaagacaggtggagaagcagagactgagagaggaggacgagatcttcaaggaggtggtgaaggtgcaccacagcaccatcagcagctacctggaggacatcatcctgaacaccgaggccaacaccgccgaggagcaggccagagccgagatcgagaagatggccgagaagatcaacgacatcgcctacgagatggagagcagaagaacctacctgcagagcgaggagatcgtggccgagctggtgtacagcttcctgatccccgaggtgcagaagtacttcgtgaaggagaaggtgagaaacgcccagagaaagcacatcctggccgcccaccagatcatccacagctacaccgagagcatggtgcagaagaagctgaccgagggcgagcaggacgaggccagcaacgccgccatgctgctggagaaggagacccagaacgagaacaacagctag

SEQ ID NO: 76884 - DNA, 564 bp, Artificial Sequence
  Description of Artificial Sequence: Synthetic coding sequence
atgagccacgccgtgaccatcgaggagccccaggcccagccccaggtgagccagaccagatacagagagagaagcagagccggcagccacatcagcagcaacagagcctacgacttcctgtacgaccccctgttcatcgtgagcagcgagaaggaccacacccaggccaacatccaggccaccctgatcagaagcagactgagaaaggtgcccagattcaagaccatgttcagcaacctgatccactaccccagatacagcctgtactggagcaagagcgaccccgtgccccccttcatcagcagagagtggaagggccacaaggagaagcacagagaggccctgagacagctgaccaccaccgacgccagcttccagatgcccaaggaggtgtacgaggaccccgaggtgaccggcaagaacagatacaagggccagaaccacaccctgttcctgctgctgctgctgagcacctaccccagcctgcagagcctgctgtgggccctgagactgatcatcggcatgctgaccttcaagcagatccacaccctgcagaacatgtag

SEQ ID NO: 76885 - DNA, 717 bp, Artificial Sequence
  Description of Artificial Sequence: Synthetic coding sequence
atgagccacgccgtgaccatcgaggagccccaggcccagccccaggtgagccagaccagatacagagagagaagcagagccggcagccacatcagcagcaacagagcctacgacttcctgtacgaccccctgttcatcgtgagcagcgagaaggaccacacccaggccaacatccaggccaccctgatcagaagcagactgagaaaggtgcccagattcaagaccatgttcagcaacctgatccactaccccagatacagcctgtactggagcaagagcgaccccgtgccccccttcatcagcagagagtggaagggccacaaggagaagcacagagaggccctgagacagctgaccaccaccgacgccagcttccagatgcccaaggaggtgtacgaggaccccgaggtgaccggcaagaacagatacaagtacttcgagagacccttcctgcccttcttccagcagatgcccttcaacgtggtgtacgccgtgagcaaggccgagccctacaccttcccccccaccagcaccaagcacctgagcatccccagcaagagcaccgtgggcacccagaccgactacagagacgccgacgtgcagaccgacccctacagcgccgagtacgtggtgtgccaggacagcatccccgagctgctgaccctggccaccctgacctggggcgagctggtgaacctgctgaccatcggcagatag

SEQ ID NO: 76886 - DNA, 654 bp, Artificial Sequence
  Description of Artificial Sequence: Synthetic coding sequence
atggacctggcccagcccagccagcccgtggacgagctggagctgagcgtgctggagagacagcccgaggagaacacccccctgaacggcgccgacaaggtgttccccagcctggacgaggaggtgccccccgccgaggccaacaaggagagcccctggagcagctgcaacaagaacgtggtgggcagatgcaagctgtggatgatcatcaccagcatcttcctgggcgtgatcaccgtgatcatcatcggcctgtgcctggccgccgtgacctacgtggacgaggacgagaacgagatcctggagctgagcagcaacaagaccttcttcatcatgctgaagatccccgaggagtgcgtggccgaggaggagctgccccacctgctgaccgagagactgaccgacgtgtacagcaccagccccagcctgggcagatacttcaccagcgtggagatcgtggacttcagcggcgagaacgccaccgtgacctacgacctgcagttcggcgtgcccagcgacgacgagaacttcatgaagtacatgatgagcgaggagctggtgctgggcatcctgctgcaggacttcagagaccagaacatccccggctgcgagagcctgggcctggaccccaccagcctgctgctgtacgagtag

SEQ ID NO: 76887 - DNA, 444 bp, Artificial Sequence
  Description of Artificial Sequence: Synthetic coding sequence
atggacctggcccagcccagccagcccgtggacgagctggagctgagcgtgctggagagacagcccgaggagaacacccccctgaacggcgccgacaaggtgttccccagcctggacgaggaggtgccccccgccgaggccaacaaggagagcccctggagcagctgcaacaagaacgtggtgggcagatgcaagctgtggatgatcatcaccagcatcttcctgggcgtgatcaccgtgatcatcatcggcctgtgcctggccgccgtgacctacgtggacgaggacgagaacgagatcctggagctgagcagcaacaagaccttcttcatcatgctgaagatccccgaggagtgcgtggccgaggaggagctgccccacctgctgaccgagagagaggtgggcctgaagcccaaccccgaggccctggtgggcttcgagtag

SEQ ID NO: 76888 - DNA, 753 bp, Artificial Sequence
  Description of Artificial Sequence: Synthetic coding sequence
atggacctggcccagcccagccagcccgtggacgagctggagctgagcgtgctggagagacagcccgaggagaacacccccctgaacggcgccgacaaggtgttccccagcctggacgaggaggtgccccccgccgaggccaacaaggagagcccctggagcagctgcaacaagaacgtggtgggcagatgcaagctgtggatgatcatcaccagcatcttcctgggcgtgatcaccgtgatcatcatcggcctgtgcctggccgccgtgacctacgtggacgaggacgagaacgagatcctggagctgagcagcaacaagaccttcttcatcatgctgaagatccccgaggagtgcgtggccgaggaggagctgccccacctgctgaccgagagaaacgaggtgatggaggccggcctgtgcctgaaggccgtgctgtaccaggtgctggagatgaagggcatccacagcgtgctgcagaagagattctgcggcctgatccagaagcaccagcagcaccagagaggcggcgacagcttcctgagcagattctacagcctggccctgagccccgtgaagcagctgcccagcaccgccagcgccggcagcagcctggacaagggcagaaagcccgccagagtgggcgccatcggcagcgccggcatgagccactgctggagaagcctggtgttctgcctgttcctgttctgcttcgtgctgttcttcgagaccggcagcagaagcgtggcctag

SEQ ID NO: 76889 - DNA, 1293 bp, Artificial Sequence
  Description of Artificial Sequence: Synthetic coding sequence
atgtggagactggtgccccccaagctgggcagactgagcagaagcctgaagctggccgccctgggcagcctgctggtgctgatggtgctgcacagccccagcctgctggccagctggcagagaaacgagctgaccgacagaagattcctgcagctgaacaagtgccccgcctgcttcggcaccagctggtgcagaagattcctgaacggccaggtggtgttcgaggcctggggcagactgagactgctggacttcctgaacgtgaagaacgtgtacttcgcccagtacggcgagcccagagagggcggcagaagaagagtggtgctgaagagactgggcagccagagagagctggcccagctggaccagagcatctgcaagagagccaccggcagacccagatgcgacctgctgcaggccatgcccagaaccgagttcgccagactgaacggcgacgtgagactgctgacccccgaggccgtggagggctggagcgacctggtgcactgccccagccagagactgctggacagactggtgagaagatacgccgagaccaaggacagcggcagcttcctgctgagaaacctgaaggacagcgagagaatgcagctgctgctgaccctggccttcaaccccgagcccctggtgctgcagagcttccccagcgacgagggctggcccttcgccaagtacctgggcgcctgcggcagaatggtggccgtgaactacgtgggcgaggagctgtggagctacttcaacgccccctgggagaagagagtggacctggcctggcagctgatggagatcgccgagcagctgaccaacaacgacttcgagttcgccctgtacctgctggacgtgagcttcgacaacttcgccgtgggccccagagacggcaaggtgatcatcgtggacgccgagaacgtgctggtggccgacaagagactgatcagacagaacaagcccgagaactgggacgtgtggtacgagagcaagttcgacgactgcgacaaggaggcctgcctgagcttcagcaaggagatcctgtgcgccagagccaccgtggaccacaactactacgccgtgtgccagaacctgctgagcagacacgccacctggagaggcaccagcggcggcctgctgcacgacccccccagcgagatcgccaaggacggcagactggaggccctgctggacgagtgcgccaaccccaagaagagatacggcagattccaggccgccaaggagctgagagagtacctggcccagctgagcaacaacgtgagatag

SEQ ID NO: 76890 - DNA, 666 bp, Artificial Sequence
  Description of Artificial Sequence: Synthetic coding sequence
atgaagagcgagaacggcaccgtggtgggcagcttccccagcgacgagggctggcccttcgccaagtacctgggcgcctgcggcagaatggtggccgtgaactacgtgggcgaggagctgtggagctacttcaacgccccctgggagaagagagtggacctggcctggcagctgatggagatcgccgagcagctgaccaacaacgacttcgagttcgccctgtacctgctggacgtgagcttcgacaacttcgccgtgggccccagagacggcaaggtgatcatcgtggacgccgagaacgtgctggtggccgacaagagactgatcagacagaacaagcccgagaactgggacgtgtggtacgagagcaagttcgacgactgcgacaaggaggcctgcctgagcttcagcaaggagatcctgtgcgccagagccaccgtggaccacaactactacgccgtgtgccagaacctgctgagcagacacgccacctggagaggcaccagcggcggcctgctgcacgacccccccagcgagatcgccaaggacggcagactggaggccctgctggacgagtgcgccaaccccaagaagagatacggcagattccaggccgccaaggagctgagagagtacctggcccagctgagcaacaacgtgagatag

SEQ ID NO: 76891 - DNA, 5079 bp, Artificial Sequence
  Description of Artificial Sequence: Synthetic coding sequence
atgagaagacccccccccctgggccccaccaccgccagcggccccgagggcaacgtgagaaacctgcagaagagacaggcccccggccccggcgccgccggcggctgcggccccgaggccggcggctgcagagagaacaagcagaagagaagaatggtggccagagccacccccggcagaggcgaggtggagagcgacaagagcgtggccgccagcggcgccggcaaggccgccagaagacaggtggagggcagaagaggccccgtgagccccagcgacagcagcgaccccagaggcctggaggccgccaaggaggccgagctgcccctgcagaccgagagacacaccaaggagaagagaaaggtgaccgaggccagcagcgacgacccccagcccggcctggacctggtgagaaaggagagcctgaccagcagcgagagcttccagaccgtggagtgcctgcagagcctgggcaaggagagcatcatcgagggcatcaagagaagaatcagaaacaagaagctgaagagcctggagaacccccccctgaagatcaccgagaacgaggccacccagaacatcaaggtggagttccaggacgagctgtacaagaacacccccaagtacagctgcaacatcctgagccccgaggtggagaacaacagcgtgctgaagctgagagactgcaactgcttcccccacagcaagggctgcaacgacgagaacaacctgccctacaagcccgacggcggctgcatgcacgtggccgagaacttcagcaagaaggagaacctgagaagcctggccgagaagagcgacaccaacagcatcccccagctgctgcagaccgaggagaacgtgatgggcgtgaacaagctgctgcccgaggagagcgacctgtaccagagcaagaccaacggcctgctgagctgcctgcagcacgagaagaacaagtacagcatcgaggagagcagcgtgggcagaaagcccagaaagagaatgaagctgagcgagaaggccgacgagaccgtgaccgagatgaacttcagcaacgagtacaacaagagcgagctgatgctgcaggagaaccagatgatcgccgacggcaaggaggccgagaccaagagccccctgaacgtgctgagaaaggtgagccacaacaccgtgagcctgatggaccacctgctgagcgtgcccgagaccgtggagaaggagaccagcagcgagcaccacgtgaacgccgtgttccagaagaccatcgagcccctgctgaaggaggagaccgagaacgccagcgagcccctgggctacgagagcatggccagcaaggaggacttcaagagcatgaagagcttcatcggcaagagccccaacgagtaccacatcgagagaagaagcagcagagaggacctgagaagcgccagcgaggagctgaagctgagctgccagagaaccatccccatgaccggcaagagaacctggccctactacagctgcgccagaatcagcgcctggtgctggaagaaggccagcctgcccgagagcagctacttcctgagaggcagccaggagagctgcagacaggtggacgtgcccaagcaccagaccaaccagacccacctgaccgacagcaagctgctgctgcagagcagcctgaccgagaccaacaccgagagcagcagcaaggagaagctggacagcaacagcaactgcctgagcagcgtgagcgccgtggagcccaccctgatggtgatcaaggagcccatcatcaaggacgacaagaagatcaagagcgaggagctgagcagaagaggcagcgaggtgatcagcaacaccaccgaggacacccagctgaccagcgagacccagagcctgaccggcaacaagaagaaggccagaggcaacctgaccaagctgaacctgaccgccaccagcaaggacggccaggaggccaacaacagcgccggcaagaccatccacagaaaggcctgcatcgcccagcagaccttcatcgtgcccgacctggtgaagatcctgaacaccggcagactgaccaacttcaagatccccctgctgaagaacaagagcgagaagagaaaggaggtgaacgccaagagcagcgagagagaggcctacagccccctggagctgctggacaacctgagcggcgccgacgtgagacagaacagaagcaaggagaacgtgagcatgatgatgctgggcccccagaccctgagcatcagaaacagcgtgacccccgtgcaggccagcagcgacagcttctacaacaagaagagctacagcatcagccccagcttcaccaagcagggcaacaacagcaagcccagcaaccacgtgagcgagcccggcaacatcgtgagcaacaaggaggtggccagcctgaccgtggagaacaacgccttcagctgcgaccccggctacgtggagaagagccccagcttctgctgcaacgagcaggagaccttcagacccgtgagcagcgaggtgagaggcagaaagatcaccaagaacttcagcgaggtgggcttccccgacatcctgaaggcctacgaggacgacgtgctgctgatcgacgtgatccaggacgaccccgacctgttcggcgtgagcaacgagggcgagctgagcttcaccagcgaggtgcccaagatcagccaggagcccaacgtggccggcgagcaccagagcaccgacagcaagtacatggagacccccgtgaagaaggagcccagcgacgacctgagagagctgcccgtgctggactgcggctggatcaagcccgacatctgcgccagcaacagcgccgagagcgagatcaagagagaccccaaggacgtgaacaccagcctgggcgaggtggccaacgagaccagcgagaacgagaccctgggcgacttcagcgagcagatcaagggcagcgacctggacgagaagcacagattcaccgacaaggtgatcaccaaggaggagaaggagaacatctacgaggtgtgcaagagcaaggacagcagaaacgccgacttcatggtgggcgagtgccagttcgccgtgcccgtgcccaagcccctgtgcctgctggtgccccccctgaacctgagcggcagacaggaggacaccatcctgaacacctggatgaacgacttcagattcctgggcaagcacagcgtgctgaagctgcagaaccccgagacctgcgagatcttcaagagagagaagaacgtgggcgtgttccagaagagcctgggcctgatgatcccctacaagtactgcaagttccacttcaacaccctgagaggctgcgagagacccctgtgcaagttcgcccacgtgcccgagcagggcgacgagaaggtgtgcatggacgtgttcaagaagtacatcaacatcaacgagctgtgcctgctgcagagagccgtgaacatcttcatggagtactacagaaagttcccccccggcgtgtacttcgacctgcaggtgctgaacgacctgctgaacagcctgctgaagcactgcctgctgaaggaggtgttccagatcgtgaacctgagcatcatggtgaagatgctgcccagcctgaagatcctgctgaacatcttcgagtacgtggccaccatgaagctgagaaacgccgtgcccgccctgatcgacatcttctgcaagctggtggaggccggcatggtgctggaccccgagcacttcaactacatcgtgaagctgctgtaccaggtgcaggccagcaagcaggagatcaccgccgtgctggagatgaagagcagactgcagatgagaagattcaagaagaactggaagtgcgacctggacagcgccctgaacaagctggagcactgcaaggagaagggcgactggaccaagctgggcaagctgtacatcaacgtgaagatgggctgcgagaagttcgccgacttccagaccttctgcgcctgcatcgccgagaccctgaccaagaactacgaggacgagagacccgacatccccttctgcgagttcgccgagaccgtgagcaaggacccccagaacagcaaggtggacaagggcgtgctgggcagaatcggcatcagcgccatgtacttctaccacaagctgctgcagtggagcaagggcagaaaggtgctggagaagctgtacgagctgaagatccacttcaccagcctgaagggcctgatcggccccgagaagctggccagcagatgccagatcgtgaacgtggccgccgagatcttcctgaagagcggcagcctggacggcgccatctgggtgatgagagagagcgagtggatcatcaacacccccctgtggccctgcgacagactggacgtgctgaacagacacaacctgctgtgcaccatcgcccacgagatcctggccaagagcctgtacagacagaccttcgaggtgctgcagaacctgcccggcttccagaacagccaggagaccgtggaggtgagccagtacagcctgctgttcaacaagctgctgggcagctgcatcgagagcagcagcctgggcatgagcagcagcgtggccgagttcatgatcagcaagagcatccccatcgacttcagcttcctgagaagactgatcaccagcctgggcagaagcagactgtggctgaaggccagagcccactacaagagcgccctgagcctgggctgctacccccccctggagggcaacctgtacagaaagctgctgctgatccccagctacctgagcgagatcgagatgctgctggccatcgagatcttcatggtgagcaacgccagcagcatccagagccccggcaccagcacccagatcctgcagatcgtgctgaagagatgcgaggacaaccagagcagaagcaacgacgactaccaggccgccgtggagagactgatcatggccgccagaatcagcgaccccaagctgttcgtgaagcacatgaccgtgaacgtgaacaaggagcaggtgtacagcctggagcactgcagcgccctgaagtggctgaaggagaacatgaagtgggccggcaaggtgtggctgttcagcaaccactag

SEQ ID NO: 76892 - DNA, 207 bp, Artificial Sequence
  Description of Artificial Sequence: Synthetic coding sequence
atggtgtactaccccgagctgttcgtgtgggtgagccaggagcccttccccaacaaggacatggagggcagactgcccaagggcagactgcccgtgcccaaggaggtgaacagaaagaagaacgacgagaccaacgccgccagcctgacccccctgggcagcagcgagctgagaagccccagaatcagctacctgcacttcttctag

SEQ ID NO: 76893 - DNA, 207 bp, Artificial Sequence; identical to SEQ ID NO: 76892
  Description of Artificial Sequence: Synthetic coding sequence

SEQ ID NO: 76894 - DNA, 339 bp, Artificial Sequence
  Description of Artificial Sequence: Synthetic coding sequence
atgaagggcgtgtggaactacagcgccctgagcagaagagaggacgagaccagaacccagagaagcagaatgaccgacagagtgccctgcagcaagtgcttccaggtgcactgccagatcagcgtgctgaactgcgtgtactaccccgagctgttcgtgtgggtgagccaggagcccttccccaacaaggacatggagggcagactgcccaagggcagactgcccgtgcccaaggaggtgaacagaaagaagaacgacgagaccaacgccgccagcctgacccccctgggcagcagcgagctgagaagccccagaatcagctacctgcacttcttctag

SEQ ID NO: 76895 - DNA, 207 bp, Artificial Sequence; identical to SEQ ID NO: 76892
  Description of Artificial Sequence: Synthetic coding sequence

SEQ ID NO: 76896 - DNA, 207 bp, Artificial Sequence; identical to SEQ ID NO: 76892
  Description of Artificial Sequence: Synthetic coding sequence

SEQ ID NO: 76897 - DNA, 207 bp, Artificial Sequence; identical to SEQ ID NO: 76892
  Description of Artificial Sequence: Synthetic coding sequence

SEQ ID NO: 76898 - DNA, 207 bp, Artificial Sequence; identical to SEQ ID NO: 76892
  Description of Artificial Sequence: Synthetic coding sequence

SEQ ID NO: 76899 - DNA, 207 bp, Artificial Sequence; identical to SEQ ID NO: 76892
  Description of Artificial Sequence: Synthetic coding sequence

SEQ ID NO: 76900 - DNA, 207 bp, Artificial Sequence; identical to SEQ ID NO: 76892
  Description of Artificial Sequence: Synthetic coding sequence

SEQ ID NO: 76901 - DNA, 18 bp, Artificial Sequence
  Description of Artificial Sequence: Synthetic coding sequence
atggtgtactacccctag

SEQ ID NO: 76902 - DNA, 102 bp, Artificial Sequence
  Description of Artificial Sequence: Synthetic coding sequence
atggtgtactaccccgagctgttcgtgtgggtgagccaggagcccttccccaacaaggacatggagggcagactgcccaagggcagactgcccgtgccctag

SEQ ID NO: 76903 - DNA, 207 bp, Artificial Sequence; identical to SEQ ID NO: 76892
  Description of Artificial Sequence: Synthetic coding sequence

SEQ ID NO: 76904 - DNA, 207 bp, Artificial Sequence; identical to SEQ ID NO: 76892
  Description of Artificial Sequence: Synthetic coding sequence

SEQ ID NO: 76905 - DNA, 198 bp, Artificial Sequence
  Description of Artificial Sequence: Synthetic coding sequence
atggtgtactaccccgagctgttcgtgtgggtgagccaggagcccttccccaacaaggacatggagggcagactgcccaagggcagactgcccgtgcccaaggaggtgaacagaaagaagaacgacgagaccaacgccgccagcctgacccccctgggcagcagcgagctgagaagccccagaatcagctacctgtag

SEQ ID NO: 76906 - DNA, 735 bp, Artificial Sequence
  Description of Artificial Sequence: Synthetic coding sequence
atgcactacggcgccgccacccacatccagaacagcagaagccacggcctggagaccgtgcccggccaccagagactggagagaggcgccggcggcgagacccccgagttccccggctgccacagccccgccccccccgagaacttcggcaacgagctgctgcccctgagcgcccccctgcagggcctgagcgagggcctgtacccccccggcagaaacaagaccctgcccgccggcgtgctgagagagggcgccgtgcagttcctgcacagaggcctgtgcaacagcaacctgagcagcgaggccagcgccagacccagcggcacccaggacgagctgcacagcagcagaagaaagaccggccagaccagaagagagggcgccagaaagcacctggtgtgcagcttcagactgtaccccttcaccgtgcacaccgtgagccccggcaacagccacctggccctgtaccaggtgttcaaggccgtgaagctgtgccccagcgagaccagcttcttcctgagcagaaagagcctgaagagcagcgacccctggcacccccccagcctgagccccaacagctggaacagacaggccggcttcagagcctggagcagccacctgatcagcctgagcctgacctgcagcgacagccagagcagaagagtgagcagcagccagcagccccccctgcacagcctgagcagccacagaagagccgcccacgtgcccgagtag

SEQ ID NO: 76907 - DNA, 480 bp, Artificial Sequence
  Description of Artificial Sequence: Synthetic coding sequence
atgtacagaagaaagagcggctggaccggctgcgccatcacctgcagcccctgcaccgccatgacccagctgagaaactgcatgagactgagcagaagctgcagcctgacctgggagacccccagatggtacatggccggcagagtggccaccagcaccagcggctgccactgctggatgagcagaagagacctgacccccctgccccaccccagcgagcccggcgtgctggactgcctgggcccctgccacctgctgcccctgctgagccccggcagcccctgctgggtgctgggcctgcacttcagcctgcacccccccagcgccgccagcgccagccacgccctgaccatcaccagcctgccccccggcctgctgcccttcgtgggcgtggagctgaccgcccacccccaggccctgatgggcagaggcttccccagcggcatgggcgccgccggcagacacctgtgcttcctgtag

SEQ ID NO: 76908 - DNA, 480 bp, Artificial Sequence; identical to SEQ ID NO: 76907
  Description of Artificial Sequence: Synthetic coding sequence

SEQ ID NO: 76909 - DNA, 480 bp, Artificial Sequence; identical to SEQ ID NO: 76907
  Description of Artificial Sequence: Synthetic coding sequence

SEQ ID NO: 76910 - DNA, 480 bp, Artificial Sequence; identical to SEQ ID NO: 76907
  Description of Artificial Sequence: Synthetic coding sequence

SEQ ID NO: 76911 - DNA, 294 bp, Artificial Sequence
  Description of Artificial Sequence: Synthetic coding sequence
atgagcagcgcccccgagccccccaccttcaagaaggagccccccaaggagaaggagttccagagccccggcctgagaggcgtgagaaccaccaccctgttcagagccgtgaaccccgagctgttcatcaagcccaacaagcccgtgatggccttcggcctggtgaccctgagcctgtgcgtggcctacatcggctacctgcacgccatccaggagaacaagaaggacctgtacgaggccatcgacagcgagggccacagctacatgagaagaaagaccagcaagtgggactag

SEQ ID NO: 76912 - DNA, 768 bp, Artificial Sequence
  Description of Artificial Sequence: Synthetic coding sequence
atgaccaagaccagcacctgcatctaccacttcctggtgctgagctggtacaccttcctgaactactacatcagccaggagggcaaggacgaggtgaagcccaagatcctggccaacggcgccagatggaagtacatgaccctgctgaacctgctgctgcagaccatcttctacggcgtgacctgcctggacgacgtgctgaagagaaccaagggcggcaaggacatcaagttcctgaccgccttcagagacctgctgttcaccaccctggccttccccgtgagcaccttcgtgttcctggccttctggatcctgttcctgtacaacagagacctgatctaccccaaggtgctggacaccgtgatccccgtgtggctgaaccacgccatgcacaccttcatcttccccatcaccctggccgaggtggtgctgagaccccacagctaccccagcaagaagaccggcctgaccctgctggccgccgccagcatcgcctacatcagcagaatcctgtggctgtacttcgagaccggcacctgggtgtaccccgtgttcgccaagctgagcctgctgggcctggccgccttcttcagcctgagctacgtgttcatcgccagcatctacctgctgggcgagaagctgaaccactggaagtgggtgagcgtgcagatcctgcagagatggagactggagagcgtgggcatctgcttccagtggcccgactggaagagccccgccaagcaccagctggtgaagaacatcagatag

SEQ ID NO: 76913 - DNA, 510 bp, Artificial Sequence
  Description of Artificial Sequence: Synthetic coding sequence
atgaccaagaccagcacctgcatctaccacttcctggtgctgagctggtacaccttcctgaactactacatcagccaggagggcaaggacgaggtgaagcccaagatcctggccaacggcgccagatggaagtacatgaccctgctgaacctgctgctgcagaccatcttctacggcgtgacctgcctggacgacgtgctgaagagaaccaagggcggcaaggacatcaagttcctgaccgccttcagagacctgctgttcaccaccctggccttccccgtgagcaccttcgtgttcctggccttctggatcctgttcctgtacaacagagacctgatctaccccaaggtgctggacaccgtgatccccgtgtggctgaaccacgccatgcacaccttcatcttccccatcaccctggccgaggtggtgctgagaccccacagctaccccagcaagaagaccggcctgaccctgctggccgccgccagcatcgcctacatcagcagatag

SEQ ID NO: 76914 - DNA, 693 bp, Artificial Sequence
  Description of Artificial Sequence: Synthetic coding sequence
atgaccaagaccagcacctgcatctaccacttcctggtgctgagctggtacaccttcctgaactactacatcagccaggagggcaaggacgaggtgaagcccaagatcctggccaacggcgccagatggaagtacatgaccctgctgaacctgctgctgcagaccatcttctacggcgtgacctgcctggacgacgtgctgaagagaaccaagggcggcaaggacatcaagttcctgaccgccttcagagacctgctgttcaccaccctggccttccccgtgagcaccttcgtgttcctggccttctggatcctgttcctgtacaacagagacctgatctaccccaaggtgctggacaccgtgatccccgtgtggctgaaccacgccatgcacaccttcatcttccccatcaccctggccgaggtggtgctgagaccccacagctaccccagcaagaagaccggcctgaccctgctggccgccgccagcatcgcctacatcagcagaatcctgtggctgtacttcgagaccggcacctgggtgtaccccgtgttcgccaagctgagcctgctgggcctggccgccttcttcagcctgagctacgtgttcatcgccagcatctacctgctgggcgagaagctgaaccactggaagtggggcgacatgagacagcccagaaagaagagaaagtag

SEQ ID NO: 76915 - DNA, 507 bp, Artificial Sequence
  Description of Artificial Sequence: Synthetic coding sequence
atgaccaagaccagcacctgcatctaccacttcctggtgctgagctggtacaccttcctgaactactacatcagccaggagggcaaggacgaggtgaagcccaagatcctggccaacggcgccagatggaagtacatgaccctgctgaacctgctgctgcagaccatcttctacggcgtgacctgcctggacgacgtgctgaagagaaccaagggcggcaaggacatcaagttcctgaccgccttcagagacctgctgttcaccaccctggccttccccgtgagcaccttcgtgttcctggccttctggatcctgttcctgtacaacagagacctgatctaccccaaggtgctggacaccgtgatccccgtgtggctgaaccacgccatgcacaccttcatcttccccatcaccctggccgaggtggtgctgagaccccacagctaccccagcaagaagaccggcctgaccctgctggccgccgccagcatcgcctacatcagctag

SEQ ID NO: 76916 - DNA, 675 bp, Artificial Sequence
  Description of Artificial Sequence: Synthetic coding sequence
atgagcttcgtggaggacgtgaccatcggcgagggcgagagcatcccccccgacacccagttcgtgaagacctggagaatccagaacagcggcgccgaggcctggccccccggcgtgtgcctgaagtacgtgggcggcgaccagttcggccacgtgaacatggtgatggtgagaagcctggagccccaggagatcgccgacgtgagcgtgcagatgtgcagccccagcagagccggcatgtaccagggccagtggagaatgtgcaccgccaccggcctgtactacggcgacgtgatctgggtgatcctgagcgtggaggtgggcggcctgctgggcgtgacccagcagctgagcagcttcgagaccgagttcaacacccagccccacagaaaggtggagggcaacttcaaccccttcgccagcccccagaagaacagacagagcgacgagaacaacctgaaggaccccggcggcagcgagttcgacagcatcagcaagaacacctgggcccccgcccccgacacctgggcccccgcccccgaccagaccgagcaggaccagaacagactgagccagaacagcgtgaacctgagccccagcagccacgccaacaacctgagcgtggtgacctacagcaagggcctgcacggcccctaccccttcggccagagctag

SEQ ID NO: 76917 - DNA, 897 bp, Artificial Sequence
  Description of Artificial Sequence: Synthetic coding sequence
atggagggcatggacgtggacctggaccccgagctgatgcagaagttcagctgcctgggcaccaccgacaaggacgtgctgatcagcgagttccagagactgctgggcttccagctgaaccccgccggctgcgccttcttcctggacatgaccaactggaacctgcaggccgccatcggcgcctactacgacttcgagagccccaacatcagcgtgcccagcatgagcttcgtggaggacgtgaccatcggcgagggcgagagcatcccccccgacacccagttcgtgaagacctggagaatccagaacagcggcgccgaggcctggccccccggcgtgtgcctgaagtacgtgggcggcgaccagttcggccacgtgaacatggtgatggtgagaagcctggagccccaggagatcgccgacgtgagcgtgcagatgtgcagccccagcagagccggcatgtaccagggccagtggagaatgtgcaccgccaccggcctgtactacggcgacgtgatctgggtgatcctgagcgtggaggtgggcggcctgctgggcgtgacccagcagctgagcagcttcgagaccgagttcaacacccagccccacagaaaggtggagggcaacttcaaccccttcgccagcccccagaagaacagacagagcgacgagaacaacctgaaggaccccggcggcagcgagttcgacagcatcagcaagaacacctgggcccccgcccccgacacctgggcccccgcccccgaccagaccgagcaggaccagaacagactgagccagaacagcgtgaacctgagccccagcagccacgccaacaacctgagcgtggtgacctacagcaagggcctgcacggcccctaccccttcggccagagctag

SEQ ID NO: 76918 - DNA, 699 bp, Artificial Sequence
  Description of Artificial Sequence: Synthetic coding sequence
atggagggcatggacgtggacctggaccccgagctgatgcagaagttcagctgcctgggcaccaccgacaaggacgtgctgatcagcgagttccagagactgctgggcttccagctgaaccccgccggctgcgccttcttcctggacatgaccaactggaacctgcaggccgccatcggcgcctactacgacttcgagagccccaacatcagcgtgcccagcatgagcttcgtggaggacgtgaccatcggcgagggcgagagcatcccccccgacacccagttcgtgaagacctggagaatccagaacagcgacgtgatctgggtgatcctgagcgtggaggtgggcggcctgctgggcgtgacccagcagctgagcagcttcgagaccgagttcaacacccagccccacagaaaggtggagggcaacttcaaccccttcgccagcccccagaagaacagacagagcgacgagaacaacctgaaggaccccggcggcagcgagttcgacagcatcagcaagaacacctgggcccccgcccccgacacctgggcccccgcccccgaccagaccgagcaggaccagaacagactgagccagaacagcgtgaacctgagccccagcagccacgccaacaacctgagcgtggtgacctacagcaagggcctgcacggcccctaccccttcggccagagctag

SEQ ID NO: 76919 - DNA, 126 bp, Artificial Sequence
  Description of Artificial Sequence: Synthetic coding sequence
atgggcgacatctacatcacctggatcggctgcggcctggacagactgcagtgggagaacgtgagcgccatgatcgaggaggtgttcgaggccaccgacatcaagatcaccgtgtacaccctgtag

SEQ ID NO: 76920 - DNA, 459 bp, Artificial Sequence
  Description of Artificial Sequence: Synthetic coding sequence
atggccagcagcctgaacgaggaccccgagggcagcagaatcacctacgtgaagggcgacctgttcgcctgccccaagaccgacagcctggcccactgcatcagcgaggactgcagaatgggcgccggcatcgccgtgctgttcaagaagaagttcggcggcgtgcaggagctgctgaaccagcagaagaagagcggcgaggtggccgtgctgaagagagacggcagatacatctactacctgatcaccaagaagagagccagccacaagcccacctacgagaacctgcagaagagcctggaggccatgaagagccactgcctgaagaacggcgtgaccgacctgagcatgcccagaatcggctgcggcctggacagactgcagtgggagaacgtgagcgccatgatcgaggaggtgttcgaggccaccgacatcaagatcaccgtgtacaccctgtag

SEQ ID NO: 76921 - DNA, 459 bp, Artificial Sequence; identical to SEQ ID NO: 76920
  Description of Artificial Sequence: Synthetic coding sequence

SEQ ID NO: 76922 - DNA, 459 bp, Artificial Sequence; identical to SEQ ID NO: 76920
  Description of Artificial Sequence: Synthetic coding sequence

SEQ ID NO: 76923 - DNA, 459 bp, Artificial Sequence; identical to SEQ ID NO: 76920
  Description of Artificial Sequence: Synthetic coding sequence

SEQ ID NO: 76924 - DNA, 396 bp, Artificial Sequence
  Description of Artificial Sequence: Synthetic coding sequence
atggccagcagcctgaacgaggaccccgagggcagcagaatcacctacgtgaagggcgacctgttcgcctgccccaagaccgacagcctggcccactgcatcagcgaggactgcagaatgggcgccggcatcgccgtgctgttcaagaagaagttcggcggcgtgcaggagctgctgaaccagcagaagaagagcggcgaggtggccgtgctgaagagagacggcagatacatctactacctgatcaccaagaagagagccagccacaagcccacctacgagaacctgcagaagagcctggaggccatgaagagccactgcctgaagaacggcgtgaccgacctgagcatgcccagaatcggctgcggcctggacagactgcagtgggagaactag

SEQ ID NO: 76925 - DNA, 1371 bp, Artificial Sequence
  Description of Artificial Sequence: Synthetic coding sequence
atggaggccctgggcgacctggagggccccagagcccccggcggcgacgaccccgccggcagcgccggcgagacccccggctggctgagcagagagcaggtgttcgtgctgatcagcgccgccagcgtgaacctgggcagcatgatgtgctacagcatcctgggccccttcttccccaaggaggccgagaagaagggcgccagcaacaccatcatcggcatgatcttcggctgcttcgccctgttcgagctgctggccagcctggtgttcggcaactacctggtgcacatcggcgccaagttcatgttcgtggccggcatgttcgtgagcggcggcgtgaccatcctgttcggcgtgctggacagagtgcccgacggccccgtgttcatcgccatgtgcttcctggtgagagtgatggacgccgtgagcttcgccgccgccatgaccgccagcagcagcatcctggccaaggccttccccaacaacgtggccaccgtgctgggcagcctggagaccttcagcggcctgggcctgatcctgggcccccccgtgggcggcttcctgtaccagagcttcggctacgaggtgcccttcatcgtgctgggctgcgtggtgctgctgatggtgcccctgaacatgtacatcctgcccaactacgagagcgaccccggcgagcacagcttctggaagctgatcgccctgcccaaggtgggcctgatcgccttcgtgatcaacagcctgagcagctgcttcggcttcctggaccccaccctgagcctgttcgtgctggagaagttcaacctgcccgccggctacgtgggcctggtgttcctgggcatggccctgagctacgccatcagcagccccctgttcggcctgctgagcgacaagagaccccccctgagaaagtggctgctggtgttcggcaacctgatcaccgccggctgctacatgctgctgggccccgtgcccatcctgcacatcaagagccagctgtggctgctggtgctgatcctggtggtgagcggcctgagcgccggcatgagcatcatccccaccttccccgagatcctgagctgcgcccacgagaacggcttcgaggagggcctgagcaccctgggcctggtgagcggcctgttcagcgccatgtggagcatcggcgccttcatgggccccaccctgggcggcttcctgtacgagaagatcggcttcgagtgggccgccgccatccagggcctgtgggccctgatcagcggcctggccatgggcctgttctacctgctggagtacagcagaagaaagagaagcaagagccagaacatcctgagcaccgaggaggagagaaccaccctgctgcccaacgagacctag

SEQ ID NO: 76926 - DNA, 324 bp, Artificial Sequence
  Description of Artificial Sequence: Synthetic coding sequence
atggaggccctgggcgacctggagggccccagagcccccggcggcgacgaccccgccggcagcgccggcgagacccccggctggctgagcagagagcaggtgttcgtgctgatcagcgccgccagcgtgaacctgggcagcatgatgtgctacagcatcctgggccccttcttccccaaggaggccgagaagaagggcgccagcaacaccatcatcggcatgatcttcggcttccagttcaccagctggatctgcggcaccagcatccccggctacggcaccgtgctgtgccacctgttcaccaccatctggagccccaagtag

SEQ ID NO: 76927 - DNA, 324 bp, Artificial Sequence; identical to SEQ ID NO: 76926
  Description of Artificial Sequence: Synthetic coding sequence

SEQ ID NO: 76928 - DNA, 711 bp, Artificial Sequence
  Description of Artificial Sequence: Synthetic coding sequence
atgttctgcttcgtgagagtggccggcatcctgggcatctggaagctgagctgcacctactggagcaagatctacgtgtgcagcagaaacgtgtgcctgagaagaagctacaacagcctgtggggcagcctggagaccttcagcggcctgggcctgatcctgggcccccccgtgggcggcttcctgtaccagagcttcggctacgaggtgcccttcatcgtgctgggctgcgtggtgctgctgatggtgcccctgaacatgtacatcctgcccaactacgagagcgaccccggcgagcacagcttctggaagctgatcgccctgcccaaggtgggcctgatcgccttcgtgatcaacagcctgagcagctgcttcggcttcctggaccccaccctgagcctgttcgtgctggagaagttcaacctgcccgccggctacgtgggcctggtgttcctgggcatggccctgagctacgccatcagcagccccctgttcggcctgctgagcgacaagagaccccccctgagaaagtggctgctggtgttcggcaacctgatcaccgccggctgctacatgctgctgggccccgtgcccatcctgcacatcaagagccagctgtggctgctggtgctgatcctggtggtgagcggcctgagcgccggcatgagcatcatccccaccttccccgagatcctgagctgcgcccagtag

SEQ ID NO: 76929 - DNA, 654 bp, Artificial Sequence
  Description of Artificial Sequence: Synthetic coding sequence
atggacgcccccagaagattccccaccctggtgcagctgatgcagcccaaggccatgcccgtggaggtgctgggccacctgcccaagagattcagctggttccacagcgagttcctgaagaaccccaaggtggtgagactggaggtgtggctggtggagaagatcttcggcagaggcggcgagagaatcccccacgtgcagggcatgagccagatcctgatccacgtgaacagactggaccccaacggcgaggccgagatcctggtgttcggcagacccagctaccaggaggacaccatcaagatgatcatgaacctggccgactaccacagacagctgcaggccaagggcagcggcaaggccctggcccaggacgtggccacccagaaggccgagacccagagaagcagcatcgaggtgagagaggccggcacccagagaagcgtggaggtgagagaggccggcacccagagaagcgtggaggtgcaggaggtgggcacccagggcagccccgtggaggtgcaggaggccggcacccagcagagcctgcaggccgccaacaagagcggcacccagagaagccccgaggccgccagcaaggccgtgacccagagattcagagaggacgccagagaccccgtgaccagactgtag

SEQ ID NO: 76930 - DNA, 1416 bp, Artificial Sequence
  Description of Artificial Sequence: Synthetic coding sequence
atgcccagcgagacccacgccatgctggccaccctggccagagtggccgccctgagaagaacctgcctgttcagcggcagaggcggcggcagaggcctgtggaccggcagaccccagagcgacatgaacaacatcaagcccctggagggcgtgaagatcctggacctgaccagagtgctggccggccccttcgccaccatgaacctgggcgacctgggcgccgaggtgatcaaggtggagagacccggcgccggcgacgacaccagaacctggggcccccccttcgtgggcaccgagagcacctactacctgagcgtgaacagaaacaagaagagcatcgccgtgaacatcaaggaccccaagggcgtgaagatcatcaaggagctggccgccgtgtgcgacgtgttcgtggagaactacgtgcccggcaagctgagcgccatgggcctgggctacgaggacatcgacgagatcgccccccacatcatctactgcagcatcaccggctacggccagaccggccccatcagccagagagccggctacgacgccgtggccagcgccgtgagcggcctgatgcacatcaccggccccgagaacggcgaccccgtgagacccggcgtggccatgaccgacctggccaccggcctgtacgcctacggcgccatcatggccggcctgatccagaagtacaagaccggcaagggcctgttcatcgactgcaacctgctgagcagccaggtggcctgcctgagccacatcgccgccaactacctgatcggccagaaggaggccaagagatggggcaccgcccacggcagcatcgtgccctaccaggccttcaagaccaaggacggctacatcgtggtgggcgccggcaacaaccagcagttcgccaccgtgtgcaagatcctggacctgcccgagctgatcgacaacagcaagtacaagaccaaccacctgagagtgcacaacagaaaggagctgatcaagatcctgagcgagagattcgaggaggagctgaccagcaagtggctgtacctgttcgagggcagcggcgtgccctacggccccatcaacaacatgaagaacgtgttcgccgagccccagaacgccgtgagcggcttccagagcctgctgcacagcctggcccacggccccttcctgcacctgcagggcagcgccagagtgctgcacaacggcctggtgatggagatggagcaccccaccgtgggcaagatcagcgtgcccggccccgccgtgagatacagcaagttcaagatgagcgaggccagacccccccccctgctgggccagcacaccacccacatcctgaaggaggtgctgagatacgacgacagagccatcggcgagctgctgagcgccggcgtggtggaccagcacgagacccactag

SEQ ID NO: 76931 - DNA, 1338 bp, Artificial Sequence
  Description of Artificial Sequence: Synthetic coding sequence
atgcccagcgagacccacgccatgctggccaccctggccagagtggccgccctgagaagaacctgcctgttcagcggcagaggcggcggcagaggcctgtggaccggcagaccccagagcgacatgaacaacatcaagcccctggagggcgtgaagatcctggacctgaccagagtgctggccggccccttcgccaccatgaacctgggcgacctgggcgccgaggtgatcaaggtggagagacccggcgccggcgacgacaccagaacctggggcccccccttcgtgggcaccgagagcacctactacctgagcgtgaacagaaacaagaagagcatcgccgtgaacatcaaggaccccaagggcgtgaagatcatcaaggagctggccgccgtgtgcgacgtgttcgtggagaactacgtgcccggcaagctgagcgccatgggcctgggctacgaggacatcgacgagatcgccccccacatcatctactgcagcatcaccggctacggccagaccggccccatcagccagagagccggctacgacgccgtggccagcgccgtgagcggcctgatgcacatcaccggccccgagaacggcgaccccgtgagacccggcgtggccatgaccgacctggccaccggcctgtacgcctacggcgccatcatggccggcctgatccagaagtacaagaccggcaagggcctgttcatcgactgcaacctgctgagcagccaggtggcctgcctgagccacatcgccgccaactacctgatcggccagaaggaggccaagagatggggcaccgcccacggcagcatcgtgccctaccaggccttcaagaccaaggacggctacatcgtggtgggcgccggcaacaaccagcagttcgccaccgtgtgcaagatcctggacctgcccgagctgatcgacaacagcaagtacaagaccaaccacctgagagtgcacaacagaaaggagctgatcaagatcctgagcgagagattcgaggaggagctgaccagcaagtggctgtacctgttcgagggcagcggcgtgccctacggccccatcaacaacatgaagaacgtgttcgccgagccccaggtgctgcacaacggcctggtgatggagatggagcaccccaccgtgggcaagatcagcgtgcccggccccgccgtgagatacagcaagttcaagatgagcgaggccagacccccccccctgctgggccagcacaccacccacatcctgaaggaggtgctgagatacgacgacagagccatcggcgagctgctgagcgccggcgtggtggaccagcacgagacccactag

SEQ ID NO: 76932 - DNA, 609 bp, Artificial Sequence
  Description of Artificial Sequence: Synthetic coding sequence
atgctggccaccctggccagagtggccgccctgagaagaacctgcctgttcagcggcagaggcggcggcagaggcctgtggaccggcagaccccagagcgacatgaacaacatcaagcccctggagggcgtgaagatcctggacctgaccagagtgctggccggccccttcgccaccatgaacctgggcgacctgggcgccgaggtgatcaaggtggagagacccggcgccggcgacgacaccagaacctggggcccccccttcgtgggcaccgagagcacctactacctgagcgtgaacagaaacaagaagagcatcgccgtgaacatcaaggaccccaagggcgtgaagatcatcaaggagctggccgccgtgtgcgacgtgttcgtggagaactacgtgcccggcaagctgagcgccatgggcctgggctacgaggacatcgacgagatcgccccccacatcatctactgcagcatcaccgagaagggcttcagccacgtggcccaggacggcctggacctgcagaccagcagcaacctgcccgccctggtgagccagagcgccggcatcaccggcatgagccacagagcctggcccaccagctag

SEQ ID NO: 76933 - DNA, 1194 bp, Artificial Sequence
  Description of Artificial Sequence: Synthetic coding sequence
atgcccagcgagacccacgccatgctggccaccctggccagagtggccgccctgagaagaacctgcctgttcagcggcagaggcggcggcagaggcctgtggaccggcagaccccagagcgacatgaacaacatcaagcccctggagggcgtgaagatcctggacctgaccagagtgctggccggccccttcgccaccatgaacctgggcgacctgggcgccgaggtgatcaaggtggagagacccggcgccggcgacgacaccagaacctggggcccccccttcgtgggcaccgagagcacctactacctgagcgtgaacagaaacaagaagagcatcgccgtgaacatcaaggaccccaagggcgtgaagatcatcaaggagctggccgccgtgtgcgacgtgttcgtggagaactacgtgcccggcaagctgagcgccatgggcctgggctacgaggacatcgacgagatcgccccccacatcatctactgcagcatcaccggctacggccagaccggccccatcagccagagagccggctacgacgccgtggccagcgccgtgagcggcctgatgcacatcaccggccccgaggtggcctgcctgagccacatcgccgccaactacctgatcggccagaaggaggccaagagatggggcaccgcccacggcagcatcgtgccctaccaggccttcaagaccaaggacggctacatcgtggtgggcgccggcaacaaccagcagttcgccaccgtgtgcaagatcctggacctgcccgagctgatcgacaacagcaagtacaagaccaaccacctgagagtgcacaacagaaaggagctgatcaagatcctgagcgagagattcgaggaggagctgaccagcaagtggctgtacctgttcgagggcagcggcgtgccctacggccccatcaacaacatgaagaacgtgttcgccgagccccaggtgctgcacaacggcctggtgatggagatggagcaccccaccgtgggcaagatcagcgtgcccggccccgccgtgagatacagcaagttcaagatgagcgaggccagacccccccccctgctgggccagcacaccacccacatcctgaaggaggtgctgagatacgacgacagagccatcggcgagctgctgagcgccggcgtggtggaccagcacgagacccactag

SEQ ID NO: 76934 - DNA, 540 bp, Artificial Sequence
  Description of Artificial Sequence: Synthetic coding sequence
atgcagagacagaacttcagaccccccacccccccctaccccggccccggcggcggcggctggggcagcggcagcagcttcagaggcacccccggcggcggcggccccagaccccccagccccagagacggctacggcagcccccaccacacccccccctacggccccagaagcagaccctacggcagcagccacagccccagacacggcggcagcttccccggcggcagattcggcagccccagccccggcggctaccccggcagctacagcagaagccccgccggcagccagcagcagttcggctacagccccggccagcagcagacccacccccagggcagccccagaaccagcacccccttcggcagcggcagagtgagagagaagagaatgagcaacgagctggagaactacttcaagcccagcatgctggaggacccctgggccggcctggagcccgtgagcgtggtggacatcagccagcagtacagcaacacccagaccttcaccggcaagaagggcagatacttctgctag

SEQ ID NO: 76935 - DNA, 480 bp, Artificial Sequence
  Description of Artificial Sequence: Synthetic coding sequence
atgaagatcgtggacgagagagagaagaacctggacgacaaggcctacagaaacatcaaggagctggagaactacgccgagaacacccagagcagcctgctgtacctgaccctggagatcctgggcatcaaggacctgcacgccgaccacgccgccagccacatcggcaaggcccagggcatcgtgacctgcctgagagccaccccctaccacggcagcagaagaaaggtgttcctgcccatggacatctgcatgctgcacggcgtgagccaggaggacttcctgagaagaaaccaggacaagaacgtgagagacgtgatctacgacatcgccagccaggcccacctgcacctgaagcacgccagaagcttccacaagaccgtgcccgtgaaggccttccccgccttcctgcagaccgagatcaaggacgccgacacccagggcgtgtgcctggcccagcccgccagcctgggcaagtag

SEQ ID NO: 76936 - DNA, 1002 bp, Artificial Sequence
  Description of Artificial Sequence: Synthetic coding sequence
atggccgccagcgcccacggcagcgtgtggggccccctgagactgggcatccccggcctgtgctgcagaagaccccccctgggcctgtacgccagaatgagaagactgcccggccccgaggtgagcggcagaagcgtggccgccgccagcggccccggcgcctggggcaccgaccactactgcctggagctgctgagaaagagagactacgagggctacctgtgcagcctgctgctgcccgccgagagcagaagcagcgtgttcgccctgagagccttcaacgtggagctggcccaggtgaaggacagcgtgagcgagaagaccatcggcctgatgagaatgcagttctggaagaagaccgtggaggacatctactgcgacaaccccccccaccagcccgtggccatcgagctgtggaaggccgtgaagagacacaacctgaccaagagatggctgatgaagatcgtggacgagagagagaagaacctggacgacaaggcctacagaaacatcaaggagctggagaactacgccgagaacacccagagcagcctgctgtacctgaccctggagatcctgggcatcaaggacctgcacgccgaccacgccgccagccacatcggcaaggcccagggcatcgtgacctgcctgagagccaccccctaccacggcagcagaagaaaggtgttcctgcccatggacatctgcatgctgcacggcgtgagccaggaggacttcctgagaagaaaccaggacaagaacgtgagagacgtgatctacgacatcgccagccaggcccacctgcacctgaagcacgccagaagcttccacaagaccgtgcccgtgaaggccttccccgccttcctgcagaccgtgagcctggaggacttcctgaagaagatccagagagtggacttcgacatcttccaccccagcctgcagcagaagaacaccctgctgcccctgtacctgtacatccagagctggagaaagacctactag

SEQ ID NO: 76937 - DNA, 846 bp, Artificial Sequence
  Description of Artificial Sequence: Synthetic coding sequence
atgcccatcagcatcagccacagcagctggctggtgcagagaaagagagactacgagggctacctgtgcagcctgctgctgcccgccgagagcagaagcagcgtgttcgccctgagagccttcaacgtggagctggcccaggtgaaggacagcgtgagcgagaagaccatcggcctgatgagaatgcagttctggaagaagaccgtggaggacatctactgcgacaaccccccccaccagcccgtggccatcgagctgtggaaggccgtgaagagacacaacctgaccaagagatggctgatgaagatcgtggacgagagagagaagaacctggacgacaaggcctacagaaacatcaaggagctggagaactacgccgagaacacccagagcagcctgctgtacctgaccctggagatcctgggcatcaaggacctgcacgccgaccacgccgccagccacatcggcaaggcccagggcatcgtgacctgcctgagagccaccccctaccacggcagcagaagaaaggtgttcctgcccatggacatctgcatgctgcacggcgtgagccaggaggacttcctgagaagaaaccaggacaagaacgtgagagacgtgatctacgacatcgccagccaggcccacctgcacctgaagcacgccagaagcttccacaagaccgtgcccgtgaaggccttccccgccttcctgcagaccgtgagcctggaggacttcctgaagaagatccagagagtggacttcgacatcttccaccccagcctgcagcagaagaacaccctgctgcccctgtacctgtacatccagagctggagaaagacctactag

SEQ ID NO: 76938 - DNA, 321 bp, Artificial Sequence
  Description of Artificial Sequence: Synthetic coding sequence
atgaaggccaagagaagccaccaggccgtgatcatgagcaccagcctgagagtgagccccagcatccacggctaccacttcgacaccgccagcagaaagaaggccgtgggcaacatcttcgagaacaccgaccaggagagcctggagagactgttcagaaacagcggcgacaagaaggccgaggagagagccaagatcatcttcgccatcgaccaggacgtggaggagaagaccagagccctgatggccctgaagaagagaaccaaggacaagctgttccagttcctgaagctgagaaagtacagcatcaaggtgcactag

SEQ ID NO: 76939 - DNA, 1185 bp, Artificial Sequence
  Description of Artificial Sequence: Synthetic coding sequence
atggccggcgccgccatggccgagagaggcagagtgcccccccccgcccccgcccccagcaccgagggcctgcccagagccttcctgcagagcctgagaaccctgttcgacatcctggacgacagaagaagaggctgcgtgcacctgagagagatcgagagcagatggcagggcaccgacgccagagagctgcccagaggcgtgctggagggcctgagacaggtggcccccgccagcggctacctgaccttcgagagattcgtggccggcctgagaaccagcctgctgagcgccgacggcggccccagagaccccaccagagcccccgccagacccggcgaccagccccccccccccccccagagactggtgttcgcccccgccgacgagcccagaaccgtgctggagagaaagcccctgcccctgggcgtgagagcccccctggccggccccagcgccgccgccagaagccccgagcagctgtgcgcccccgccgaggccgccccctgccccgccgagcccgagagaagccagagcgccgccctggagcccagcagcagcgccgacgccggcgccgtggcctgcagagccctggaggccgacagcggcgacgccagaagagcccccagagccagaggcgagagaagaagacacaccatcgccagcggcgtggactgcggcctgctgaagcagatgaaggagctggagcaggagaaggaggtgctgctgcagggcctggagatgatggccagaggcagagactggtaccagcagcagctgcagagagtgcaggagagacagagaagactgggccagagcagagccagcgccgacttcggcgccgccggcagccccagacccctgggcagactgctgcccaaggtgcaggaggtggccagatgcctgggcgagctgctggccgccgcctgcgccagcagagccctgccccccagcagcagcggccccccctgccccgccctgaccagcaccagcccccccgtgtggcagcagcagaccatcctgatgctgaaggagcagaacagactgctgacccaggaggtgaccgagaagagcgagagaatcacccagctggagcaggagaagagcgccctgatcaagcagctgttcgaggccagagccctgagccagcaggacggcggccccctggacagcaccttcatctag

SEQ ID NO: 76940 - DNA, 1035 bp, Artificial Sequence
  Description of Artificial Sequence: Synthetic coding sequence
atgagaagacccagacagggcggcggcggcgccggcggcagcgccgccgccagagccagagccggcggcctgggcggcggcagcgtgcccgccagagccagaggcgcccccgccgccgccagagccgcctggctgagagacctgtgcgccagaatggccagaccccccagacagcaccccggcgtgtgggccagcctgctgctgctgctgctgaccggccccgccgcctgcgccgccagccccgccgacgacggcgccggccccggcggcagaggccccagaggcagagccagaggcgacaccggcgccgacgaggccgtgcccagacacgacagcagctacggcaccttcgccggcgagttctacgacctgagatacctgagcgaggagggctaccccttccccaccgccccccccgtggaccccttcgccaagatcaaggtggacgactgcggcaagaccaagggctgcttcagatacggcaagcccggctgcaacgccgagacctgcgactacttcctgagctacagaatgatcggcgccgacgtggagttcgagctgagcgccgacaccgacggctgggtggccgtgggcttcagcagcgacaagaagatgggcggcgacgacgtgatggcctgcgtgcacgacgacaacggcagagtgagaatccagcacttctacaacgtgggccagtgggccaaggagatccagagaaaccccgccagagacgaggagggcgtgttcgagaacaacagagtgacctgcagattcaagagacccgtgaacgtgcccagagacgagaccatcgtggacctgcacctgagctggtactacctgttcgcctggggccccgccatccagggcagcatcaccagacacgacatcgacagcccccccgccagcgagagagtggtgagcatctacaagtacgaggacatcttcatgcccagcgccgcctaccagaccttcagcagccccttctgcctgctgctgatcgtggccctgaccttctacctgctgatgggcaccccctag

SEQ ID NO: 76941 - DNA, 393 bp, Artificial Sequence
  Description of Artificial Sequence: Synthetic coding sequence
atgagcagcagcggcggcgcccccggcgccagcgccagcagcgccccccccgcccaggaggagggcatgacctggtggtacagatggctgtgcagactgagcggcgtgctgggcgccgtgagctgcgccatcagcggcctgttcaactgcatcaccatccaccccctgaacatcgccgccggcgtgtggatgatgatggccgtggtgcccatcgtgatcagcctgaccctgaccaccctgctgggcaacgccatcgccttcgccaccggcgtgctgtacggcctgagcgccctgggcaagaagggcgacgccatcagctacgccagaatccagcagcagagacagcaggccgacgaggagaagctggccgagaccctggagggcgagctgtag

SEQ ID NO: 76942 - DNA, 519 bp, Artificial Sequence
  Description of Artificial Sequence: Synthetic coding sequence
atgagcagcagcggcggcgcccccggcgccagcgccagcagcgccccccccgcccaggaggagggcatgacctggtggtacagatggctgtgcagactgagcggcgtgctgggcgccgtgagctgcgccatcagcggcctgttcaactgcatcaccatccaccccctgaacatcgccgccggcgtgtggatgatcatgaacgccttcatcctgctgctgtgcgaggcccccttctgctgccagttcatcgagttcgccaacaccgtggccgagaaggtggacagactgagaagctggcagaaggccgtgttctactgcggcatggccgtggtgcccatcgtgatcagcctgaccctgaccaccctgctgggcaacgccatcgccttcgccaccggcgtgctgtacggcctgagcgccctgggcaagaagggcgacgccatcagctacgccagaatccagcagcagagacagcaggccgacgaggagaagctggccgagaccctggagggcgagctgtag

SEQ ID NO: 76943 - DNA, 345 bp, Artificial Sequence
  Description of Artificial Sequence: Synthetic coding sequence
atgctgaccgccgccggcagcaccgccgagctgagcgcctgcgccatcagcggcctgttcaactgcatcaccatccaccccctgaacatcgccgccggcgtgtggatgatcatgaacgccttcatcctgctgctgtgcgaggcccccttctgctgccagttcatcgagttcgccaacaccgtggccgagaaggtggacagactgagaagctggcagaaggccgtgttctactgcggcatggccgtggtgcccatcgtgatcagcctgaccctgaccaccctgctgggcaacgccatcgccttcgccaccggcgtgctgtacggcctgagcgccctgggcaagtag

SEQ ID NO: 76944 - DNA, 489 bp, Artificial Sequence
  Description of Artificial Sequence: Synthetic coding sequence
atgagcagcagcgccccccccgcccaggaggagggcatgacctggtggtacagatggctgtgcagactgagcggcgtgctgggcgccgtgagctgcgccatcagcggcctgttcaactgcatcaccatccaccccctgaacatcgccgccggcgtgtggatgatcatgaacgccttcatcctgctgctgtgcgaggcccccttctgctgccagttcatcgagttcgccaacaccgtggccgagaaggtggacagactgagaagctggcagaaggccgtgttctactgcggcatggccgtggtgcccatcgtgatcagcctgaccctgaccaccctgctgggcaacgccatcgccttcgccaccggcgtgctgtacggcctgagcgccctgggcaagaagggcgacgccatcagctacgccagaatccagcagcagagacagcaggccgacgaggagaagctggccgagaccctggagggcgagctgtag

SEQ ID NO: 76945 - DNA, 702 bp, Artificial Sequence
  Description of Artificial Sequence: Synthetic coding sequence
atgagcagcagcggcggcgcccccggcgccagcgccagcagcgccccccccgcccaggaggagggcatgacctggtggtacagatggctgtgcagactgagcggcgtgctgggcgccgtgagctgcgccatcagcggcctgttcaactgcatcaccatccaccccctgaacatcgccgccggcgtgtggatgatcatgaacgccttcatcctgctgctgtgcgaggcccccttctgctgccagttcatcgagttcgccaacaccgtggccgagaaggtggacagactgagaagctggcagaaggccgtgttctactgcggcatggccgtggtgcccatcgtgatcagcctgaccctgaccaccctgctgggcaacgccatcgccttcgccaccggcgtgctgtacggcctgagcgccctgggcaagaaggcccagaccgaggccggcagcttcgccgcccagcaccccagagagcccggccccttcagcgagggcaccagacaggccttcgccacccccgccgtggtgagcggcgagatcagaatgcccgccggcgccatgagaagccccatgcccggcagcagcagcagaggcagcagaagaatgagaagaagcagcagaagaccctggagaggcagctgcgagggcctgggcgccccccccagcctgagccccctgctggccctgtgcggcagcaagtag

SEQ ID NO: 76946 - DNA, 576 bp, Artificial Sequence
  Description of Artificial Sequence: Synthetic coding sequence
atgagcagcagcggcggcgcccccggcgccagcgccagcagcgccccccccgcccaggaggagggcatgacctggtggtacagatggctgtgcagactgagcggcgtgctgggcgccgtgagctgcgccatcagcggcctgttcaactgcatcaccatccaccccctgaacatcgccgccggcgtgtggatgatgatggccgtggtgcccatcgtgatcagcctgaccctgaccaccctgctgggcaacgccatcgccttcgccaccggcgtgctgtacggcctgagcgccctgggcaagaaggcccagaccgaggccggcagcttcgccgcccagcaccccagagagcccggccccttcagcgagggcaccagacaggccttcgccacccccgccgtggtgagcggcgagatcagaatgcccgccggcgccatgagaagccccatgcccggcagcagcagcagaggcagcagaagaatgagaagaagcagcagaagaccctggagaggcagctgcgagggcctgggcgccccccccagcctgagccccctgctggccctgtgcggcagcaagtag

SEQ ID NO: 76947 - DNA, 669 bp, Artificial Sequence
  Description of Artificial Sequence: Synthetic coding sequence
atgagcaccctgtgccccccccccagccccgccgtggccaagaccgagatcgccctgagcggcaagagccccctgctggccgccaccttcgcctactgggacaacatcctgggccccagagtgagacacatctgggcccccaagaccgagcaggtgctgctgagcgacggcgagatcaccttcctggccaaccacaccctgaacggcgagatcctgagaaacgccgagagcggcgccatcgacgtgaagttcttcgtgctgagcgagaagggcgtgatcatcgtgagcctgatcttcgacggcaactggaacggcgacagaagcacctacggcctgagcatcatcctgccccagaccgagctgagcttctacctgcccctgcacagagtgtgcgtggacagactgacccacatcatcagaaagggcagaatctggatgcacaaggagagacaggagaacgtgcagaagatcatcctggagggcaccgagagaatggaggaccagggccagagcatcatccccatgctgaccggcgaggtgatccccgtgatggagctgctgagcagcatgaagagccacagcgtgcccgaggagatcgacatcgccgacaccgtgctgaacgacgacgacatcggcgacagctgccacgagggcttcctgctgaagtag

SEQ ID NO: 76948 - DNA, 669 bp, Artificial Sequence; identical to SEQ ID NO: 76947
  Description of Artificial Sequence: Synthetic coding sequence

SEQ ID NO: 76949 - DNA, 1446 bp, Artificial Sequence
  Description of Artificial Sequence: Synthetic coding sequence
atgagcaccctgtgccccccccccagccccgccgtggccaagaccgagatcgccctgagcggcaagagccccctgctggccgccaccttcgcctactgggacaacatcctgggccccagagtgagacacatctgggcccccaagaccgagcaggtgctgctgagcgacggcgagatcaccttcctggccaaccacaccctgaacggcgagatcctgagaaacgccgagagcggcgccatcgacgtgaagttcttcgtgctgagcgagaagggcgtgatcatcgtgagcctgatcttcgacggcaactggaacggcgacagaagcacctacggcctgagcatcatcctgccccagaccgagctgagcttctacctgcccctgcacagagtgtgcgtggacagactgacccacatcatcagaaagggcagaatctggatgcacaaggagagacaggagaacgtgcagaagatcatcctggagggcaccgagagaatggaggaccagggccagagcatcatccccatgctgaccggcgaggtgatccccgtgatggagctgctgagcagcatgaagagccacagcgtgcccgaggagatcgacatcgccgacaccgtgctgaacgacgacgacatcggcgacagctgccacgagggcttcctgctgaacgccatcagcagccacctgcagacctgcggctgcagcgtggtggtgggcagcagcgccgagaaggtgaacaagatcgtgagaaccctgtgcctgttcctgacccccgccgagagaaagtgcagcagactgtgcgaggccgagagcagcttcaagtacgagagcggcctgttcgtgcagggcctgctgaaggacagcaccggcagcttcgtgctgcccttcagacaggtgatgtacgccccctaccccaccacccacatcgacgtggacgtgaacaccgtgaagcagatgcccccctgccacgagcacatctacaaccagagaagatacatgagaagcgagctgaccgccttctggagagccaccagcgaggaggacatggcccaggacaccatcatctacaccgacgagagcttcacccccgacctgaacatcttccaggacgtgctgcacagagacaccctggtgaaggccttcctggaccaggtgttccagctgaagcccggcctgagcctgagaagcaccttcctggcccagttcctgctggtgctgcacagaaaggccctgaccctgatcaagtacatcgaggacgacacccagaagggcaagaagcccttcaagagcctgagaaacctgaagatcgacctggacctgaccgccgagggcgacctgaacatcatcatggccctggccgagaagatcaagcccggcctgcacagcttcatcttcggcagacccttctacaccagcgtgcaggagagagacgtgctgatgaccttctag

SEQ ID NO: 76950 - DNA, 168 bp, Artificial Sequence
  Description of Artificial Sequence: Synthetic coding sequence
atgcagaaccagagcagcaccaaccaccccggcgccagcatgctgatgcacatccacctggacaccagcagcctgaagaccctgcacctgggcaccctgttcttcctgttctacctggccctgacccagaacgaggagaacatctgcgacggcaaggtgaccctgtag

SEQ ID NO: 76951 - DNA, 225 bp, Artificial Sequence
  Description of Artificial Sequence: Synthetic coding sequence
atgcagaaccagagcagcaccaaccaccccggcgccagcatcgccctgagcagacccagcctgaacaaggacttcagagaccacgccgagcagcagcacatcgccgcccagcagaaggccgccctgcagcacgcccacgcccacagcagcggctacttcatcacccaggacagcgccttcggcaacctgatcctgcccgtgctgcccagactggaccccgagtag

SEQ ID NO: 76952 - DNA, 168 bp, Artificial Sequence; identical to SEQ ID NO: 76950
  Description of Artificial Sequence: Synthetic coding sequence

SEQ ID NO: 76953 - DNA, 315 bp, Artificial Sequence
  Description of Artificial Sequence: Synthetic coding sequence
atggccgccaacagcagcggccagggcttccagaacaagaacagagtggccatcctggccgagctggacaaggagaagagaaagctgctgatgcagaaccagagcagcaccaaccaccccggcgccagcatcgccctgagcagacccagcctgaacaaggacttcagagaccacgccgagcagcagcacatcgccgcccagcagaaggccgccctgcagcacgcccacgcccacagcagcggctacttcatcacccaggacagcgccttcggcaacctgatcctgcccgtgctgcccagactggaccccgagtag

SEQ ID NO: 76954 - DNA, 2190 bp, Artificial Sequence
  Description of Artificial Sequence: Synthetic coding sequence
atgttcagcgccctgaagaagctggtgggcagcgaccaggcccccggcagagacaagaacatccccgccggcctgcagagcatgaaccaggccctgcagagaagattcgccaagggcgtgcagtacaacatgaagatcgtgatcagaggcgacagaaacaccggcaagaccgccctgtggcacagactgcagggcagacccttcgtggaggagtacatccccacccaggagatccaggtgaccagcatccactggagctacaagaccaccgacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagaccccccggcagcagctacttcagatacgccgagagcagcatgaagaacagcttcggcctgaagtacctgcacaagttcttcaacatccccttcctgcagctgcagagagagaccctgctgagacagctggagaccaaccagctggacatggacgccaccctggaggagctgagcgtgcagcaggagaccgaggaccagaactacggcatcttcctggagatgatggaggccagaagcagaggccacgccagccccctggccgccaacggccagagccccagccccggcagccagagccccgtggtgcccgccggcgccgtgagcaccggcagcagcagccccggcaccccccagcccgccccccagctgcccctgaacgccgccccccccagcagcgtgccccccgtgccccccagcgaggccctgcccccccccgcctgccccagcgcccccgcccccagaagaagcatcatcagcagactgttcggcaccagccccgccaccgaggccgccccccccccccccgagcccgtgcccgccgccgagggccccgccaccgtgcagagcgtggaggacttcgtgcccgacgacagactggacagaagcttcctggaggacaccacccccgccagagacgagaagaaggtgggcgccaaggccgcccagcaggacagcgacagcgacggcgaggccctgggcggcaaccccatggtggccggcttccaggacgacgtggacctggaggaccagcccagaggcagcccccccctgcccgccggccccgtgcccagccaggacatcaccctgagcagcgaggaggaggccgaggtggccgcccccaccaagggccccgcccccgccccccagcagtgcagcgagcccgagaccaagtggagcagcatccccgccagcaagcccagaagaggcaccgcccccaccagaaccgccgcccccccctggcccggcggcgtgagcgtgagaaccggccccgagaagagaagcagcaccagaccccccgccgagatggagcccggcaagggcgagcaggccagcagcagcgagagcgaccccgagggccccatcgccgcccagatgctgagcttcgtgatggacgaccccgacttcgagagcgagggcagcgacacccagagaagagccgacgacttccccgtgagagacgaccccagcgacgtgaccgacgaggacgagggccccgccgagcccccccccccccccaagctgcccctgcccgccttcagactgaagaacgacagcgacctgttcggcctgggcctggaggaggccggccccaaggagagcagcgaggagggcaaggagggcaagacccccagcaaggagaagaagaagaagaagaagaagggcaaggaggaggaggagaaggccgccaagaagaagagcaagcacaagaagagcaaggacaaggaggagggcaaggaggagagaagaagaagacagcagagaccccccagaagcagagagagaaccgccgccgacgagctggaggccttcctgggcggcggcgcccccggcggcagacaccccggcggcggcgactacgaggagctgtag

SEQ ID NO: 76955 - DNA, 1563 bp, Artificial Sequence
  Description of Artificial Sequence: Synthetic coding sequence
atgttcagcgccctgaagaagctggtgggcagcgaccaggcccccggcagagacaagaacatccccgccggcctgcagagcatgaaccaggccctgcagagaagattcgccaagggcgtgcagtacaacatgaagatcgtgatcagaggcgacagaaacaccggcaagaccgccctgtggcacagactgcagggcagacccttcgtggaggagtacatccccacccaggagatccaggtgaccagcatccactggagctacaagaccaccgacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagaccccccggcagcagctacttcagatacgccgagagcagcatgaagaacagcttcggcctgaagtacctgcacaagttcttcaacatccccttcctgcagctgcagagagagaccctgctgagacagctggagaccaaccagctggacatggacgccaccctggaggagctgagcgtgcagcaggagaccgaggaccagaactacggcatcttcctggagatgatggaggccagaagcagaggccacgccagccccctggccgccaacggccagagccccagccccggcagccagagccccgtggtgcccgccggcgccgtgagcaccggcagcagcagccccggcaccccccagcccgccccccagctgcccctgaacgccgccccccccagcagcgtgccccccgtgccccccagcgaggccctgcccccccccgcctgccccagcgcccccgcccccagaagaagcatcatcagcagaccccccccctggggctggagactgagaggcgccctgggcagaagaggccagtggcccccctggggcggcggcagagcctgccactgcctgggcagacacctgcccctgtaccacagactgtgcagatgccccgtggccgccgtgtgcgccagcgagctggaggaggccggccactggtggagccccggctgggccctgcaggtgctgggcctgcaggcccagtgcgagcccgccctgcaggagggcagaggccagctggccagcgccagactgggcggccaccccggccccctgggcgccgagccccccgtgttcctgagagacgtgaccgaggcccaggagggccccgtgagagtgtgcctgcagagactgggcagaggcagactggccgtgggctgcgccctgcccagacacctgctggccctgagagcccacctgggcccccagcacgcctacggcagcgccagcggcagagagccctag

SEQ ID NO: 76956 - DNA, 2193 bp, Artificial Sequence
  Description of Artificial Sequence: Synthetic coding sequence
atgttcagcgccctgaagaagctggtgggcagcgaccaggcccccggcagagacaagaacatccccgccggcctgcagagcatgaaccaggccctgcagagaagattcgccaagggcgtgcagtacaacatgaagatcgtgatcagaggcgacagaaacaccggcaagaccgccctgtggcacagactgcagggcagacccttcgtggaggagtacatccccacccaggagatccaggtgaccagcatccactggagctacaagaccaccgacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagcagaccccccggcagcagctacttcagatacgccgagagcagcatgaagaacagcttcggcctgaagtacctgcacaagttcttcaacatccccttcctgcagctgcagagagagaccctgctgagacagctggagaccaaccagctggacatggacgccaccctggaggagctgagcgtgcagcaggagaccgaggaccagaactacggcatcttcctggagatgatggaggccagaagcagaggccacgccagccccctggccgccaacggccagagccccagccccggcagccagagccccgtggtgcccgccggcgccgtgagcaccggcagcagcagccccggcaccccccagcccgccccccagctgcccctgaacgccgccccccccagcagcgtgccccccgtgccccccagcgaggccctgcccccccccgcctgccccagcgcccccgcccccagaagaagcatcatcagcagactgttcggcaccagccccgccaccgaggccgccccccccccccccgagcccgtgcccgccgccgagggccccgccaccgtgcagagcgtggaggacttcgtgcccgacgacagactggacagaagcttcctggaggacaccacccccgccagagacgagaagaaggtgggcgccaaggccgcccagcaggacagcgacagcgacggcgaggccctgggcggcaaccccatggtggccggcttccaggacgacgtggacctggaggaccagcccagaggcagcccccccctgcccgccggccccgtgcccagccaggacatcaccctgagcagcgaggaggaggccgaggtggccgcccccaccaagggccccgcccccgccccccagcagtgcagcgagcccgagaccaagtggagcagcatccccgccagcaagcccagaagaggcaccgcccccaccagaaccgccgcccccccctggcccggcggcgtgagcgtgagaaccggccccgagaagagaagcagcaccagaccccccgccgagatggagcccggcaagggcgagcaggccagcagcagcgagagcgaccccgagggccccatcgccgcccagatgctgagcttcgtgatggacgaccccgacttcgagagcgagggcagcgacacccagagaagagccgacgacttccccgtgagagacgaccccagcgacgtgaccgacgaggacgagggccccgccgagcccccccccccccccaagctgcccctgcccgccttcagactgaagaacgacagcgacctgttcggcctgggcctggaggaggccggccccaaggagagcagcgaggagggcaaggagggcaagacccccagcaaggagaagaagaagaagaagaagaagggcaaggaggaggaggagaaggccgccaagaagaagagcaagcacaagaagagcaaggacaaggaggagggcaaggaggagagaagaagaagacagcagagaccccccagaagcagagagagaaccgccgccgacgagctggaggccttcctgggcggcggcgcccccggcggcagacaccccggcggcggcgactacgaggagctgtag

SEQ ID NO: 76957 - DNA, 945 bp, Artificial Sequence
  Description of Artificial Sequence: Synthetic coding sequence
atgttcagcgccctgaagaagctggtgggcagcgaccaggcccccggcagagacaagaacatccccgccggcctgcagagcatgaaccaggccctgcagagaagattcgccaagggcgtgcagtacaacatgaagatcgtgatcagaggcgacagaaacaccggcaagaccgccctgtggcacagactgcagggcagacccttcgtggaggagtacatccccacccaggagatccaggtgaccagcatccactggagctacaagaccaccgacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagaccccccggcagcagctacttcagatacgccgagagcagcatgaagaacagcttcggcctgaagtacctgcacaagttcttcaacatccccttcctgcagctgcagaaggacgtgagactggcccaggagagaggctgcgccgtggtgctggtgagcgaggaggtgagaatgcccgccggctgggactgctgctggggcagactgggctggaaggagggcggcagccagacctgccccgtgcccgccctgctgggcagacccctgctgcccgccgagcccagcccccaccactgggtggactacagcctggagagcagccccctgctgagctgcagcatcccctag

SEQ ID NO: 76958 - DNA, 1566 bp, Artificial Sequence
  Description of Artificial Sequence: Synthetic coding sequence
atgttcagcgccctgaagaagctggtgggcagcgaccaggcccccggcagagacaagaacatccccgccggcctgcagagcatgaaccaggccctgcagagaagattcgccaagggcgtgcagtacaacatgaagatcgtgatcagaggcgacagaaacaccggcaagaccgccctgtggcacagactgcagggcagacccttcgtggaggagtacatccccacccaggagatccaggtgaccagcatccactggagctacaagaccaccgacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagcagaccccccggcagcagctacttcagatacgccgagagcagcatgaagaacagcttcggcctgaagtacctgcacaagttcttcaacatccccttcctgcagctgcagagagagaccctgctgagacagctggagaccaaccagctggacatggacgccaccctggaggagctgagcgtgcagcaggagaccgaggaccagaactacggcatcttcctggagatgatggaggccagaagcagaggccacgccagccccctggccgccaacggccagagccccagccccggcagccagagccccgtggtgcccgccggcgccgtgagcaccggcagcagcagccccggcaccccccagcccgccccccagctgcccctgaacgccgccccccccagcagcgtgccccccgtgccccccagcgaggccctgcccccccccgcctgccccagcgcccccgcccccagaagaagcatcatcagcagaccccccccctggggctggagactgagaggcgccctgggcagaagaggccagtggcccccctggggcggcggcagagcctgccactgcctgggcagacacctgcccctgtaccacagactgtgcagatgccccgtggccgccgtgtgcgccagcgagctggaggaggccggccactggtggagccccggctgggccctgcaggtgctgggcctgcaggcccagtgcgagcccgccctgcaggagggcagaggccagctggccagcgccagactgggcggccaccccggccccctgggcgccgagccccccgtgttcctgagagacgtgaccgaggcccaggagggccccgtgagagtgtgcctgcagagactgggcagaggcagactggccgtgggctgcgccctgcccagacacctgctggccctgagagcccacctgggcccccagcacgcctacggcagcgccagcggcagagagccctag

SEQ ID NO: 76959 - DNA, 1845 bp, Artificial Sequence
  Description of Artificial Sequence: Synthetic coding sequence
atggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagaccccccggcagcagctacttcagatacgccgagagcagcatgaagaacagcttcggcctgaagtacctgcacaagttcttcaacatccccttcctgcagctgcagagagagaccctgctgagacagctggagaccaaccagctggacatggacgccaccctggaggagctgagcgtgcagcaggagaccgaggaccagaactacggcatcttcctggagatgatggaggccagaagcagaggccacgccagccccctggccgccaacggccagagccccagccccggcagccagagccccgtggtgcccgccggcgccgtgagcaccggcagcagcagccccggcaccccccagcccgccccccagctgcccctgaacgccgccccccccagcagcgtgccccccgtgccccccagcgaggccctgcccccccccgcctgccccagcgcccccgcccccagaagaagcatcatcagcagactgttcggcaccagccccgccaccgaggccgccccccccccccccgagcccgtgcccgccgccgagggccccgccaccgtgcagagcgtggaggacttcgtgcccgacgacagactggacagaagcttcctggaggacaccacccccgccagagacgagaagaaggtgggcgccaaggccgcccagcaggacagcgacagcgacggcgaggccctgggcggcaaccccatggtggccggcttccaggacgacgtggacctggaggaccagcccagaggcagcccccccctgcccgccggccccgtgcccagccaggacatcaccctgagcagcgaggaggaggccgaggtggccgcccccaccaagggccccgcccccgccccccagcagtgcagcgagcccgagaccaagtggagcagcatccccgccagcaagcccagaagaggcaccgcccccaccagaaccgccgcccccccctggcccggcggcgtgagcgtgagaaccggccccgagaagagaagcagcaccagaccccccgccgagatggagcccggcaagggcgagcaggccagcagcagcgagagcgaccccgagggccccatcgccgcccagatgctgagcttcgtgatggacgaccccgacttcgagagcgagggcagcgacacccagagaagagccgacgacttccccgtgagagacgaccccagcgacgtgaccgacgaggacgagggccccgccgagcccccccccccccccaagctgcccctgcccgccttcagactgaagaacgacagcgacctgttcggcctgggcctggaggaggccggccccaaggagagcagcgaggagggcaaggagggcaagacccccagcaaggagaagaagaagaagaagaagaagggcaaggaggaggaggagaaggccgccaagaagaagagcaagcacaagaagagcaaggacaaggaggagggcaaggaggagagaagaagaagacagcagagaccccccagaagcagagagagaaccgccgccgacgagctggaggccttcctgggcggcggcgcccccggcggcagacaccccggcggcggcgactacgaggagctgtag

SEQ ID NO: 76960 - DNA, 678 bp, Artificial Sequence
  Description of Artificial Sequence: Synthetic coding sequence
tgagacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagaccccccggcagcagctacttcagatacgccgagagcagcatgaagaacagcttcggcctgaagtacctgcacaagttcttcaacatccccttcctgcagctgcagaaggacgtgagactggcccaggagagaggctgcgccgtggtgctggtgagcgaggaggtgagaatgcccgccggctgggactgctgctggggcagactgggctggaaggagggcggcagccagacctgccccgtgcccgccctgctgggcagacccctgctgcccgccgagcccagcccccaccactgggtggactacagcctggagagcagccccctgctgagctgcagcatcccctag

SEQ ID NO: 76961 - DNA, 1416 bp, Artificial Sequence
  Description of Artificial Sequence: Synthetic coding sequence
atgaccgtgggcaccgtgaagatcgtgatcagaggcgacagaaacaccggcaagaccgccctgtggcacagactgcagggcagacccttcgtggaggagtacatccccacccaggagatccaggtgaccagcatccactggagctacaagaccaccgacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagaccccccggcagcagctacttcagatacgccgagagcagcatgaagaacagcttcggcctgaagtacctgcacaagttcttcaacatccccttcctgcagctgcagagagagaccctgctgagacagctggagaccaaccagctggacatggacgccaccctggaggagctgagcgtgcagcaggagaccgaggaccagaactacggcatcttcctggagatgatggaggccagaagcagaggccacgccagccccctggccgccaacggccagagccccagccccggcagccagagccccgtggtgcccgccggcgccgtgagcaccggcagcagcagccccggcaccccccagcccgccccccagctgcccctgaacgccgccccccccagcagcgtgccccccgtgccccccagcgaggccctgcccccccccgcctgccccagcgcccccgcccccagaagaagcatcatcagcagactgttcggcaccagccccgccaccgaggccgccccccccccccccgagcccgtgcccgccgccgagggccccgccaccgtgcagagcgtggaggacttcgtgcccgacgacagactggacagaagcttcctggaggacaccacccccgccagagacgagaagaaggtgggcgccaaggccgcccagcaggacagcgacagcgacggcgaggccctgggcggcaaccccatggtggccggcttccaggacgacgtggacctggaggaccagcccagaggcagcccccccctgcccgccggccccgtgcccagccaggacatcaccctgagcagcgaggaggaggccgaggtggccgcccccaccaagggccccgcccccgccccccagcagtgcagcgagcccgagaccaagtggagcggcgaggcccagcagcaccaggccccctgctag

SEQ ID NO: 76962 - DNA, 1347 bp, Artificial Sequence
  Description of Artificial Sequence: Synthetic coding sequence
atgagccacagagcctggctggccctgctgcccctggaggtggacggcgacgacggcctgtgcggcgccggcggccccgagcacagcggcagcagccagccccagcagcagcagcagagagccccctgccacctgagagccagcggcagaggcagaggcgccagactgctgaccagactgctgcccttcagcttcctggagatgatggaggccagaagcagaggccacgccagccccctggccgccaacggccagagccccagccccggcagccagagccccgtggtgcccgccggcgccgtgagcaccggcagcagcagccccggcaccccccagcccgccccccagctgcccctgaacgccgccccccccagcagcgtgccccccgtgccccccagcgaggccctgcccccccccgcctgccccagcgcccccgcccccagaagaagcatcatcagcagactgttcggcaccagccccgccaccgaggccgccccccccccccccgagcccgtgcccgccgccgagggccccgccaccgtgcagagcgtggaggacttcgtgcccgacgacagactggacagaagcttcctggaggacaccacccccgccagagacgagaagaaggtgggcgccaaggccgcccagcaggacagcgacagcgacggcgaggccctgggcggcaaccccatggtggccggcttccaggacgacgtggacctggaggaccagcccagaggcagcccccccctgcccgccggccccgtgcccagccaggacatcaccctgagcagcgaggaggaggccgaggtggccgcccccaccaagggccccgcccccgccccccagcagtgcagcgagcccgagaccaagtggagcagcatccccgccagcaagcccagaagaggcaccgcccccaccagaaccgccgcccccccctggcccggcggcgtgagcgtgagaaccggccccgagaagagaagcagcaccagaccccccgccgagatggagcccggcaagggcgagcaggccagcagcagcgagagcgaccccgagggccccatcgccgcccagatgctgagcttcgtgatggacgaccccgacttcgagagcgagggcagcgacacccagagaagagccgacgacttccccgtgagagacgaccccagcgacgtgaccgacgaggacgagggccccgccgagcccccccccccccccaagctgcccctgcccgccttcagactgaagaacgacagcgacctgttcggcctgggcctggaggaggccggccccaaggagagcagcgaggagggcaaggagggcaagacccccagcaaggagaagtag

SEQ ID NO: 76963 - DNA, 648 bp, Artificial Sequence
  Description of Artificial Sequence: Synthetic coding sequence
tgaaagatcgtgatcagaggcgacagaaacaccggcaagaccgccctgtggcacagactgcagggcagacccttcgtggaggagtacatccccacccaggagatccaggtgaccagcatccactggagctacaagaccaccgacgacatcgtgaaggtggaggtgtgggacgtggtggacaagggcaagtgcaagaagagaggcgacggcctgaagatggagaacgacccccaggaggccgagagcgagatggccctggacgccgagttcctggacgtgtacaagaactgcaacggcgtggtgatgatgttcgacatcaccaagcagtggaccttcaactacatcctgagagagctgcccaaggtgcccacccacgtgcccgtgtgcgtgctgggcaactacagagacatgggcgagcacagagtgatcctgcccgacgacgtgagagacttcatcgacaacctggacagcagaccccccggcagcagctacttcagatacgccgagagcagcatgaagaacagcttcggcctgaagtacctgcacaagttcttcaacatccccttcctgcagctgcaggtgagcacccaccacgtgggctggagcggctgctggagcctgaccagcttccaggtgagccccgtgtag

SEQ ID NO: 76964 - DNA, 336 bp, Artificial Sequence
  Description of Artificial Sequence: Synthetic coding sequence
atgtacagcagactgttctacctgaagagcagctacatcatctacttcgagcccctgttcagcaacgccatcatcaacatcctgagcttcatcaacagcctggccagccccctgaccatcttctgcttcgccctgagcgcccaggccctgagcaccatcttctacttcagaatcttcatcttcatcttccacagctggatcctgctgttccacttctacttcacctgcagcttcaagacctacgagcaccagcacagcaagatggtgcccgcctacagaatgcagagccccagagccctgcccagaacctacctgtacgtgtggccctacaagtag

SEQ ID NO: 76965 - DNA, 342 bp, Artificial Sequence
  Description of Artificial Sequence: Synthetic coding sequence
atgaacttctacctgctgctggccagcagcatcctgtgcgccctgatcgtgttctggaagtacagaagattccagagaaacaccggcgagatgagcagcaacagcaccgccctggccctggtgagacccagcagcagcggcctgatcaacagcaacaccgacaacaacctggccgtgtacgacctgagcagagacatcctgaacaacttcccccacagcatcgccagacagaagagaatcctggtgaacctgagcatggtggagaacaagctggtggagctggagcacaccctgctgagcaagggcttcagaggcgccagcccccacagaaagagcacctag

SEQ ID NO: 76966 - DNA, 2853 bp, Artificial Sequence
  Description of Artificial Sequence: Synthetic coding sequence
atgacctggagaatgggccccagattcaccatgctgctggccatgtggctggtgtgcggcagcgagccccacccccacgccaccatcagaggcagccacggcggcagaaaggtgcccctggtgagccccgacagcagcagacccgccagattcctgagacacaccggcagaagcagaggcatcgagagaagcaccctggaggagcccaacctgcagcccctgcagagaagaagaagcgtgcccgtgctgagactggccagacccaccgagccccccgccagaagcgacatcaacggcgccgccgtgagacccgagcagagacccgccgccagaggcagccccagagagatgatcagagacgagggcagcagcgccagaagcagaatgctgagattccccagcggcagcagcagccccaacatcctggccagcttcgccggcaagaacagagtgtgggtgatcagcgccccccacgccagcgagggctactacagactgatgatgagcctgctgaaggacgacgtgtactgcgagctggccgagagacacatccagcagatcgtgctgttccaccaggccggcgaggagggcggcaaggtgagaagaatcaccagcgagggccagatcctggagcagcccctggaccccagcctgatccccaagctgatgagcttcctgaagctggagaagggcaagttcggcatggtgctgctgaagaagaccctgcaggtggaggagagatacccctaccccgtgagactggaggccatgtacgaggtgatcgaccagggccccatcagaagaatcgagaagatcagacagaagggcttcgtgcagaagtgcaaggccagcggcgtggagggccaggtggtggccgagggcaacgacggcggcggcggcgccggcagacccagcctgggcagcgagaagaagaaggaggaccccagaagagcccaggtgccccccaccagagagagcagagtgaaggtgctgagaaagctggccgccaccgcccccgccctgccccagccccccagcacccccagagccaccaccctgccccccgcccccgccaccaccgtgaccagaagcaccagcagagccgtgaccgtggccgccagacccatgaccaccaccgccttccccaccacccagagaccctggacccccagccccagccacagaccccccaccaccaccgaggtgatcaccgccagaagacccagcgtgagcgagaacctgtacccccccagcagaaaggaccagcacagagagagaccccagaccaccagaagacccagcaaggccaccagcctggagagcttcaccaacgccccccccaccaccatcagcgagcccagcaccagagccgccggccccggcagattcagagacaacagaatggacagaagagagcacggccacagagaccccaacgtggtgcccggcccccccaagcccgccaaggagaagccccccaagaagaaggcccaggacaagatcctgagcaacgagtacgaggagaagtacgacctgagcagacccaccgccagccagctggaggacgagctgcaggtgggcaacgtgcccctgaagaaggccaaggagagcaagaagcacgagaagctggagaagcccgagaaggagaagaagaagaagatgaagaacgagaacgccgacaagctgctgaagagcgagaagcagatgaagaagagcgagaagaagagcaagcaggagaaggagaagagcaagaagaagaagggcggcaagaccgagcaggacggctaccagaagcccaccaacaagcacttcacccagagccccaagaagagcgtggccgacctgctgggcagcttcgagggcaagagaagactgctgctgatcaccgcccccaaggccgagaacaacatgtacgtgcagcagagagacgagtacctggagagcttctgcaagatggccaccagaaagatcagcgtgatcaccatcttcggccccgtgaacaacagcaccatgaagatcgaccacttccagctggacaacgagaagcccatgagagtggtggacgacgaggacctggtggaccagagactgatcagcgagctgagaaaggagtacggcatgacctacaacgacttcttcatggtgctgaccgacgtggacctgagagtgaagcagtactacgaggtgcccatcaccatgaagagcgtgttcgacctgatcgacaccttccagagcagaatcaaggacatggagaagcagaagaaggagggcatcgtgtgcaaggaggacaagaagcagagcctggagaacttcctgagcagattcagatggagaagaagactgctggtgatcagcgcccccaacgacgaggactgggcctacagccagcagctgagcgccctgagcggccaggcctgcaacttcggcctgagacacatcaccatcctgaagctgctgggcgtgggcgaggaggtgggcggcgtgctggagctgttccccatcaacggcagcagcgtggtggagagagaggacgtgcccgcccacctggtgaaggacatcagaaactacttccaggtgagccccgagtacttcagcatgctgctggtgggcaaggacggcaacgtgaagagctggtaccccagccccatgtggagcatggtgatcgtgtacgacctgatcgacagcatgcagctgagaagacaggagatggccatccagcagagcctgggcatgagatgccccgaggacgagtacgccggctacggctaccacagctaccaccagggctaccaggacggctaccaggacgactacagacaccacgagagctaccaccacggctacccctactag

SEQ ID NO: 76967 - DNA, 744 bp, Artificial Sequence
  Description of Artificial Sequence: Synthetic coding sequence
atgctgctgctgcccctgcccctgctgctgttcctgctgtgcagcagagccgaggccggcgagatcatcggcggcaccgagtgcaagccccacagcagaccctacatggcctacctggagatcgtgaccagcaacggccccagcaagttctgcggcggcttcctgatcagaagaaacttcgtgctgaccgccgcccactgcgccggcagaagcatcaccgtgaccctgggcgcccacaacatcaccgaggaggaggacacctggcagaagctggaggtgatcaagcagttcagacaccccaagtacaacaccagcaccctgcaccacgacatcatgctgctgaagctgaaggagaaggccagcctgaccctggccgtgggcaccctgcccttccccagccagttcaacttcgtgccccccggcagaatgtgcagagtggccggctggggcagaaccggcgtgctgaagcccggcagcgacaccctgcaggaggtgaagctgagactgatggacccccaggcctgcagccacttcagagacttcgaccacaacctgcagctgtgcgtgggcaaccccagaaagaccaagagcgccttcaagggcgacagcggcggccccctgctgtgcgccggcgtggcccagggcatcgtgagctacggcagaagcgacgccaagccccccgccgtgttcaccagaatcagccactacagaccctggatcaaccagatcctgcaggccaactag

SEQ ID NO: 76968 - DNA, 210 bp, Artificial Sequence
  Description of Artificial Sequence: Synthetic coding sequence
atgctgggcatcaccgtgctggccgccctgctggcctgcgccacccccggccccaccgtgtggccctgggagagaaccacctggagatggaagaccaagaaggacccctgcctgtgggtgtggacccccagcaccagcaccagagacggcatgcccagctgctgcgccatgatcctgcccagcagcagcctgcagagcatgtggagctag

SEQ ID NO: 76969 - DNA, 807 bp, Artificial Sequence
  Description of Artificial Sequence: Synthetic coding sequence
atgctgggcatcaccgtgctggccgccctgctggcctgcgccagcagctgcggcgtgcccagcttcccccccaacctgagcgccagagtggtgggcggcgaggacgccagaccccacagctggccctggcagatcagcctgcagtacctgaagaacgacacctggagacacacctgcggcggcaccctgatcgccagcaacttcgtgctgaccgccgcccactgcatcagcaacaccagaacctacagagtggccgtgggcaagaacaacctggaggtggaggacgaggagggcagcctgttcgtgggcgtggacaccatccacgtgcacaagagatggaacgccctgctgctgagaaacgacatcgccctgatcaagctggccgagcacgtggagctgagcgacaccatccaggtggcctgcctgcccgagaaggacagcctgctgcccaaggactacccctgctacgtgaccggctggggcagactgtggaccaacggccccatcgccgacaagctgcagcagggcctgcagcccgtggtggaccacgccacctgcagcagaatcgactggtggggcttcagagtgaagaagaccatggtgtgcgccggcggcgacggcgtgatcagcgcctgcaacggcgacagcggcggccccctgaactgccagctggagaacggcagctgggaggtgttcggcatcgtgagcttcggcagcagaagaggctgcaacaccagaaagaagcccgtggtgtacaccagagtgagcgcctacatcgactggatcaacgagaagatgcagctgtag

SEQ ID NO: 76970 - DNA, 795 bp, Artificial Sequence
  Description of Artificial Sequence: Synthetic coding sequence
atgctgctgctgagcctgaccctgagcctggtgctgctgggcagcagctggggctgcggcatccccgccatcaagcccgccctgagcttcagccagagaatcgtgaacggcgagaacgccgtgctgggcagctggccctggcaggtgagcctgcaggacagcagcggcttccacttctgcggcggcagcctgatcagccagagctgggtggtgaccgccgcccactgcaacgtgagccccggcagacacttcgtggtgctgggcgagtacgacagaagcagcaacgccgagcccctgcaggtgctgagcgtgagcagagccatcacccaccccagctggaacagcaccaccatgaacaacgacgtgaccctgctgaagctggccagccccgcccagtacaccaccagaatcagccccgtgtgcctggccagcagcaacgaggccctgaccgagggcctgacctgcgtgaccaccggctggggcagactgagcggcgtgggcaacgtgacccccgcccacctgcagcaggtggccctgcccctggtgaccgtgaaccagtgcagacagtactggggcagcagcatcaccgacagcatgatctgcgccggcggcgccggcgccagcagctgccagggcgacagcggcggccccctggtgtgccagaagggcaacacctgggtgctgatcggcatcgtgagctggggcaccaagaactgcaacgtgagagcccccgccgtgtacaccagagtgagcaagttcagcacctggatcaaccaggtgatcgcctacaactag

SEQ ID NO: 76971 - DNA, 795 bp, Artificial Sequence; identical to SEQ ID NO: 76970
  Description of Artificial Sequence: Synthetic coding sequence

SEQ ID NO: 76972 - DNA, 792 bp, Artificial Sequence
  Description of Artificial Sequence: Synthetic coding sequence
atggccagcctgtggctgctgagctgcttcagcctggtgggcgccgccttcggctgcggcgtgcccgccatccaccccgtgctgagcggcctgagcagaatcgtgaacggcgaggacgccgtgcccggcagctggccctggcaggtgagcctgcaggacaagaccggcttccacttctgcggcggcagcctgatcagcgaggactgggtggtgaccgccgcccactgcggcgtgagaaccagcgacgtggtggtggccggcgagttcgaccagggcagcgacgaggagaacatccaggtgctgaagatcgccaaggtgttcaagaaccccaagttcagcatcctgaccgtgaacaacgacatcaccctgctgaagctggccacccccgccagattcagccagaccgtgagcgccgtgtgcctgcccagcgccgacgacgacttccccgccggcaccctgtgcgccaccaccggctggggcaagaccaagtacaacgccaacaagacccccgacaagctgcagcaggccgccctgcccctgctgagcaacgccgagtgcaagaagagctggggcagaagaatcaccgacgtgatgatctgcgccggcgccagcggcgtgagcagctgcatgggcgacagcggcggccccctggtgtgccagaaggacggcgcctggaccctggtgggcatcgtgagctggggcagcgacacctgcagcaccagcagccccggcgtgtacgccagagtgaccaagctgatcccctgggtgcagaagatcctggccgccaactag

SEQ ID NO: 76973 - DNA, 1119 bp, Artificial Sequence
  Description of Artificial Sequence: Synthetic coding sequence
atggccgcccccgtgccctgggcctgctgcgccgtgctggccgccgccgccgccgtggtgtacgcccagagacacagcccccaggaggccccccacgtgcagtacgagagactgggcagcgacgtgaccctgccctgcggcaccgccaactgggacgccgccgtgacctggagagtgaacggcaccgacctggcccccgacctgctgaacggcagccagctggtgctgcacggcctggagctgggccacagcggcctgtacgcctgcttccacagagacagctggcacctgagacaccaggtgctgctgcacgtgggcctgccccccagagagcccgtgctgagctgcagaagcaacacctaccccaagggcttctactgcagctggcacctgcccacccccacctacatccccaacaccttcaacgtgaccgtgctgcacggcagcaagatcatggtgtgcgagaaggaccccgccctgaagaacagatgccacatcagatacatgcacctgttcagcaccatcaagtacaaggtgagcatcagcgtgagcaacgccctgggccacaacgccaccgccatcaccttcgacgagttcaccatcgtgaagcccgacccccccgagaacgtggtggccagacccgtgcccagcaaccccagaagactggaggtgacctggcagacccccagcacctggcccgaccccgagagcttccccctgaagttcttcctgagatacagacccctgatcctggaccagtggcagcacgtggagctgagcgacggcaccgcccacaccatcaccgacgcctacgccggcaaggagtacatcatccaggtggccgccaaggacaacgagatcggcacctggagcgactggagcgtggccgcccacgccaccccctggaccgaggagcccagacacctgaccaccgaggcccaggccgccgagaccaccaccagcaccaccagcagcctggcccccccccccaccaccaagatctgcgaccccggcgagctgggcagcggcggcggccccagcgcccccttcctggtgagcgtgcccatcaccctggccctggccgccgccgccgccaccgccagcagcctgctgatctag

SEQ ID NO: 76974 - DNA, 1119 bp, Artificial Sequence; identical to SEQ ID NO: 76973
  Description of Artificial Sequence: Synthetic coding sequence

SEQ ID NO: 76975 - DNA, 771 bp, Artificial Sequence
  Description of Artificial Sequence: Synthetic coding sequence
atggccgcccccgtgccctgggcctgctgcgccgtgctggccgccgccgccgccgtggtgtacgcccagagacacagcccccaggaggccccccacgtgcagtacgagagactgggcagcgacgtgaccctgccctgcggcaccgccaactgggacgccgccgtgacctggagagtgaacggcaccgacctggcccccgacctgctgaacggcagccagctggtgctgcacggcctggagctgggccacagcggcctgtacgcctgcttccacagagacagctggcacctgagacaccaggtgctgctgcacgtgggcctgccccccagagagcccgtgctgagctgcagaagcaacacctaccccaagggcttctactgcagctggcacctgcccacccccacctacatccccaacaccttcaacgtgaccgtgctgcacggcagcaagatcatggtgtgcgagaaggaccccgccctgaagaacagatgccacatcagatacatgcacctgttcagcaccatcaagtacaaggtgagcatcagcgtgagcaacgccctgggccacaacgccaccgccatcaccttcgacgagttcaccatcgtgaagcccgacccccccgagaacgtggtggccagacccgtgcccagcaaccccagaagactggaggtgacctggcagacccccagcacctggcccgaccccgagagcttccccctgaagttcttcctgagatacagacccctgatcctggaccagtggcagcactag

SEQ ID NO: 76976 - DNA, 3909 bp, Artificial Sequence
  Description of Artificial Sequence: Synthetic coding sequence
atggagctgtacttcggcgagtaccagcacgtgcagcaggagtacggcgtgcacctgagactggccagcgacgacacccagaagagcagaagcagccagaacagcaaggccggcagctacggcgtgagcatcagagtgcagggcatcgacggccacccctacatcgtgctgaacaacaccgagagatgcctggccggcaccagcttcagcgagaacggcccccccttccccccccccgtgatcaacaacctgcccctgcacagcagcaacggcagcgtgcccaaggagaacagcgaggagctgcagctgcccgagaacccctacgcccagcccagccccatcagaaacctgaagcagcccctgctgcacgagggcaagaacggcgtgctggacagaaaggacggcagcgtgaagcccagccacctgctgaacttccagagacaccccgagctgctgcagccctacgaccccgagaagaacgagctgaacctgcagaaccaccagcccagcgagagcaactggctgaagaccctgaccgaggagggcatcaacaacaagaagccctggacctgcttccccaagcccagcaacagccagcccaccagccccagcctggaggaccccgccaagagcggcgtgaccgccatcagactgtgcagcagcgtggtgatcgaggaccccaagaagcagaccagcgtgtgcgtgaacgtgcagagctgcaccaaggagagagtgggcgaggaggccctgttcaccagcggcagacccctgaccgcccacagcccccacgcccaccccgagaccaagaagaccagacccgacgtgctgcccttcagaagacaggacagcgccggccccgtgctggacggcgccagaagcagaagaagcagcagcagcagcaccacccccaccagcgccaacagcctgtacagattcctgctggacgaccaggagtgcgccatccacgccgacaacgtgaacagacacgagaacagaagatacatccccttcctgcccggcaccggcagagacatcgacaccggcagcatccccggcgtggaccagctgatcgagaagttcgaccagaagcccggcctgcagagaagaggcagaagcggcaagagaaacagaatcaacaccgacgacagaaagagaagcagaagcgtggacagcgccttccccttcggcctgcagggcaacagcgagtacctgatcgagttcagcagaaacctgggcaagagcagcgagcacctgctgagacccagccaggtgtgcccccagagacccctgagccaggagagaagaggcaagcagagcgtgggcagaaccttcgccaagctgcagggcgccgcccacggcgccagctgcgcccacagcagacccccccagcccaacatcgacggcaaggtgctggagaccgagggcagccaggagagcaccgtgatcagagcccccagcctgggcgcccagagcaagaaggaggaggaggtgaagaccgccaccgccaccctgatgctgcagaacagagccaccgccaccagccccgacagcggcgccaagaagatcagcgtgaagaccttccccagcgccagcaacacccaggccacccccgacctgctgaagggccagcaggagctgacccagcagaccaacgaggagaccgccaagcagatcctgtacaactacctgaaggagggcagcaccgacaacgacgacgccaccaagagaaaggtgaacctggtgttcgagaagatccagaccctgaagagcagagccgccggcagcgcccagggcaacaaccaggcctgcaacagcaccagcgaggtgaaggacctgctggagcagaagagcaagctgaccatcgaggtggccgagctgcagagacagctgcagctggaggtgaagaaccagcagaacatcaaggaggagagagagagaatgagagccaacctggaggagctgagaagccagcacaacgagaaggtggaggagaacagcaccctgcagcagagactggaggagagcgagggcgagctgagaaagaacctggaggagctgttccaggtgaagatggagagagagcagcaccagaccgagatcagagacctgcaggaccagctgagcgagatgcacgacgagctggacagcgccaagagaagcgaggacagagagaagggcgccctgatcgaggagctgctgcaggccaagcaggacctgcaggacctgctgatcgccaaggaggagcaggaggacctgctgagaaagagagagagagagctgaccgccctgaagggcgccctgaaggaggaggtgagcagccacgaccaggagatggacaagctgaaggagcagtacgacgccgagctgcaggccctgagagagagcgtggaggaggccaccaagaacgtggaggtgctggccagcagaagcaacaccagcgagcaggaccaggccggcaccgagatgagagtgaagctgctgcaggaggagaacgagaagctgcagggcagaagcgaggagctggagagaagagtggcccagctgcagagacagatcgaggacctgaagggcgacgaggccaaggccaaggagaccctgaagaagtacgagggcgagatcagacagctggaggaggccctggtgcacgccagaaaggaggagaaggaggccgtgagcgccagaagagccctggagaacgagctggaggccgcccagggcaacctgagccagaccacccaggagcagaagcagctgagcgagaagctgaaggaggagagcgagcagaaggagcagctgagaagactgaagaacgagatggagaacgagagatggcacctgggcaagaccatcgagaagctgcagaaggagatggccgacatcgtggaggccagcagaaccagcaccctggagctgcagaaccagctggacgagtacaaggagaagaacagaagagagctggccgagatgcagagacagctgaaggagaagaccctggaggccgagaagagcagactgaccgccatgaagatgcaggacgagatgagactgatggaggaggagctgagagactaccagagagcccaggacgaggccctgaccaagagacagctgctggagcagaccctgaaggacctggagtacgagctggaggccaagagccacctgaaggacgacagaagcagactggtgaagcagatggaggacaaggtgagccagctggagatggagctggaggaggagagaaacaacagcgacctgctgagcgagagaatcagcagaagcagagagcagatggagcagctgagaaacgagctgctgcaggagagagccgccagacaggacctggagtgcgacaagatcagcctggagagacagaacaaggacctgaagagcagaatcatccacctggagggcagctacagaagcagcaaggagggcctggtggtgcagatggaggccagaatcgccgagctggaggacagactggagagcgaggagagagacagagccaacctgcagctgagcaacagaagactggagagaaaggtgaaggagctggtgatgcaggtggacgacgagcacctgagcctgaccgaccagaaggaccagctgagcctgagactgaaggccatgaagagacaggtggaggaggccgaggaggagatcgacagactggagagcagcaagaagaagctgcagagagagctggaggagcagatggacatgaacgagcacctgcagggccagctgaacagcatgaagaaggacctgagactgaagaagctgcccagcaaggtgctggacgacatggacgacgacgacgacctgagcaccgacggcggcagcctgtacgaggcccccgtgagctacaccttcagcaaggacagcaccgtggccagccagatctag

SEQ ID NO: 76977 - DNA, 2061 bp, Artificial Sequence
  Description of Artificial Sequence: Synthetic coding sequence
atgggcgagttcaaggtgcacagagtgagattcttcaactacgtgcccagcggcatcagatgcgtggcctacaacaaccagagcaacagactggccgtgagcagaaccgacggcaccgtggagatctacaacctgagcgccaactacttccaggagaagttcttccccggccacgagagcagagccaccgaggccctgtgctgggccgagggccagagactgttcagcgccggcctgaacggcgagatcatggagtacgacctgcaggccctgaacatcaagtacgccatggacgccttcggcggccccatctggagcatggccgccagccccagcggcagccagctgctggtgggctgcgaggacggcagcgtgaagctgttccagatcacccccgacaagatccagttcgagagaaacttcgacagacagaagagcagaatcctgagcctgagctggcaccccagcggcacccacatcgccgccggcagcatcgactacatcagcgtgttcgacgtgaagagcggcagcgccgtgcacaagatgatcgtggacagacagtacatgggcgtgagcaagagaaagtgcatcgtgtggggcgtggccttcctgagcgacggcaccatcatcagcgtggacagcgccggcaaggtgcagttctgggacagcgccaccggcaccctggtgaagagccacctgatcgccaacgccgacgtgcagagcatcgccgtggccgaccaggaggacagcttcgtggtgggcaccgccgagggcaccgtgttccacttccagctggtgcccgtgaccagcaacagcagcgagaagcagtgggtgagaaccaagcccttccagcaccacacccacgacgtgagaaccgtggcccacagccccaccgccctgatcagcggcggcaccgacacccacctggtgttcagacccctgatggagaaggtggaggtgaagaactacgacgccgccctgagaaagatcaccttcccccacagatgcctgatcagctgcagcaagaagagacagctgctgctgttccagttcgcccaccacctggagctgtggagactgggcagcaccgtggccaccggcaagaacggcgacaccctgcccctgagcaagaacgccgaccacctgctgcacctgaagaccaagggccccgagaacatcatctgcagctgcatcagcccctgcggcagctggatcgcctacagcaccgtgagcagattcttcctgtacagactgaactacgagcacgacaacatcagcctgaagagagtgagcaagatgcccgccttcctgagaagcgccctgcagatcctgttcagcgaggacagcaccaagctgttcgtggccagcaaccagggcgccctgcacatcgtgcagctgagcggcggcagcttcaagcacctgcacgccttccagccccagagcggcaccgtggaggccatgtgcctgctggccgtgagccccgacggcaactggctggccgccagcggcaccagcgccggcgtgcacgtgtacaacgtgaagcagctgaagctgcactgcaccgtgcccgcctacaacttccccgtgaccgccatggccatcgcccccaacaccaacaacctggtgatcgcccacagcgaccagcaggtgttcgagtacagcatccccgacaagcagtacaccgactggagcagaaccgtgcagaagcagggcttccaccacctgtggctgcagagagacacccccatcacccacatcagcttccaccccaagagacccatgcacatcctgctgcacgacgcctacatgttctgcatcatcgacaagagcctgcccctgcccaacgacaagaccctgctgtacaaccccttcccccccaccaacgagagcgacgtgatcagaagaagaaccgcccacgccttcaagatcagcaagatctacaagcccctgctgttcatggacctgctggacgagagaaccctggtggccgtggagagacccctggacgacatcatcgcccagctgcccccccccatcaagaagaagaagttcggcacctag

SEQ ID NO: 76978 - DNA, 1716 bp, Artificial Sequence
  Description of Artificial Sequence: Synthetic coding sequence
atgggcgagttcaaggtgcacagagtgagattcttcaactacgtgcccagcggcatcagatgcgtggcctacaacaaccagagcaacagactggccgtgagcagaaccgacggcaccgtggagatctacaacctgagcgccaactacttccaggagaagttcttccccggccacgagagcagagccaccgaggccctgtgctgggccgagggccagagactgttcagcgccggcctgaacggcgagatcatggagtacgacctgcaggccctgaacatcaagtacgccatggacgccttcggcggccccatctggagcatggccgccagccccagcggcagccagctgctggtgggctgcgaggacggcagcgtgaagctgttccagatcacccccgacaagatccagttcgagagaaacttcgacagacagaagagcagaatcctgagcctgagctggcaccccagcggcacccacatcgccgccggcagcatcgactacatcagcgtgttcgacgtgaagagcggcagcgccgtgcacaagatgatcgtggacagacagtacatgggcgtgagcaagagaaagtgcatcgtgtggggcgtggccttcctgagcgacggcaccatcatcagcgtggacagcgccggcaaggtgcagttctgggacagcgccaccggcaccctggtgaagagccacctgatcgccaacgccgacgtgcagagcatcgccgtggccgaccaggaggacagcttcgtggtgggcaccgccgagggcaccgtgttccacttccagctggtgcccgtgaccagcaacagcagcgagaagcagtgggtgagaaccaagcccttccagcaccacacccacgacgtgagaaccgtggcccacagccccaccgccctgatcagcggcggcaccgacacccacctggtgttcagacccctgatggagaaggtggaggtgaagaactacgacgccgccctgagaaagatcaccttcccccacagatgcctgatcagctgcagcaagaagagacagctgctgctgttccagttcgcccaccacctggagctgtggagactgggcagcaccgtggccaccggcaccgtggaggccatgtgcctgctggccgtgagccccgacggcaactggctggccgccagcggcaccagcgccggcgtgcacgtgtacaacgtgaagcagctgaagctgcactgcaccgtgcccgcctacaacttccccgtgaccgccatggccatcgcccccaacaccaacaacctggtgatcgcccacagcgaccagcaggtgttcgagtacagcatccccgacaagcagtacaccgactggagcagaaccgtgcagaagcagggcttccaccacctgtggctgcagagagacacccccatcacccacatcagcttccaccccaagagacccatgcacatcctgctgcacgacgcctacatgttctgcatcatcgacaagagcctgcccctgcccaacgacaagaccctgctgtacaaccccttcccccccaccaacgagagcgacgtgatcagaagaagaaccgcccacgccttcaagatcagcaagatctacaagcccctgctgttcatggacctgctggacgagagaaccctggtggccgtggagagacccctggacgacatcatcgcccagctgcccccccccatcaagaagaagaagttcggcacctag

SEQ ID NO: 76979 - DNA, 1023 bp, Artificial Sequence
  Description of Artificial Sequence: Synthetic coding sequence
atggccctgagactgctgagaagagccgccagaggcgccgccgccgccgccctgctgagactgaaggccagcctggccgccgacatccccagactgggctacagcagcagcagccaccacaagtacatccccagaagagccgtgctgtacgtgcccggcaacgacgagaagaagatcaagaagatccccagcctgaacgtggactgcgccgtgctggactgcgaggacggcgtggccgccaacaagaagaacgaggccagactgagaatcgtgaagaccctggaggacatcgacctgggccccaccgagaagtgcgtgagagtgaacagcgtgagcagcggcctggccgaggaggacctggagaccctgctgcagagcagagtgctgcccagcagcctgatgctgcccaaggtggagagccccgaggagatccagtggttcgccgacaagttcagcttccacctgaagggcagaaagctggagcagcccatgaacctgatccccttcgtggagaccgccatgggcctgctgaacttcaaggccgtgtgcgaggagaccctgaaggtgggcccccaggtgggcctgttcctggacgccgtggtgttcggcggcgaggacttcagagccagcatcggcgccaccagcagcaaggagaccctggacatcctgtacgccagacagaagatcgtggtgatcgccaaggccttcggcctgcaggccatcgacctggtgtacatcgacttcagagacggcgccggcctgctgagacagagcagagagggcgccgccatgggcttcaccggcaagcaggtgatccaccccaaccagatcgccgtggtgcaggagcagttcagccccagccccgagaagatcaagtgggccgaggagctgatcgccgccttcaaggagcaccagcagctgggcaagggcgccttcaccttccagggcagcatgatcgacatgcccctgctgaagcaggcccagaacaccgtgaccctggccaccagcatcaaggagaagtag

SEQ ID NO: 76980 - DNA, 921 bp, Artificial Sequence
  Description of Artificial Sequence: Synthetic coding sequence
atggccctgagactgctgagaagagccgccagaggcgccgccgccgccgccctgctgagactgaaggccagcctggccgccgacatccccagactgggctacagcagcagcagccaccacaagtacatccccagaagagccgtgctgtacgtgcccggcaacgacgagaagaagatcaagaagatccccagcctgaacgtggactgcgccgtgctggactgcgaggacggcgtggccgccaacaagaagaacgaggccagactgagaatcgtgaagaccctggaggacatcgacctgggccccaccgagaagtgcgtgagagtgaacagcgtgagcagcggcctggccgaggaggacctggagaccctgctgcagagcagagtgctgcccagcagcctgatgctgcccaaggtggagagccccgaggagatccagtgggccgtgtgcgaggagaccctgaaggtgggcccccaggtgggcctgttcctggacgccgtggtgttcggcggcgaggacttcagagccagcatcggcgccaccagcagcaaggagaccctggacatcctgtacgccagacagaagatcgtggtgatcgccaaggccttcggcctgcaggccatcgacctggtgtacatcgacttcagagacggcgccggcctgctgagacagagcagagagggcgccgccatgggcttcaccggcaagcaggtgatccaccccaaccagatcgccgtggtgcaggagcagttcagccccagccccgagaagatcaagtgggccgaggagctgatcgccgccttcaaggagcaccagcagctgggcaagggcgccttcaccttccagggcagcatgatcgacatgcccctgctgaagcaggcccagaacaccgtgaccctggccaccagcatcaaggagaagtag

SEQ ID NO: 76981 - DNA, 921 bp, Artificial Sequence; identical to SEQ ID NO: 76980
  Description of Artificial Sequence: Synthetic coding sequence

SEQ ID NO: 76982 - DNA, 1023 bp, Artificial Sequence; identical to SEQ ID NO: 76979
  Description of Artificial Sequence: Synthetic coding sequence

SEQ ID NO: 76983 - DNA, 546 bp, Artificial Sequence
  Description of Artificial Sequence: Synthetic coding sequence
aacgaggccagactgagaatcgtgaagaccctggaggacatcgacctgggccccaccgagaagtgcgtgagagtgaacagcgtgagcagcggcctggccgaggaggacctggagaccctgctgcagagcagagtgctgcccagcagcctgatgctgcccaaggtggagagccccgaggagatccagtggttcgccgacaagttcagcttccacctgaagggcagaaagctggagcagcccatgaacctgatccccttcgtggagaccgccatgggcctgctgaacttcaaggccgtgtgcgaggagaccctgaaggtgggcccccaggtgggcctgttcctggacgccgtggtgttcggcggcgaggacttcagagccagcatcggcgtgaaggacatcagcctgagcctgttcctgtgcgtgtgcgtgtacatgtgcgtgtacatcttcagcctgcccctgaaggacggccacctgcacaacaacgtgtacctgcccaccatgaccatggtgttccacgacaacggcatggacaccaccagctag

SEQ ID NO: 76984 - DNA, 312 bp, Artificial Sequence
  Description of Artificial Sequence: Synthetic coding sequence
ctgcaggccatcgacctggtgtacatcgacttcagagacggcgccggcctgctgagacagagcagagagggcgccgccatgggcttcaccggcaagcaggtgatccaccccaaccagatcgccgtggtgcaggagcagttcagccccagccccgagaagatcaagtgggccgaggagctgatcgccgccttcaaggagcaccagcagctgggcaagggcgccttcaccttccagggcagcatgatcgacatgcccctgctgaagcaggcccagaacaccgtgaccctggccaccagcatcaaggagaagtag

SEQ ID NO: 76985 - DNA, 270 bp, Artificial Sequence
  Description of Artificial Sequence: Synthetic coding sequence
gaggagctgatcgccgccttcaaggagcaccagcagctgggcaaggtgggcagatactgctgcagctggctgtgcatccagcccttccccagcagccccggccagagaagccagagcatcagcagagtgcccggcagatactgggtgctgggcgccagaagctgggagagcaagggcgccttcaccttccagggcagcatgatcgacatgcccctgctgaagcaggcccagaacaccgtgaccctggccaccagcatcaaggagaagtag

SEQ ID NO: 76986 - DNA, 444 bp, Artificial Sequence
  Description of Artificial Sequence: Synthetic coding sequence
aacgaggccagactgagaatcgtgaagaccctggaggacatcgacctgggccccaccgagaagtgcgtgagagtgaacagcgtgagcagcggcctggccgaggaggacctggagaccctgctgcagagcagagtgctgcccagcagcctgatgctgcccaaggtggagagccccgaggagatccagtgggccgtgtgcgaggagaccctgaaggtgggcccccaggtgggcctgttcctggacgccgtggtgttcggcggcgaggacttcagagccagcatcggcgtgaaggacatcagcctgagcctgttcctgtgcgtgtgcgtgtacatgtgcgtgtacatcttcagcctgcccctgaaggacggccacctgcacaacaacgtgtacctgcccaccatgaccatggtgttccacgacaacggcatggacaccaccagctag

SEQ ID NO: 76987 - DNA, 909 bp, Artificial Sequence
  Description of Artificial Sequence: Synthetic coding sequence
atggccctgagactgctgagaagagccgccagaggcgccgccgccgccgccctgctgagactgaaggccagcctggccgccgacatccccagactgggctacagcagcagcagccaccacaagtacatccccagaagagccgtgctgtacgtgcccggcaacgacgagaagaagatcaagaagatccccagcctgaacgtggactgcgccgtgctggactgcgaggacggcgtggccgccaacaagaagaacgaggccagactgagaatcgtgaagaccctggaggacatcgacctgggccccaccgagaagtgcgtgagagtgaacagcgtgagcagcggcctggccgaggaggacctggagaccctgctgcagagcagagtgctgcccagcagcctgatgctgcccaaggtggagagccccgaggagatccagtgggccgtgtgcgaggagaccctgaaggtgggcccccaggtgggcctgttcctggacgccgtggtgttcggcggcgaggacttcagagccagcatcggcgccaccagcagcaaggagaccctggacatcctgtacgccagacagaagatcgtggtgatcgccaaggccttcggcctgcaggccatcgacctggtgtacatcgacttcagagacggcgccggcctgctgagacagagcagagagggcgccgccatgggcttcaccggcaagcaggtgatccaccccaaccagatcgccgtggtgcaggagcagttcagccccagccccgagaagatcaagtgggccgaggagctgatcgccgccttcaaggagcaccagcagctgggcaagaccgtgagctgcagcgccagccaggccggcgtgcagtggagagacctgggcagcctgcagccccccccccccggcttcaagtag

SEQ ID NO: 76988 - DNA, 1401 bp, Artificial Sequence
  Description of Artificial Sequence: Synthetic coding sequence
atggccctgctgaccgccgccgccagactgctgggcaccaagaacgccagctgcctggtgctggccgccagacacgccagcgccagcagcaccaacctgaaggacatcctggccgacctgatccccaaggagcaggccagaatcaagaccttcagacagcagcacggcaagaccgtggtgggccagatcaccgtggacatgatgtacggcggcatgagaggcatgaagggcctggtgtacgagaccagcgtgctggaccccgacgagggcatcagattcagaggcttcagcatccccgagtgccagaagctgctgcccaaggccaagggcggcgaggagcccctgcccgagggcctgttctggctgctggtgaccggccacatccccaccgaggagcaggtgagctggctgagcaaggagtgggccaagagagccgccctgcccagccacgtggtgaccatgctggacaacttccccaccaacctgcaccccatgagccagctgagcgccgccgtgaccgccctgaacagcgagagcaacttcgccagagcctacgcccagggcatcagcagaaccaagtactgggagctgatctacgaggacagcatggacctgatcgccaagctgccctgcgtggccgccaagatctacagaaacctgtacagagagggcagcggcatcggcgccatcgacagcaacctggactggagccacaacttcaccaacatgctgggctacaccgaccaccagttcaccgagctgaccagactgtacctgaccatccacagcgaccacgagggcggcaacgtgagcgcccacaccagccacctggtgggcagcgccctgagcgacccctacctgagcttcgccgccgccatgaacggcctggccggccccctgcacggcctggccaaccaggaggtgctggtgtggctgacccagctgcagaaggaggtgggcaaggacgtgagcgacgagaagctgagagactacatctggaacaccctgaacagcggcagagtggtgcccggctacggccacgccgtgctgagaaagaccgaccccagatacacctgccagagagagttcgccctgaagcacctgcccaacgaccccatgttcaagctggtggcccagctgtacaagatcgtgcccaacgtgctgctggagcagggcaaggccaagaacccctggcccaacgtggacgcccacagcggcgtgctgctgcagtactacggcatgaccgagatgaactactacaccgtgctgttcggcgtgagcagagccctgggcgtgctggcccagctgatctggagcagagccctgggcttccccctggagagacccaagagcatgagcaccgagggcctgatgaagttcgtggacagcaagagcggctag

SEQ ID NO: 76989 - DNA, 537 bp, Artificial Sequence
  Description of Artificial Sequence: Synthetic coding sequence
atggccctgctgaccgccgccgccagactgctgggcaccaagaacgccagctgcctggtgctggccgccagacacgccagcgccagcagcaccaacctgaaggacatcctggccgacctgatccccaaggagcaggccagaatcaagaccttcagacagcagcacggcaagaccgtggtgggccagatcaccgtggacatgatgtacggcggcatgagaggcatgaagggcctggtgtacgagaccagcgtgctggaccccgacgagggcatcagattcagaggcttcagcatccccgagtgccagaagctgctgcccaaggccaagggcggcgaggagcccctgcccgagggcctgttctggctgctggtgaccggccacatccccaccgaggagcaggtgagctggctgagcaaggagtgggccaagagagccgccctgcccagccacgtggtgaccatgctggacaacttccccaccaacctgcaccccatgagccagctgagcgccgccgtgaccgccctgaacagcgagtag

SEQ ID NO: 76990 - DNA, 6084 bp, Artificial Sequence
  Description of Artificial Sequence: Synthetic coding sequence
atgctgaagttcaagtacggcgccagaaaccccctggacgccggcgccgccgagcccatcgccagcagagccagcagactgaacctgttcttccagggcaagccccccttcatgacccagcagcagatgagccccctgagcagagagggcatcctggacgccctgttcgtgctgttcgaggagtgcagccagcccgccctgatgaagatcaagcacgtgagcaacttcgtgagaaagtacagcgacaccatcgccgagctgcaggagctgcagcccagcgccaaggacttcgaggtgagaagcctggtgggctgcggccacttcgccgaggtgcaggtggtgagagagaaggccaccggcgacatctacgccatgaaggtgatgaagaagaaggccctgctggcccaggagcaggtgagcttcttcgaggaggagagaaacatcctgagcagaagcaccagcccctggatcccccagctgcagtacgccttccaggacaagaaccacctgtacctggtgatggagtaccagcccggcggcgacctgctgagcctgctgaacagatacgaggaccagctggacgagaacctgatccagttctacctggccgagctgatcctggccgtgcacagcgtgcacctgatgggctacgtgcacagagacatcaagcccgagaacatcctggtggacagaaccggccacatcaagctggtggacttcggcagcgccgccaagatgaacagcaacaagatggtgaacgccaagctgcccatcggcacccccgactacatggcccccgaggtgctgaccgtgatgaacggcgacggcaagggcacctacggcctggactgcgactggtggagcgtgggcgtgatcgcctacgagatgatctacggcagaagccccttcgccgagggcaccagcgccagaaccttcaacaacatcatgaacttccagagattcctgaagttccccgacgaccccaaggtgagcagcgacttcctggacctgatccagagcctgctgtgcggccagaaggagagactgaagttcgagggcctgtgctgccaccccttcttcagcaagatcgactggaacaacatcagaaacagccccccccccttcgtgcccaccctgaagagcgacgacgacaccagcaacttcgacgagcccgagaagaacagctgggtgagcagcagcccctgccagctgagccccagcggcttcagcggcgaggagctgcccttcgtgggcttcagctacagcaaggccctgggcatcctgggcagaagcgagagcgtggtgagcggcctggacagccccgccaagaccagcagcatggagaagaagctgctgatcaagagcaaggagctgcaggacagccaggacaagtgccacaagatggagcaggagatgaccagactgcacagaagagtgagcgaggtggaggccgtgctgagccagaaggaggtggagctgaaggccagcgagacccagagaagcctgctggagcaggacctggccacctacatcaccgagtgcagcagcctgaagagaagcctggagcaggccagaatggaggtgagccaggaggacgacaaggccctgcagctgctgcacgacatcagagagcagagcagaaagctgcaggagatcaaggagcaggagtaccaggcccaggtggaggagatgagactgatgatgaaccagctggaggaggacctggtgagcgccagaagaagaagcgacctgtacgagagcgagctgagagagagcagactggccgccgaggagttcaagagaaaggccaccgagtgccagcacaagctgctgaaggccaaggaccagggcaagcccgaggtgggcgagtacgccaagctggagaagatcaacgccgagcagcagctgaagatccaggagctgcaggagaagctggagaaggccgtgaaggccagcaccgaggccaccgagctgctgcagaacatcagacaggccaaggagagagccgagagagagctggagaagctgcagaacagagaggacagcagcgagggcatcagaaagaagctggtggaggccgaggagctggaggagaagcacagagaggcccaggtgagcgcccagcacctggaggtgcacctgaagcagaaggagcagcactacgaggagaagatcaaggtgctggacaaccagatcaagaaggacctggccgacaaggagaccctggagaacatgatgcagagacacgaggaggaggcccacgagaagggcaagatcctgagcgagcagaaggccatgatcaacgccatggacagcaagatcagaagcctggagcagagaatcgtggagctgagcgaggccaacaagctggccgccaacagcagcctgttcacccagagaaacatgaaggcccaggaggagatgatcagcgagctgagacagcagaagttctacctggagacccaggccggcaagctggaggcccagaacagaaagctggaggagcagctggagaagatcagccaccaggaccacagcgacaagaacagactgctggagctggagaccagactgagagaggtgagcctggagcacgaggagcagaagctggagctgaagagacagctgaccgagctgcagctgagcctgcaggagagagagagccagctgaccgccctgcaggccgccagagccgccctggagagccagctgagacaggccaagaccgagctggaggagaccaccgccgaggccgaggaggagatccaggccctgaccgcccacagagacgagatccagagaaagttcgacgccctgagaaacagctgcaccgtgatcaccgacctggaggagcagctgaaccagctgaccgaggacaacgccgagctgaacaaccagaacttctacctgagcaagcagctggacgaggccagcggcgccaacgacgagatcgtgcagctgagaagcgaggtggaccacctgagaagagagatcaccgagagagagatgcagctgaccagccagaagcagaccatggaggccctgaagaccacctgcaccatgctggaggagcaggtgatggacctggaggccctgaacgacgagctgctggagaaggagagacagtgggaggcctggagaagcgtgctgggcgacgagaagagccagttcgagtgcagagtgagagagctgcagagaatgctggacaccgagaagcagagcagagccagagccgaccagagaatcaccgagagcagacaggtggtggagctggccgtgaaggagcacaaggccgagatcctggccctgcagcaggccctgaaggagcagaagctgaaggccgagagcctgagcgacaagctgaacgacctggagaagaagcacgccatgctggagatgaacgccagaagcctgcagcagaagctggagaccgagagagagctgaagcagagactgctggaggagcaggccaagctgcagcagcagatggacctgcagaagaaccacatcttcagactgacccagggcctgcaggaggccctggacagagccgacctgctgaagaccgagagaagcgacctggagtaccagctggagaacatccaggtgctgtacagccacgagaaggtgaagatggagggcaccatcagccagcagaccaagctgatcgacttcctgcaggccaagatggaccagcccgccaagaagaagaagggcctgttcagcagaagaaaggaggaccccgccctgcccacccaggtgcccctgcagtacaacgagctgaagctggccctggagaaggagaaggccagatgcgccgagctggaggaggccctgcagaagaccagaatcgagctgagaagcgccagagaggaggccgcccacagaaaggccaccgaccacccccaccccagcacccccgccaccgccagacagcagatcgccatgagcgccatcgtgagaagccccgagcaccagcccagcgccatgagcctgctggccccccccagcagcagaagaaaggagagcagcacccccgaggagttcagcagaagactgaaggagagaatgcaccacaacatcccccacagattcaacgtgggcctgaacatgagagccaccaagtgcgccgtgtgcctggacaccgtgcacttcggcagacaggccagcaagtgcctggagtgccaggtgatgtgccaccccaagtgcagcacctgcctgcccgccacctgcggcctgcccgccgagtacgccacccacttcaccgaggccttctgcagagacaagatgaacagccccggcctgcagaccaaggagcccagcagcagcctgcacctggagggctggatgaaggtgcccagaaacaacaagagaggccagcagggctgggacagaaagtacatcgtgctggagggcagcaaggtgctgatctacgacaacgaggccagagaggccggccagagacccgtggaggagttcgagctgtgcctgcccgacggcgacgtgagcatccacggcgccgtgggcgccagcgagctggccaacaccgccaaggccgacgtgccctacatcctgaagatggagagccacccccacaccacctgctggcccggcagaaccctgtacctgctggcccccagcttccccgacaagcagagatgggtgaccgccctggagagcgtggtggccggcggcagagtgagcagagagaaggccgaggccgacgccaagctgctgggcaacagcctgctgaagctggagggcgacgacagactggacatgaactgcaccctgcccttcagcgaccaggtggtgctggtgggcaccgaggagggcctgtacgccctgaacgtgctgaagaacagcctgacccacgtgcccggcatcggcgccgtgttccagatctacatcatcaaggacctggagaagctgctgatgatcgccggcgaggagagagccctgtgcctggtggacgtgaagaaggtgaagcagagcctggcccagagccacctgcccgcccagcccgacatcagccccaacatcttcgaggccgtgaagggctgccacctgttcggcgccggcaagatcgagaacggcctgtgcatctgcgccgccatgcccagcaaggtggtgatcctgagatacaacgagaacctgagcaagtactgcatcagaaaggagatcgagaccagcgagccctgcagctgcatccacttcaccaactacagcatcctgatcggcaccaacaagttctacgagatcgacatgaagcagtacaccctggaggagttcctggacaagaacgaccacagcctggcccccgccgtgttcgccgccagcagcaacagcttccccgtgagcatcgtgcaggtgaacagcgccggccagagagaggagtacctgctgtgcttccacgagttcggcgtgttcgtggacagctacggcagaagaagcagaaccgacgacctgaagtggagcagactgcccctggccttcgcctacagagagccctacctgttcgtgacccacttcaacagcctggaggtgatcgagatccaggccagaagcagcgccggcacccccgccagagcctacctggacatccccaaccccagatacctgggccccgccatcagcagcggcgccatctacctggccagcagctaccaggacaagctgagagtgatctgctgcaagggcaacctggtgaaggagagcggcaccgagcaccacagaggccccagcaccagcagaagcagccccaacaagagaggcccccccacctacaacgagcacatcaccaagagagtggccagcagccccgccccccccgagggccccagccaccccagagagcccagcaccccccacagatacagagagggcagaaccgagctgagaagagacaagagccccggcagacccctggagagagagaagagccccggcagaatgctgagcaccagaagagagagaagccccggcagactgttcgaggacagcagcagaggcagactgcccgccggcgccgtgagaacccccctgagccaggtgaacaaggtgtgggaccagagcagcgtgtag

SEQ ID NO: 76991 - DNA, 6210 bp, Artificial Sequence
  Description of Artificial Sequence: Synthetic coding sequence
atgctgaagttcaagtacggcgccagaaaccccctggacgccggcgccgccgagcccatcgccagcagagccagcagactgaacctgttcttccagggcaagccccccttcatgacccagcagcagatgagccccctgagcagagagggcatcctggacgccctgttcgtgctgttcgaggagtgcagccagcccgccctgatgaagatcaagcacgtgagcaacttcgtgagaaagtacagcgacaccatcgccgagctgcaggagctgcagcccagcgccaaggacttcgaggtgagaagcctggtgggctgcggccacttcgccgaggtgcaggtggtgagagagaaggccaccggcgacatctacgccatgaaggtgatgaagaagaaggccctgctggcccaggagcaggtgagcttcttcgaggaggagagaaacatcctgagcagaagcaccagcccctggatcccccagctgcagtacgccttccaggacaagaaccacctgtacctggtgatggagtaccagcccggcggcgacctgctgagcctgctgaacagatacgaggaccagctggacgagaacctgatccagttctacctggccgagctgatcctggccgtgcacagcgtgcacctgatgggctacgtgcacagagacatcaagcccgagaacatcctggtggacagaaccggccacatcaagctggtggacttcggcagcgccgccaagatgaacagcaacaagatggtgaacgccaagctgcccatcggcacccccgactacatggcccccgaggtgctgaccgtgatgaacggcgacggcaagggcacctacggcctggactgcgactggtggagcgtgggcgtgatcgcctacgagatgatctacggcagaagccccttcgccgagggcaccagcgccagaaccttcaacaacatcatgaacttccagagattcctgaagttccccgacgaccccaaggtgagcagcgacttcctggacctgatccagagcctgctgtgcggccagaaggagagactgaagttcgagggcctgtgctgccaccccttcttcagcaagatcgactggaacaacatcagaaacagccccccccccttcgtgcccaccctgaagagcgacgacgacaccagcaacttcgacgagcccgagaagaacagctgggtgagcagcagcccctgccagctgagccccagcggcttcagcggcgaggagctgcccttcgtgggcttcagctacagcaaggccctgggcatcctgggcagaagcgagagcgtggtgagcggcctggacagccccgccaagaccagcagcatggagaagaagctgctgatcaagagcaaggagctgcaggacagccaggacaagtgccacaagatggagcaggagatgaccagactgcacagaagagtgagcgaggtggaggccgtgctgagccagaaggaggtggagctgaaggccagcgagacccagagaagcctgctggagcaggacctggccacctacatcaccgagtgcagcagcctgaagagaagcctggagcaggccagaatggaggtgagccaggaggacgacaaggccctgcagctgctgcacgacatcagagagcagagcagaaagctgcaggagatcaaggagcaggagtaccaggcccaggtggaggagatgagactgatgatgaaccagctggaggaggacctggtgagcgccagaagaagaagcgacctgtacgagagcgagctgagagagagcagactggccgccgaggagttcaagagaaaggccaccgagtgccagcacaagctgctgaaggccaaggaccagggcaagcccgaggtgggcgagtacgccaagctggagaagatcaacgccgagcagcagctgaagatccaggagctgcaggagaagctggagaaggccgtgaaggccagcaccgaggccaccgagctgctgcagaacatcagacaggccaaggagagagccgagagagagctggagaagctgcagaacagagaggacagcagcgagggcatcagaaagaagctggtggaggccgaggagagaagacacagcctggagaacaaggtgaagagactggagaccatggagagaagagagaacagactgaaggacgacatccagaccaagagccagcagatccagcagatggccgacaagatcctggagctggaggagaagcacagagaggcccaggtgagcgcccagcacctggaggtgcacctgaagcagaaggagcagcactacgaggagaagatcaaggtgctggacaaccagatcaagaaggacctggccgacaaggagaccctggagaacatgatgcagagacacgaggaggaggcccacgagaagggcaagatcctgagcgagcagaaggccatgatcaacgccatggacagcaagatcagaagcctggagcagagaatcgtggagctgagcgaggccaacaagctggccgccaacagcagcctgttcacccagagaaacatgaaggcccaggaggagatgatcagcgagctgagacagcagaagttctacctggagacccaggccggcaagctggaggcccagaacagaaagctggaggagcagctggagaagatcagccaccaggaccacagcgacaagaacagactgctggagctggagaccagactgagagaggtgagcctggagcacgaggagcagaagctggagctgaagagacagctgaccgagctgcagctgagcctgcaggagagagagagccagctgaccgccctgcaggccgccagagccgccctggagagccagctgagacaggccaagaccgagctggaggagaccaccgccgaggccgaggaggagatccaggccctgaccgcccacagagacgagatccagagaaagttcgacgccctgagaaacagctgcaccgtgatcaccgacctggaggagcagctgaaccagctgaccgaggacaacgccgagctgaacaaccagaacttctacctgagcaagcagctggacgaggccagcggcgccaacgacgagatcgtgcagctgagaagcgaggtggaccacctgagaagagagatcaccgagagagagatgcagctgaccagccagaagcagaccatggaggccctgaagaccacctgcaccatgctggaggagcaggtgatggacctggaggccctgaacgacgagctgctggagaaggagagacagtgggaggcctggagaagcgtgctgggcgacgagaagagccagttcgagtgcagagtgagagagctgcagagaatgctggacaccgagaagcagagcagagccagagccgaccagagaatcaccgagagcagacaggtggtggagctggccgtgaaggagcacaaggccgagatcctggccctgcagcaggccctgaaggagcagaagctgaaggccgagagcctgagcgacaagctgaacgacctggagaagaagcacgccatgctggagatgaacgccagaagcctgcagcagaagctggagaccgagagagagctgaagcagagactgctggaggagcaggccaagctgcagcagcagatggacctgcagaagaaccacatcttcagactgacccagggcctgcaggaggccctggacagagccgacctgctgaagaccgagagaagcgacctggagtaccagctggagaacatccaggtgctgtacagccacgagaaggtgaagatggagggcaccatcagccagcagaccaagctgatcgacttcctgcaggccaagatggaccagcccgccaagaagaagaagggcctgttcagcagaagaaaggaggaccccgccctgcccacccaggtgcccctgcagtacaacgagctgaagctggccctggagaaggagaaggccagatgcgccgagctggaggaggccctgcagaagaccagaatcgagctgagaagcgccagagaggaggccgcccacagaaaggccaccgaccacccccaccccagcacccccgccaccgccagacagcagatcgccatgagcgccatcgtgagaagccccgagcaccagcccagcgccatgagcctgctggccccccccagcagcagaagaaaggagagcagcacccccgaggagttcagcagaagactgaaggagagaatgcaccacaacatcccccacagattcaacgtgggcctgaacatgagagccaccaagtgcgccgtgtgcctggacaccgtgcacttcggcagacaggccagcaagtgcctggagtgccaggtgatgtgccaccccaagtgcagcacctgcctgcccgccacctgcggcctgcccgccgagtacgccacccacttcaccgaggccttctgcagagacaagatgaacagccccggcctgcagaccaaggagcccagcagcagcctgcacctggagggctggatgaaggtgcccagaaacaacaagagaggccagcagggctgggacagaaagtacatcgtgctggagggcagcaaggtgctgatctacgacaacgaggccagagaggccggccagagacccgtggaggagttcgagctgtgcctgcccgacggcgacgtgagcatccacggcgccgtgggcgccagcgagctggccaacaccgccaaggccgacgtgccctacatcctgaagatggagagccacccccacaccacctgctggcccggcagaaccctgtacctgctggcccccagcttccccgacaagcagagatgggtgaccgccctggagagcgtggtggccggcggcagagtgagcagagagaaggccgaggccgacgccaagctgctgggcaacagcctgctgaagctggagggcgacgacagactggacatgaactgcaccctgcccttcagcgaccaggtggtgctggtgggcaccgaggagggcctgtacgccctgaacgtgctgaagaacagcctgacccacgtgcccggcatcggcgccgtgttccagatctacatcatcaaggacctggagaagctgctgatgatcgccggcgaggagagagccctgtgcctggtggacgtgaagaaggtgaagcagagcctggcccagagccacctgcccgcccagcccgacatcagccccaacatcttcgaggccgtgaagggctgccacctgttcggcgccggcaagatcgagaacggcctgtgcatctgcgccgccatgcccagcaaggtggtgatcctgagatacaacgagaacctgagcaagtactgcatcagaaaggagatcgagaccagcgagccctgcagctgcatccacttcaccaactacagcatcctgatcggcaccaacaagttctacgagatcgacatgaagcagtacaccctggaggagttcctggacaagaacgaccacagcctggcccccgccgtgttcgccgccagcagcaacagcttccccgtgagcatcgtgcaggtgaacagcgccggccagagagaggagtacctgctgtgcttccacgagttcggcgtgttcgtggacagctacggcagaagaagcagaaccgacgacctgaagtggagcagactgcccctggccttcgcctacagagagccctacctgttcgtgacccacttcaacagcctggaggtgatcgagatccaggccagaagcagcgccggcacccccgccagagcctacctggacatccccaaccccagatacctgggccccgccatcagcagcggcgccatctacctggccagcagctaccaggacaagctgagagtgatctgctgcaagggcaacctggtgaaggagagcggcaccgagcaccacagaggccccagcaccagcagaagcagccccaacaagagaggcccccccacctacaacgagcacatcaccaagagagtggccagcagccccgccccccccgagggccccagccaccccagagagcccagcaccccccacagatacagagagggcagaaccgagctgagaagagacaagagccccggcagacccctggagagagagaagagccccggcagaatgctgagcaccagaagagagagaagccccggcagactgttcgaggacagcagcagaggcagactgcccgccggcgccgtgagaacccccctgagccaggtgaacaaggtgtgggaccagagcagcgtgtag

SEQ ID NO: 76992 - DNA, 696 bp, Artificial Sequence
  Description of Artificial Sequence: Synthetic coding sequence
atggaccccgagcacgccaagcccgagagcagcgaggcccccagcggcaacctgaagcagcccgagaccgccgccgccctggccagcagcggcagcgtggtgagcagcgtgcccaaggcccagagaaacatcagcgccaagaccgcccccagaaagcaccccgccgtgagcatcagaagcgcccagagcgccgccgccgccagaccccagggcagcgagggcaccgcccccagcagaaaggccaccaccagacccccccccaagcccaccctgcccccccccacccccagcgcccacaccgagagcaagctgctgaacgagatggccatcaaggagagagtggagggcagagccaaggtgccctacaagttcagagacagcctgaagagattcagcttcagccccaccggcatgctgaagatcctgagactgagcctgatcctgggcgccctggcctgcttcatcatcacccaggccaacgagagcttcatcaccatcaccagcctggagatctgcatcgtggtgttcttcatcctgatctacgtgctgaccctgcaccacctgctgacctacctgcactggcccctgctggacctgaccaacagcatcatcaccgccgtgttcctgagcgtggtggccatcctggccatgcaggagaagaagagaagacacctgctgtacgtgggcggcagatag

SEQ ID NO: 76993 - DNA, 369 bp, Artificial Sequence
  Description of Artificial Sequence: Synthetic coding sequence
atggaccccgagcacgccaagcccgagagcagcgaggcccccagcggcaacctgaagcagcccgagaccgccgccgccctggccagcagcggcagcgtggacctgaccaacagcatcatcaccgccgtgttcctgagcgtggtggccatcctggccatgcaggagaagaagagaagacacctgctgtacgtgggcggcagcctgtgcctgaccgccgtgatcgtgtgctgcatcgacgccttcgtggtgaccaccaagatgagaaccaacctgaagagattcctgggcgtggaggtggagagaaagctgagccccgccaaggacgcctaccccgagaccggccccgacgccccccagagacccgcctag

SEQ ID NO: 76994 - DNA, 351 bp, Artificial Sequence
  Description of Artificial Sequence: Synthetic coding sequence
atggaccccgagcacgccaagcccgagagcagcgaggcccccagcggcaacctgaagcagcccgagaccgccgccgccctggacctgaccaacagcatcatcaccgccgtgttcctgagcgtggtggccatcctggccatgcaggagaagaagagaagacacctgctgtacgtgggcggcagcctgtgcctgaccgccgtgatcgtgtgctgcatcgacgccttcgtggtgaccaccaagatgagaaccaacctgaagagattcctgggcgtggaggtggagagaaagctgagccccgccaaggacgcctaccccgagaccggccccgacgccccccagagacccgcctag

SEQ ID NO: 76995 - DNA, 279 bp, Artificial Sequence
  Description of Artificial Sequence: Synthetic coding sequence
atggaccccgagcacgccaagcccgagagcagcgaggcccccagcggcaacctgaagcagcccgagaccgccgccgccctggccagcagcggcagcgtggtgagcagcgtgcccaaggcccagagaaacatcagcgccaagaccgcccccagaaagcaccccgccgtgagcatcagaagcgcccagagcgccgccgccgccagaccccagggcagcgagggcaccgcccccagcagaatcctgcccaccgtgagcctgcagctgtgcagcttccagtag

SEQ ID NO: 76996 - DNA, 861 bp, Artificial Sequence
  Description of Artificial Sequence: Synthetic coding sequence
atggaccccgagcacgccaagcccgagagcagcgaggcccccagcggcaacctgaagcagcccgagaccgccgccgccctggccagcagcggcagcgtggtgagcagcgtgcccaaggcccagagaaacatcagcgccaagaccgcccccagaaagcaccccgccgtgagcatcagaagcgcccagagcgccgccgccgccagaccccagggcagcgagggcaccgcccccagcagaaaggccaccaccagacccccccccaagcccaccctgcccccccccacccccagcgcccacaccgagagcaagctgctgaacgagatggccatcaaggagagagtggagggcagagccaaggtgccctacaagttcagagacagcctgaagagattcagcttcagccccaccggcatgctgaagatcctgagactgagcctgatcctgggcgccctggcctgcttcatcatcacccaggccaacgagagcttcatcaccatcaccagcctggagatctgcatcgtggtgttcttcatcctgatctacgtgctgaccctgcaccacctgctgacctacctgcactggcccctgctggacctgaccaacagcatcatcaccgccgtgttcctgagcgtggtggccatcctggccatgcaggagaagaagagaagacacctgctgtacgtgggcggcagcctgtgcctgaccgccgtgatcgtgtgctgcatcgacgccttcgtggtgaccaccaagatgagaaccaacctgaagagattcctgggcgtggaggtggagagaaagctgagccccgccaaggacgcctaccccgagaccggccccgacgccccccagagacccgcctag

SEQ ID NO: 76997 - DNA, 510 bp, Artificial Sequence
  Description of Artificial Sequence: Synthetic coding sequence
atggaccccgagcacgccaagcccgagagcagcgaggcccccagcggcaacctgaagcagcccgagaccgccgccgccctgagcctgatcctgggcgccctggcctgcttcatcatcacccaggccaacgagagcttcatcaccatcaccagcctggagatctgcatcgtggtgttcttcatcctgatctacgtgctgaccctgcaccacctgctgacctacctgcactggcccctgctggacctgaccaacagcatcatcaccgccgtgttcctgagcgtggtggccatcctggccatgcaggagaagaagagaagacacctgctgtacgtgggcggcagcctgtgcctgaccgccgtgatcgtgtgctgcatcgacgccttcgtggtgaccaccaagatgagaaccaacctgaagagattcctgggcgtggaggtggagagaaagctgagccccgccaaggacgcctaccccgagaccggccccgacgccccccagagacccgcctag

SEQ ID NO: 76998 - DNA, 345 bp, Artificial Sequence
  Description of Artificial Sequence: Synthetic coding sequence
atggaccccgagcacgccaagcccgagagcagcgaggcccccagcggcaacctgaagcagcccgagaccgccgccgccctgagcctgatcctgggcgccctggcctgcttcatcatcacccaggccaacgagagcttcatcaccatcaccagcctggagatctgcatcgtggtgttcttcatcctgatctacgtgctgaccctgcaccacctgctgacctacctgcactggcccctgctggacctgaccaacagcatcatcaccgccgtgttcctgagcgtggtggccatcctggccatgcaggagaagaagagaagacacctgctgtacgtgggcggcagatag

SEQ ID NO: 76999 - DNA, 117 bp, Artificial Sequence
  Description of Artificial Sequence: Synthetic coding sequence
atggaccccgagcacgccaagcccgagagcagcgaggcccccagcggcaacctgaagcagcccgagaccgccgccgccctggaggccgacaaggccaacatgagcaacttcaactag

SEQ ID NO: 77000 - DNA, 87 bp, Artificial Sequence
  Description of Artificial Sequence: Synthetic coding sequence
atggaccccgagcacgccaagcccgagagcagcgaggcccccagcggcaacctgaagcagcccgagaccgccgccgccctgagatag

SEQ ID NO: 77001 - DNA, 747 bp, Artificial Sequence
  Description of Artificial Sequence: Synthetic coding sequence
atggcccccaaggccgccaagggcgccaagcccgagcccgcccccgccccccccccccccggcgccaagcccgaggaggacaagaaggacggcaaggagcccagcgacaagccccagaaggccgtgcaggaccacaaggagcccagcgacaagccccagaaggccgtgcagcccaagcacgaggtgggcaccagaagaggctgcagaagatacagatgggagctgaaggacagcaacaaggagttctggctgctgggccacgccgagatcaagatcagaagcctgggctgcctgatcgccgccatgatcctgctgagcagcctgaccgtgcaccccatcctgagactgatcatcaccatggagatcagcttcttcagcttcttcatcctgctgtacagcttcgccatccacagatacatccccttcatcctgtggcccatcagcgacctgttcaacgacctgatcgcctgcgccttcctggtgggcgccgtggtgttcgccgtgagaagcagaagaagcatgaacctgcactacctgctggccgtgatcctgatcggcgccgccggcgtgttcgccttcatcgacgtgtgcctgcagagaaaccacttcagaggcaagaaggccaagaagcacatgctggtgcccccccccggcaaggagaagggcccccagcagggcaagggccccgagcccgccaagccccccgagcccggcaagccccccggccccgccaagggcaagaagtag

SEQ ID NO: 77002 - DNA, 588 bp, Artificial Sequence
  Description of Artificial Sequence: Synthetic coding sequence
atggcccccaaggccgccaagggcgccaagcccgagcccgcccccgccccccccccccccggcgccaagcccgaggaggacaagaaggacggcaaggagcccagcgacaagccccagaaggccgtgcaggaccacaaggagcccagcgacaagccccagaaggccgtgcagcccaagcacgaggtgggcaccagaagaggctgcagaagatacagatgggagctgaaggacagcaacaaggagttctggctgctgggccacgccgagatcaagatcagaagcctggacctgttcaacgacctgatcgcctgcgccttcctggtgggcgccgtggtgttcgccgtgagaagcagaagaagcatgaacctgcactacctgctggccgtgatcctgatcggcgccgccggcgtgttcgccttcatcgacgtgtgcctgcagagaaaccacttcagaggcaagaaggccaagaagcacatgctggtgcccccccccggcaaggagaagggcccccagcagggcaagggccccgagcccgccaagccccccgagcccggcaagccccccggccccgccaagggcaagaagtag

SEQ ID NO: 77003 - DNA, 180 bp, Artificial Sequence
  Description of Artificial Sequence: Synthetic coding sequence
atgtggccccccgaccccgaccccgaccccgaccccgagcccgccggcggcagcagacccggccccgccgtgcccggcctgagagccctgctgcccgccagagccttcctgtgcagcctgaagggccccggcggcttcgtgtgcacctggtgcagctgcccccaccagcccctgtggtag

SEQ ID NO: 77004 - DNA, 549 bp, Artificial Sequence
  Description of Artificial Sequence: Synthetic coding sequence
atgtggccccccgaccccgaccccgaccccgaccccgagcccgccggcggcagcagacccggccccgccgtgcccggcctgagagccctgctgcccgccagagccttcctgtgcagcctgaagggcagactgctgctggccgagagcggcctgagcttcatcaccttcatctgctacgtggccagcagcgccagcgccttcctgaccgcccccctgctggagttcctgctggccctgtacttcctgttcgccgacgccatgcagctgaacgacaagtggcagggcctgtgctggcccatgatggacttcctgagatgcgtgaccgccgccctgatctacttcgccatcagcatcaccgccatcgccaagtacagcgacggcgccagcaaggccgccggcgtgttcggcttcttcgccaccatcgtgttcgccaccgacttctacctgatcttcaacgacgtggccaagttcctgaagcagggcgacagcgccgacgagaccaccgcccacaagaccgaggaggagaacagcgacagcgacagcgactag

SEQ ID NO: 77005 - DNA, 549 bp, Artificial Sequence; identical to SEQ ID NO: 77004
  Description of Artificial Sequence: Synthetic coding sequence

SEQ ID NO: 77006 - DNA, 549 bp, Artificial Sequence; identical to SEQ ID NO: 77004
  Description of Artificial Sequence: Synthetic coding sequence

SEQ ID NO: 77007 - DNA, 705 bp, Artificial Sequence
  Description of Artificial Sequence: Synthetic coding sequence
atgagaagcggcgaggagctggacggcttcgagggcgaggccagcagcaccagcatgatcagcggcgccagcagcccctaccagcccaccaccgagcccgtgagccagagaagaggcctggccggcctgagatgcgaccccgactacctgagaggcgccctgggcagactgaaggtggcccaggtgatcctggccctgatcgccttcatctgcatcgagaccatcatggcctgcagcccctgcgagggcctgtacttcttcgagttcgtgagctgcagcgccttcgtggtgaccggcgtgctgctgatcatgttcagcctgaacctgcacatgagaatcccccagatcaactggaacctgaccgacctggtgaacaccggcctgagcgccttcctgttcttcatcgccagcatcgtgctggccgccctgaaccacagagccggcgccgagatcgccgccgtgatcttcggcttcctggccaccgccgcctacgccgtgaacaccttcctggccgtgcagaagtggagagtgagcgtgagacagcagagcaccaacgactacatcagagccagaaccgagagcagagacgtggacagcagacccgagatccagagactggacaccttcagctacagcaccaacgtgaccgtgagaaagaagagccccaccaacctgctgagcctgaaccactggcagctggcctag

SEQ ID NO: 77008 - DNA, 627 bp, Artificial Sequence
  Description of Artificial Sequence: Synthetic coding sequence
atgagaagcggcgaggagctggacggcttcgagggcgaggccagcagcaccagcatgatcagcggcgccagcagcccctaccagcccaccaccgagcccgtgagccagagaagaggcctggccggcctgagatgcgaccccgactacctgagaggcgccctgggcagactgaaggtggcccaggtgatcctggccctgatcgccttcatctgcatcgagaccatcatggcctgcagcccctgcgagggcctgtacttcttcgagttcgtgagctgcagcgccttcgtggtgaccggcgtgctgctgatcatgttcagcctgaacctgcacatgagaatcccccagatcaactggaacctgaccgacctggtgaacaccggcctgagcgccttcctgttcttcatcgccagcatcgtgctggccgccctgaaccacagagccggcgccgagatcgccgccgtgatcttcggcttcctggccaccgccgcctacgccgtgaacaccttcctggccgtgcagaagtggagagtgagcgtgagacagcagagcaccaacgactacatcagagccagaaccgagagcagagacgtggacagcagacccgagatccagagactggacacctag

SEQ ID NO: 77009 - DNA, 672 bp, Artificial Sequence
  Description of Artificial Sequence: Synthetic coding sequence
atgctgagcgccagagacagaagagacagacaccccgaggagggcgtggtggccgagctgcagggcttcgccgtggacaaggccttcctgaccagccacaagggcatcctgctggagaccgagctggccctgaccctgatcatcttcatctgcttcaccgccagcatcagcgcctacatggccgccgccctgctggagttcttcatcaccctggccttcctgttcctgtacgccacccagtactaccagagattcgacagaatcaactggccctgcctgctgcagggccacggccagagcggcggcccccaccccctggacctgctgagccacagcgccaaggtgcagccccagccctggcccggcctgaccccccccggctggcacacccccgccgccgtgccctgggtgcccgcccccgcccccggcttctggagctggctgctgtggttcatctgcttccacagcctgggcagcagcgacttcctgagatgcgtgagcgccatcatcatcttcctggtggtgagcttcgccgccgtgaccagcagagacggcgccgccatcgccgccttcgtgttcggcatcatcctggtgagcatcttcgcctacgacgccttcaagatctacagaaccgagatggcccccggcgccagccagggcgaccagcagtag

SEQ ID NO: 77010 - DNA, 225 bp, Artificial Sequence
  Description of Artificial Sequence: Synthetic coding sequence
atgctgagcgccagagacagaagagacagacaccccgaggagggcgtggtggccgagctgcagggcttcgccgtggacaaggccttcctgaccagccacaagggcatcctgctggagaccgagctggtgttcggcatcatcctggtgagcatcttcgcctacgacgccttcaagatctacagaaccgagatggcccccggcgccagccagggcgaccagcagtag

SEQ ID NO: 77011 - DNA, 471 bp, Artificial Sequence
  Description of Artificial Sequence: Synthetic coding sequence
atgctgagcgccagagacagaagagacagacaccccgaggagggcgtggtggccgagctgcagggcttcgccgtggacaaggccttcctgaccagccacaagggcatcctgctggagaccgagctggccctgaccctgatcatcttcatctgcttcaccgccagcatcagcgcctacatggccgccgccctgctggagttcttcatcaccctggccttcctgttcctgtacgccacccagtactaccagagattcgacagaatcaactggccctgcctggacttcctgagatgcgtgagcgccatcatcatcttcctggtggtgagcttcgccgccgtgaccagcagagacggcgccgccatcgccgccttcgtgttcggcatcatcctggtgagcatcttcgcctacgacgccttcaagatctacagaaccgagatggcccccggcgccagccagggcgaccagcagtag

SEQ ID NO: 77012 - DNA, 378 bp, Artificial Sequence
  Description of Artificial Sequence: Synthetic coding sequence
atgctgagcgccagagacagaagagacagacaccccgaggagggcgtggtggccgagctgcagggcttcgccgtggacaaggccttcctgaccagccacaagggcatcctgctggagaccgagctggccctgaccctgatcatcttcatctgcttcaccgccagcatcagcgcctacatggccgccgccctgctggagttcttcatcaccctggccttcctgttcctgtacgccacccagtactaccagagattcgacagaatcaactggccctgcctggtgttcggcatcatcctggtgagcatcttcgcctacgacgccttcaagatctacagaaccgagatggcccccggcgccagccagggcgaccagcagtag

SEQ ID NO: 77013 - DNA, 318 bp, Artificial Sequence
  Description of Artificial Sequence: Synthetic coding sequence
atgctgagcgccagagacagaagagacagacaccccgaggagggcgtggtggccgagctgcagggcttcgccgtggacaaggccttcctgaccagccacaagggcatcctgctggagaccgagctggacttcctgagatgcgtgagcgccatcatcatcttcctggtggtgagcttcgccgccgtgaccagcagagacggcgccgccatcgccgccttcgtgttcggcatcatcctggtgagcatcttcgcctacgacgccttcaagatctacagaaccgagatggcccccggcgccagccagggcgaccagcagtag

SEQ ID NO: 77014 - DNA, 1326 bp, Artificial Sequence
  Description of Artificial Sequence: Synthetic coding sequence
cccagccccgccatcggcctgttcgccagcatggccgccgtgctgctgggcggcgccagagccagcagactgctgttccagagactgctgtgggacgtggtgagaagccccatcagcttcttcgagagaacccccatcggccacctgctgaacagattcagcaaggagaccgacaccgtggacgtggacatccccgacaagctgagaagcctgctgatgtacgccttcggcctgctggaggtgagcctggtggtggccgtggccacccccctgcccctgtggcccagctgccactgcttcagcagcaccctgggcttcagatggctggccgccaacgtggagctgctgggcaacggcctggtgttcgccgccgccacctgcgccgtgctgagcaaggcccacctgagcgccggcctggtgggcttcagcgtgagcgccgccctgcaggtgacccagaccctgcagtgggtggtgagaaactggaccgacctggagaacagcatcgtgagcgtggagagaatgcaggactacgcctggacccccaaggaggccccctggagactgcccacctgcgccgcccagcccccctggccccagggcggccagatcgagttcagagacttcggcctgagatacagacccgagctgcccctggccgtgcagggcgtgagcttcaagatccacgccggcgagaaggtgggcatcgtgggcagaaccggcgccggcaagagcagcctggccagcggcctgctgagactgcaggaggccgccgagggcggcatctggatcgacggcgtgcccatcgcccacgtgggcctgcacaccctgagaagcagaatcagcatcatcccccaggaccccatcctgttccccggcagcctgagaatgaacctggacctgctgcaggagcacagcgacgaggccatctgggccgccctggagaccgtgcagctgaaggccctggtggccagcctgcccggccagctgcagtacaagtgcgccgacagaggcgaggacctgagcgtgggccagaagcagctgctgtgcctggccagagccctgctgagaaagacccagatcctgatcctggacgaggccaccgccgccgtggaccccggcaccgagctgcagatgcaggccatgctgggcagctggttcgcccagtgcaccgtgctgctgatcgcccacagactgagaagcgtgatggactgcgccagagtgctggtgatggacaagggccaggtggccgagagcggcagccccgcccagctgctggcccagaagggcctgttctacagactggcccaggagagcggcctggtgtag

SEQ ID NO: 77015 - DNA, 528 bp, Artificial Sequence
  Description of Artificial Sequence: Synthetic coding sequence
atgagccacggcgccggcctggtgagaaccacctgcagcagcggcagcgccctgggccccggcgccggcgccgcccagcccagcgccagccccctggagggcctgctggacctgagctaccccagaacccacgccgccctgctgaaggtggcccagatggtgaccctgctgatcgccttcatctgcgtgagaagcagcctgtggaccaactacagcgcctacagctacttcgaggtggtgaccatctgcgacctgatcatgatcctggccttctacctggtgcacctgttcagattctacagagtgctgacctgcatcagctggcccctgagcgagctgctgcactacctgatcggcaccctgctgctgctgatcgccagcatcgtggccgccagcaagagctacaaccagagcggcctggtggccggcgccatcttcggcttcatggccaccttcctgtgcatggccagcatctggctgagctacaagatcagctgcgtgacccagagcaccgacgccgccgtgtag

SEQ ID NO: 77016 - DNA, 429 bp, Artificial Sequence
  Description of Artificial Sequence: Synthetic coding sequence
atgagccacggcgccggcctggtgagaaccacctgcagcagcggcagcgccctgggccccggcgccggcgccgcccagcccagcgccagccccctggagggcctgctggacctgagctaccccagaacccacgccgccctgctgaaggtggcccagatggtgaccctgctgatcgccttcatctgcgtgagaagcagcctgtggaccaactacagcgcctacagctacttcgaggtggtgaccatctgcgacctgatcatgatcctggccttctacctggtgcacctgttcagattctacagagtgctgacctgcatcagctggcccctgagcatcttcggcttcatggccaccttcctgtgcatggccagcatctggctgagctacaagatcagctgcgtgacccagagcaccgacgccgccgtgtag

SEQ ID NO: 77017 - DNA, 522 bp, Artificial Sequence
  Description of Artificial Sequence: Synthetic coding sequence
atggaggagccccagagagccagaagccacaccgtgaccaccaccgccagcagcttcgccgagaacttcagcaccagcagcagcagcttcgcctacgacagagagttcctgagaaccctgcccggcttcctgatcgtggccgagatcgtgctgggcctgctggtgtggaccctgatcgccggcaccgagtacttcagagtgcccgccttcggctgggtgatgttcgtggccgtgttctactgggtgctgaccgtgttcttcctgatcatctacatcaccatgacctacaccagaatcccccaggtgccctggaccaccgtgggcctgtgcttcaacggcagcgccttcgtgctgtacctgagcgccgccgtggtggacgccagcagcgtgagccccgagagagacagccacaacttcaacagctgggccgccagcagcttcttcgccttcctggtgaccatctgctacgccggcaacacctacttcagcttcatcgcctggagaagcagaaccatccagtag

SEQ ID NO: 77018 - DNA, 363 bp, Artificial Sequence
  Description of Artificial Sequence: Synthetic coding sequence
atgcaggccctgcagcagcagcccgtgttccccgacctgctgaaggccatccccgtgagcatccacgtgaacgtgatcctgttcagcgccatcctgatcgtgctgaccatggtgggcaccgccttcttcatgtacaacgccttcggcaagcccttcgagaccctgcacggccccctgggcctgtacctgctgagcttcatcagcggcagctgcggctgcctggtgatgatcctgttcgccagcgaggtgaagatccaccacctgagcgagaagatcgccaactacaaggagggcacctacgtgtacaagacccagagcgagaagtacaccaccagcttctggctgaccaagggccacagctag

SEQ ID NO: 77019 - DNA, 699 bp, Artificial Sequence
  Description of Artificial Sequence: Synthetic coding sequence
atgcccagccagcagaagaagatcatcttctgcatggccggcgtgttcagcttcgcctgcgccctgggcgtggtgaccgccctgggcacccccctgtggatcaaggccaccgtgctgtgcaagaccggcgccctgctggtgaacgccagcggccaggagctggacaagttcatgggcgagatgcagtacggcctgttccacggcgagggcgtgagacagtgcggcctgggcgccagacccttcagattcagcttcttccccgacctgctgaaggccatccccgtgagcatccacgtgaacgtgatcctgttcagcgccatcctgatcgtgctgaccatggtgggcaccgccttcttcatgtacaacgccttcggcaagcccttcgagaccctgcacggccccctgggcctgtacctgctgagcttcatcagcggcagctgcggctgcctggtgatgatcctgttcgccagcgaggtgaagatccaccacctgagcgagaagatcgccaactacaaggagggcacctacgtgtacaagacccagagcgagaagtacaccaccagcttctgggtgatcttcttctgcttcttcgtgcacttcctgaacggcctgctgatcagactggccggcttccagttccccttcgccaagagcaaggacgccgagaccaccaacgtggccgccgacctgatgtactag

SEQ ID NO: 77020 - DNA, 738 bp, Artificial Sequence
  Description of Artificial Sequence: Synthetic coding sequence
atgcccagccagcagaagaagatcatcttctgcatggccggcgtgttcagcttcgcctgcgccctgggcgtggtgaccgccctgggcacccccctgtggatcaaggccaccgtgctgtgcaagaccggcgccctgctggtgaacgccagcggccaggagctggacaagttcatgggcgagatgcagtacggcctgttccacggcgagggcgtgagacagtgcggcctgggcgccagacccttcagattcagcttcttccccgacctgctgaaggccatccccgtgagcatccacgtgaacgtgatcctgttcagcgccatcctgatcgtgctgaccatggtgggcaccgccttcttcatgtacaacgccttcggcaagcccttcgagaccctgcacggccccctgggcctgtacctgctgagcttcatcagcgtggccctgtggctgcccgccaccagacaccaggcccagggcagctgcggctgcctggtgatgatcctgttcgccagcgaggtgaagatccaccacctgagcgagaagatcgccaactacaaggagggcacctacgtgtacaagacccagagcgagaagtacaccaccagcttctgggtgatcttcttctgcttcttcgtgcacttcctgaacggcctgctgatcagactggccggcttccagttccccttcgccaagagcaaggacgccgagaccaccaacgtggccgccgacctgatgtactag

SEQ ID NO: 77021 - DNA, 348 bp, Artificial Sequence
  Description of Artificial Sequence: Synthetic coding sequence
atgcaggccctgcagcagcagcccgtgttccccgacctgctgaaggccatccccgtgagcatccacgtgaacgtgatcctgttcagcgccatcctgatcgtgctgaccatggtgggcaccgccttcttcatgtacaacgccttcggcaagcccttcgagaccctgcacggccccctgggcctgtacctgctgagcttcatcagcggcagctgcggctgcctggtgatgatcctgttcgccagcgaggtgaagatccaccacctgagcgagaagatcgccaactacaaggagggcacctacgtgtacaagacccagagcgagaagtacaccaccagcttctgggtgtag

SEQ ID NO: 77022 - DNA, 1878 bp, Artificial Sequence
  Description of Artificial Sequence: Synthetic coding sequence
atgaactacagcgagatcgagagcaaggtgagagaggccaccaacgacgacccctggggccccagcggccagctgatgggcgagatcgccaaggccaccttcatgtacgagcagttccccgagctgatgaacatgctgtggagcagaatgctgaaggacaacaagaagaactggagaagagtgtacaagagcctgctgctgctggcctacctgatcagaaacggcagcgagagagtggtgaccagcgccagagagcacatctacgacctgagaagcctggagaactaccacttcgtggacgagcacggcaaggaccagggcatcaacatcagacagaaggtgaaggagctggtggagttcgcccaggacgacgacagactgagagaggagagaaagaaggccaagaagaacaaggacaagtacgtgggcgtgagcagcgacagcgtgggcggcttcagatacagcgagagatacgaccccgagcccaagagcaagtgggacgaggagtgggacaagaacaagagcgccttccccttcagcgacaagctgggcgagctgagcgacaagatcggcagcaccatcgacgacaccatcagcaagttcagaagaaaggacagagaggacagccccgagagatgcagcgacagcgacgaggagaagaaggccagaagaggcagaagccccaagggcgagttcaaggacgaggaggagaccgtgaccaccaagcacatccacatcacccaggccaccgagaccaccaccaccagacacaagagaaccgccaaccccagcaagaccatcgacctgggcgccgccgcccactacaccggcgacaaggccagccccgaccagaacgccagcacccacaccccccagagcagcgtgaagaccagcgtgcccagcagcaagagcagcggcgacctggtggacctgttcgacggcaccagccagagcaccggcggcagcgccgacctgttcggcggcttcgccgacttcggcagcgccgccgccagcggcagcttccccagccaggtgaccgccaccagcggcaacggcgacttcggcgactggagcgccttcaaccaggcccccagcggccccgtggccagcagcggcgagttcttcggcagcgccagccagcccgccgtggagctggtgagcggcagccagagcgccctgggccccccccccgccgccagcaacagcagcgacctgttcgacctgatgggcagcagccaggccaccatgaccagcagccagagcatgaacttcagcatgatgagcaccaacaccgtgggcctgggcctgcccatgagcagaagccagcccctgcagaacgtgagcaccgtgctgcagaagcccaaccccctgtacaaccagaacaccgacatggtgcagaagagcgtgagcaagaccctgcccagcacctggagcgaccccagcgtgaacatcagcctggacaacctgctgcccggcatgcagcccagcaagccccagcagcccagcctgaacaccatgatccagcagcagaacatgcagcagcccatgaacgtgatgacccagagcttcggcgccgtgaacctgagcagccccagcaacatgctgcccgtgagaccccagaccaacgccctgatcggcggccccatgcccatgagcatgcccaacgtgatgaccggcaccatgggcatggcccccctgggcaacacccccatgatgaaccagagcatgatgggcatgaacatgaacatcggcatgagcgccgccggcatgggcctgaccggcaccatgggcatgggcatgcccaacatcgccatgaccagcggcaccgtgcagcccaagcaggacgccttcgccaacttcgccaacttcagcaagtag

SEQ ID NO: 77023 - DNA, 1878 bp, Artificial Sequence
  Description of Artificial Sequence: Synthetic coding sequence
atgctgaacatgtggaaggtgagagagctggtggacaaggccaccaacgtggtgatgaactacagcgagatcgagagcaaggtgagagaggccaccaacgacgacccctggggccccagcggccagctgatgggcgagatcgccaaggccaccttcatgtacgagcagttccccgagctgatgaacatgctgtggagcagaatgctgaaggacaacaagaagaactggagaagagtgtacaagagcctgctgctgctggcctacctgatcagaaacggcagcgagagagtggtgaccagcgccagagagcacatctacgacctgagaagcctggagaactaccacttcgtggacgagcacggcaaggaccagggcatcaacatcagacagaaggtgaaggagctggtggagttcgcccaggacgacgacagactgagagaggagagaaagaaggccaagaagaacaaggacaagtacgtgggcgtgagcagcgacagcgtgggcggcttcagatacagcgagagatacgaccccgagcccaagagcaagtgggacgaggagtgggacaagaacaagagcgccttccccttcagcgacaagctgggcgagctgagcgacaagatcggcagcaccatcgacgacaccatcagcaagttcagaagaaaggacagagaggacagccccgagagatgcagcgacagcgacgaggagaagaaggccagaagaggcagaagccccaagggcgagttcaaggacgaggaggagaccgtgaccaccaagcacatccacatcacccaggccaccgagaccaccaccaccagacacaagagaaccgccaaccccagcaagaccatcgacctgggcgccgccgcccactacaccggcgacaaggccagccccgaccagaacgccagcacccacaccccccagagcagcgtgaagaccagcgtgcccagcagcaagagcagcggcgacctggtggacctgttcgacggcaccagccagagcaccggcggcagcgccgacctgttcggcggcttcgccgacttcggcagcgccgccgccagcggcagcttccccagccaggtgaccgccaccagcggcaacggcgacttcggcgactggagcgccttcaaccaggcccccagcggccccgtggccagcagcggcgagttcttcggcagcgccagccagcccgccgtggagctggtgagcggcagccagagcgccctgggccccccccccgccgccagcaacagcagcgacctgttcgacctgatgggcagcagccaggccaccatgaccagcagccagagcatgaacttcagcatgatgagcaccaacaccgtgggcctgggcctgcccatgagcagaagccagaacaccgacatggtgcagaagagcgtgagcaagaccctgcccagcacctggagcgaccccagcgtgaacatcagcctggacaacctgctgcccggcatgcagcccagcaagccccagcagcccagcctgaacaccatgatccagcagcagaacatgcagcagcccatgaacgtgatgacccagagcttcggcgccgtgaacctgagcagccccagcaacatgctgcccgtgagaccccagaccaacgccctgatcggcggccccatgcccatgagcatgcccaacgtgatgaccggcaccatgggcatggcccccctgggcaacacccccatgatgaaccagagcatgatgggcatgaacatgaacatcggcatgagcgccgccggcatgggcctgaccggcaccatgggcatgggcatgcccaacatcgccatgaccagcggcaccgtgcagcccaagcaggacgccttcgccaacttcgccaacttcagcaagtag

SEQ ID NO: 77024 - DNA, 1878 bp, Artificial Sequence; identical to SEQ ID NO: 77022
  Description of Artificial Sequence: Synthetic coding sequence

SEQ ID NO: 77025 - DNA, 1878 bp, Artificial Sequence; identical to SEQ ID NO: 77022
  Description of Artificial Sequence: Synthetic coding sequence

SEQ ID NO: 77026 - DNA, 1932 bp, Artificial Sequence
  Description of Artificial Sequence: Synthetic coding sequence
atgctgaacatgtggaaggtgagagagctggtggacaaggccaccaacgtggtgatgaactacagcgagatcgagagcaaggtgagagaggccaccaacgacgacccctggggccccagcggccagctgatgggcgagatcgccaaggccaccttcatgtacgagcagttccccgagctgatgaacatgctgtggagcagaatgctgaaggacaacaagaagaactggagaagagtgtacaagagcctgctgctgctggcctacctgatcagaaacggcagcgagagagtggtgaccagcgccagagagcacatctacgacctgagaagcctggagaactaccacttcgtggacgagcacggcaaggaccagggcatcaacatcagacagaaggtgaaggagctggtggagttcgcccaggacgacgacagactgagagaggagagaaagaaggccaagaagaacaaggacaagtacgtgggcgtgagcagcgacagcgtgggcggcttcagatacagcgagagatacgaccccgagcccaagagcaagtgggacgaggagtgggacaagaacaagagcgccttccccttcagcgacaagctgggcgagctgagcgacaagatcggcagcaccatcgacgacaccatcagcaagttcagaagaaaggacagagaggacagccccgagagatgcagcgacagcgacgaggagaagaaggccagaagaggcagaagccccaagggcgagttcaaggacgaggaggagaccgtgaccaccaagcacatccacatcacccaggccaccgagaccaccaccaccagacacaagagaaccgccaaccccagcaagaccatcgacctgggcgccgccgcccactacaccggcgacaaggccagccccgaccagaacgccagcacccacaccccccagagcagcgtgaagaccagcgtgcccagcagcaagagcagcggcgacctggtggacctgttcgacggcaccagccagagcaccggcggcagcgccgacctgttcggcggcttcgccgacttcggcagcgccgccgccagcggcagcttccccagccaggtgaccgccaccagcggcaacggcgacttcggcgactggagcgccttcaaccaggcccccagcggccccgtggccagcagcggcgagttcttcggcagcgccagccagcccgccgtggagctggtgagcggcagccagagcgccctgggccccccccccgccgccagcaacagcagcgacctgttcgacctgatgggcagcagccaggccaccatgaccagcagccagagcatgaacttcagcatgatgagcaccaacaccgtgggcctgggcctgcccatgagcagaagccagcccctgcagaacgtgagcaccgtgctgcagaagcccaaccccctgtacaaccagaacaccgacatggtgcagaagagcgtgagcaagaccctgcccagcacctggagcgaccccagcgtgaacatcagcctggacaacctgctgcccggcatgcagcccagcaagccccagcagcccagcctgaacaccatgatccagcagcagaacatgcagcagcccatgaacgtgatgacccagagcttcggcgccgtgaacctgagcagccccagcaacatgctgcccgtgagaccccagaccaacgccctgatcggcggccccatgcccatgagcatgcccaacgtgatgaccggcaccatgggcatggcccccctgggcaacacccccatgatgaaccagagcatgatgggcatgaacatgaacatcggcatgagcgccgccggcatgggcctgaccggcaccatgggcatgggcatgcccaacatcgccatgaccagcggcaccgtgcagcccaagcaggacgccttcgccaacttcgccaacttcagcaagtag

SEQ ID NO: 77027 - DNA, 5028 bp, Artificial Sequence
  Description of Artificial Sequence: Synthetic coding sequence
atggcccagatcctgcccatcagattccaggagcacctgcagctgcagaacctgggcatcaaccccgccaacatcggcttcagcaccctgaccatggagagcgacaagttcatctgcatcagagagaaggtgggcgagcaggcccaggtggtgatcatcgacatgaacgaccccagcaaccccatcagaagacccatcagcgccgacagcgccatcatgaaccccgccagcaaggtgatcgccctgaaggccggcaagaccctgcagatcttcaacatcgagatgaagagcaagatgaaggcccacaccatgaccgacgacgtgaccttctggaagtggatcagcctgaacaccgtggccctggtgaccgacaacgccgtgtaccactggagcatggagggcgagagccagcccgtgaagatgttcgacagacacagcagcctggccggctgccagatcatcaactacagaaccgacgccaagcagaagtggctgctgctgaccggcatcagcgcccagcagaacagagtggtgggcgccatgcagctgtacagcgtggacagaaaggtgagccagcccatcgagggccacgccgccagcttcgcccagttcaagatggagggcaacgccgaggagagcaccctgttctgcttcgccgtgagaggccaggccggcggcaagctgcacatcatcgaggtgggcaccccccccaccggcaaccagcccttccccaagaaggccgtggacgtgttcttcccccccgaggcccagaacgacttccccgtggccatgcagatcagcgagaagcacgacgtggtgttcctgatcaccaagtacggctacatccacctgtacgacctggagaccggcacctgcatctacatgaacagaatcagcggcgagaccatcttcgtgaccgccccccacgaggccaccgccggcatcatcggcgtgaacagaaagggccaggtgctgagcgtgtgcgtggaggaggagaacatcatcccctacatcaccaacgtgctgcagaaccccgacctggccctgagaatggccgtgagaaacaacctggccggcgccgaggagctgttcgccagaaagttcaacgccctgttcgcccagggcaactacagcgaggccgccaaggtggccgccaacgcccccaagggcatcctgagaacccccgacaccatcagaagattccagagcgtgcccgcccagcccggccagaccagccccctgctgcagtacttcggcatcctgctggaccagggccagctgaacaagtacgagagcctggagctgtgcagacccgtgctgcagcagggcagaaagcagctgctggagaagtggctgaaggaggacaagctggagtgcagcgaggagctgggcgacctggtgaagagcgtggaccccaccctggccctgagcgtgtacctgagagccaacgtgcccaacaaggtgatccagtgcttcgccgagaccggccaggtgcagaagatcgtgctgtacgccaagaaggtgggctacacccccgactggatcttcctgctgagaaacgtgatgagaatcagccccgaccagggccagcagttcgcccagatgctggtgcaggacgaggagcccctggccgacatcacccagatcgtggacgtgttcatggagtacaacctgatccagcagtgcaccgccttcctgctggacgccctgaagaacaacagacccagcgagggccccctgcagaccagactgctggagatgaacctgatgcacgccccccaggtggccgacgccatcctgggcaaccagatgttcacccactacgacagagcccacatcgcccagctgtgcgagaaggccggcctgctgcagagagccctggagcacttcaccgacctgtacgacatcaagagagccgtggtgcacacccacctgctgaaccccgagtggctggtgaactacttcggcagcctgagcgtggaggacagcctggagtgcctgagagccatgctgagcgccaacatcagacagaacctgcagatctgcgtgcaggtggccagcaagtaccacgagcagctgagcacccagagcctgatcgagctgttcgagagcttcaagagcttcgagggcctgttctacttcctgggcagcatcgtgaacttcagccaggaccccgacgtgcacttcaagtacatccaggccgcctgcaagaccggccagatcaaggaggtggagagaatctgcagagagagcaactgctacgaccccgagagagtgaagaacttcctgaaggaggccaagctgaccgaccagctgcccctgatcatcgtgtgcgacagattcgacttcgtgcacgacctggtgctgtacctgtacagaaacaacctgcagaagtacatcgagatctacgtgcagaaggtgaaccccagcagactgcccgtggtgatcggcggcctgctggacgtggactgcagcgaggacgtgatcaagaacctgatcctggtggtgagaggccagttcagcaccgacgagctggtggccgaggtggagaagagaaacagactgaagctgctgctgccctggctggaggccagaatccacgagggctgcgaggagcccgccacccacaacgccctggccaagatctacatcgacagcaacaacaaccccgagagattcctgagagagaacccctactacgacagcagagtggtgggcaagtactgcgagaagagagacccccacctggcctgcgtggcctacgagagaggccagtgcgacctggagctgatcaacgtgtgcaacgagaacagcctgttcaagagcctgagcagatacctggtgagaagaaaggaccccgagctgtggggcagcgtgctgctggagagcaacccctacagaagacccctgatcgaccaggtggtgcagaccgccctgagcgagacccaggaccccgaggaggtgagcgtgaccgtgaaggccttcatgaccgccgacctgcccaacgagctgatcgagctgctggagaagatcgtgctggacaacagcgtgttcagcgagcacagaaacctgcagaacctgctgatcctgaccgccatcaaggccgacagaaccagagtgatggagtacatcaacagactggacaactacgacgcccccgacatcgccaacatcgccatcagcaacgagctgttcgaggaggccttcgccatcttcagaaagttcgacgtgaacaccagcgccgtgcaggtgctgatcgagcacatcggcaacctggacagagcctacgagttcgccgagagatgcaacgagcccgccgtgtggagccagctggccaaggcccagctgcagaagggcatggtgaaggaggccatcgacagctacatcaaggccgacgaccccagcagctacatggaggtggtgcaggccgccaacaccagcggcaactgggaggagctggtgaagtacctgcagatggccagaaagaaggccagagagagctacgtggagaccgagctgatcttcgccctggccaagaccaacagactggccgagctggaggagttcatcaacggccccaacaacgcccacatccagcaggtgggcgacagatgctacgacgagaagatgtacgacgccgccaagctgctgtacaacaacgtgagcaacttcggcagactggccagcaccctggtgcacctgggcgagtaccaggccgccgtggacggcgccagaaaggccaacagcaccagaacctggaaggaggtgtgcttcgcctgcgtggacggcaaggagttcagactggcccagatgtgcggcctgcacatcgtggtgcacgccgacgagctggaggagctgatcaactactaccaggacagaggctacttcgaggagctgatcaccatgctggaggccgccctgggcctggagagagcccacatgggcatgttcaccgagctggccatcctgtacagcaagttcaagccccagaagatgagagagcacctggagctgttctggagcagagtgaacatccccaaggtgctgagagccgccgagcaggcccacctgtgggccgagctggtgttcctgtacgacaagtacgaggagtacgacaacgccatcatcaccatgatgaaccaccccaccgacgcctggaaggagggccagttcaaggacatcatcaccaaggtggccaacgtggagctgtactacagagccatccagttctacctggagttcaagcccctgctgctgaacgacctgctgatggtgctgagccccagactggaccacaccagagccgtgaactacttcagcaaggtgaagcagctgcccctggtgaagccctacctgagaagcgtgcagaaccacaacaacaagagcgtgaacgagagcctgaacaacctgttcatcaccgaggaggactaccaggccctgagaaccagcatcgacgcctacgacaacttcgacaacatcagcctggcccagagactggagaagcacgagctgatcgagttcagaagaatcgccgcctacctgttcaagggcaacaacagatggaagcagagcgtggagctgtgcaagaaggacagcctgtacaaggacgccatgcagtacgccagcgagagcaaggacaccgagctggccgaggagctgctgcagtggttcctgcaggaggagaagagagagtgcttcggcgcctgcctgttcacctgctacgacctgctgagacccgacgtggtgctggagaccgcctggagacacaacatcatggacttcgccatgccctacttcatccaggtgatgaaggagtacctgaccaaggtggacaagctggacgccagcgagagcctgagaaaggaggaggagcaggccaccgagacccagcccatcgtgtacggccagccccagctgatgctgaccgccggccccagcgtggccgtgcccccccaggcccccttcggctacggctacaccgcccccccctacggccagccccagcccggcttcggctacagcatgtag

SEQ ID NO: 77028 - DNA, 4923 bp, Artificial Sequence
  Description of Artificial Sequence: Synthetic coding sequence
atggcccagatcctgcccgtgagattccaggagcacttccagctgcagaacctgggcatcaaccccgccaacatcggcttcagcaccctgaccatggagagcgacaagttcatctgcatcagagagaaggtgggcgagcaggcccaggtgaccatcatcgacatgagcgaccccatggcccccatcagaagacccatcagcgccgagagcgccatcatgaaccccgccagcaaggtgatcgccctgaaggccggcaagaccctgcagatcttcaacatcgagatgaagagcaagatgaaggcccacaccatggccgaggaggtgatcttctggaagtgggtgagcgtgaacaccgtggccctggtgaccgagaccgccgtgtaccactggagcatggagggcgacagccagcccatgaagatgttcgacagacacaccagcctggtgggctgccaggtgatccactacagaaccgacgagtaccagaagtggctgctgctggtgggcatcagcgcccagcagaacagagtggtgggcgccatgcagctgtacagcgtggacagaaaggtgagccagcccatcgagggccacgccgccgccttcgccgagttcaagatggagggcaacgccaagcccgccaccctgttctgcttcgccgtgagaaaccccaccggcggcaagctgcacatcatcgaggtgggccagcccgccgccggcaaccagcccttcgtgaagaaggccgtggacgtgttcttcccccccgaggcccagaacgacttccccgtggccatgcagatcggcgccaagcacggcgtgatctacctgatcaccaagtacggctacctgcacctgtacgacctggagagcggcgtgtgcatctgcatgaacagaatcagcgccgacaccatcttcgtgaccgccccccacaagcccaccagcggcatcatcggcgtgaacaagaagggccaggtgctgagcgtgtgcgtggaggaggacaacatcgtgaactacgccaccaacgtgctgcagaaccccgacctgggcctgagactggccgtgagaagcaacctggccggcgccgagaagctgttcgtgagaaagttcaacaccctgttcgcccagggcagctacgccgaggccgccaaggtggccgccagcgcccccaagggcatcctgagaaccagagagaccgtgcagaagttccagagcatccccgcccagagcggccaggccagccccctgctgcagtacttcggcatcctgctggaccagggccagctgaacaagctggagagcctggagctgtgccacctggtgctgcagcagggcagaaagcagctgctggagaagtggctgaaggaggacaagctggagtgcagcgaggagctgggcgacctggtgaagaccaccgaccccatgctggccctgagcgtgtacctgagagccaacgtgcccagcaaggtgatccagtgcttcgccgagaccggccagttccagaagatcgtgctgtacgccaagaaggtgggctacacccccgactggatcttcctgctgagaggcgtgatgaagatcagccccgagcagggcctgcagttcagcagaatgctggtgcaggacgaggagcccctggccaacatcagccagatcgtggacatcttcatggagaacagcctgatccagcagtgcaccagcttcctgctggacgccctgaagaacaacagacccgccgagggcctgctgcagacctggctgctggagatgaacctggtgcacgccccccaggtggccgacgccatcctgggcaacaagatgttcacccactacgacagagcccacatcgcccagctgtgcgagaaggccggcctgctgcagcaggccctggagcactacaccgacctgtacgacatcaagagagccgtggtgcacacccacctgctgaaccccgagtggctggtgaacttcttcggcagcctgagcgtggaggacagcgtggagtgcctgcacgccatgctgagcgccaacatcagacagaacctgcagctgtgcgtgcaggtggccagcaagtaccacgagcagctgggcacccaggccctggtggagctgttcgagagcttcaagagctacaagggcctgttctacttcctgggcagcatcgtgaacttcagccaggaccccgacgtgcacctgaagtacatccaggccgcctgcaagaccggccagatcaaggaggtggagagaatctgcagagagagcagctgctacaaccccgagagagtgaagaacttcctgaaggaggccaagctgaccgaccagctgcccctgatcatcgtgtgcgacagattcggcttcgtgcacgacctggtgctgtacctgtacagaaacaacctgcagagatacatcgagatctacgtgcagaaggtgaaccccagcagaacccccgccgtgatcggcggcctgctggacgtggactgcagcgaggaggtgatcaagcacctgatcatggccgtgagaggccagttcagcaccgacgagctggtggccgaggtggagaagagaaacagactgaagctgctgctgccctggctggagagccagatccaggagggctgcgaggagcccgccacccacaacgccctggccaagatctacatcgacagcaacaacagccccgagtgcttcctgagagagaacgcctactacgacagcagcgtggtgggcagatactgcgagaagagagacccccacctggcctgcgtggcctacgagagaggccagtgcgacctggagctgatcaaggtgtgcaacgagaacagcctgttcaagagcgaggccagatacctggtgtgcagaaaggaccccgagctgtgggcccacgtgctggaggagaccaaccccagcagaagacagctgatcgaccaggtggtgcagaccgccctgagcgagaccagagaccccgaggagatcagcgtgaccgtgaaggccttcatgaccgccgacctgcccaacgagctgatcgagctgctggagaagatcgtgctggacaacagcgtgttcagcgagcacagaaacctgcagaacctgctgatcctgaccgccatcaaggccgacagaaccagagtgatggagtacatcagcagactggacaactacgacgccctggacatcgccagcatcgccgtgagcagcgccctgtacgaggaggccttcaccgtgttccacaagttcgacatgaacgccagcgccatccaggtgctgatcgagcacatcggcaacctggacagagcctacgagttcgccgagagatgcaacgagcccgccgtgtggagccagctggcccaggcccagctgcagaaggacctggtgaaggaggccatcaacagctacatcagaggcgacgaccccagcagctacctggaggtggtgcagagcgccagcagaagcaacaactgggaggacctggtgaagttcctgcagatggccagaaagaagggcagagagagctacatcgagaccgagctgatcttcgccctggccaagaccagcagagtgagcgagctggaggacttcatcaacggccccaacaacgcccacatccagcaggtgggcgacagatgctacgaggagggcatgtacgaggccgccaagctgctgtacagcaacgtgagcaacttcgccagactggccagcaccctggtgcacctgggcgagtaccaggccgccgtggacaacagcagaaaggccagcagcaccagaacctggaaggaggtgtgcttcgcctgcatggacggccaggagttcagattcgcccagctgtgcggcctgcacatcgtgatccacgccgacgagctggaggagctgatgtgctactaccaggacagaggctacttcgaggagctgatcctgctgctggaggccgccctgggcctggagagagcccacatgggcatgttcaccgagctggccatcctgtacagcaagttcaagccccagaagatgctggagcacctggagctgttctggagcagagtgaacatccccaaggtgctgagagccgccgagcaggcccacctgtgggccgagctggtgttcctgtacgacaagtacgaggagtacgacaacgccgtgctgaccatgatgagccaccccaccgaggcctggaaggagggccagttcaaggacatcatcaccaaggtggccaacgtggagctgtgctacagagccctgcagttctacctggactacaagcccctgctgatcaacgacctgctgctggtgctgagccccagactggaccacacctggaccgtgagcttcttcagcaaggccggccagctgcccctggtgaagccctacctgagaagcgtgcagagccacaacaacaagagcgtgaacgaggccctgaaccacctgctgaccgaggaggaggactaccagggcctgagagccagcatcgacgcctacgacaacttcgacaacatcagcctggcccagcagctggagaagcaccagctgatggagttcagatgcatcgccgcctacctgtacaagggcaacaactggtgggcccagagcgtggagctgtgcaagaaggaccacctgtacaaggacgccatgcagcacgccgccgagagcagagacgccgagctggcccagaagctgctgcagtggttcctggaggagggcaagagagagtgcttcgccgcctgcctgttcacctgctacgacctgctgagacccgacatggtgctggagctggcctggagacacaacctggtggacctggccatgccctacttcatccaggtgatgagagagtacctgagcaaggtggacaagctggacgccctggagagcctgagaaagcaggaggagcacgtgaccgagcccgcccccctggtgttcgacttcgacggccacgagtag

SEQ ID NO: 77029 - DNA, 4752 bp, Artificial Sequence
  Description of Artificial Sequence: Synthetic coding sequence
atggcccagatcctgcccgtgagattccaggagcacttccagctgcagaacctgggcatcaaccccgccaacatcggcttcagcaccctgaccatggagagcgacaagttcatctgcatcagagagaaggtgggcgagcaggcccaggtgaccatcatcgacatgagcgaccccatggcccccatcagaagacccatcagcgccgagagcgccatcatgaaccccgccagcaaggtgatcgccctgaaggccggcaagaccctgcagatcttcaacatcgagatgaagagcaagatgaaggcccacaccatggccgaggaggtgatcttctggaagtgggtgagcgtgaacaccgtggccctggtgaccgagaccgccgtgtaccactggagcatggagggcgacagccagcccatgaagatgttcgacagacacaccagcctggtgggctgccaggtgatccactacagaaccgacgagtaccagaagtggctgctgctggtgggcatcagcgcccagcagaacagagtggtgggcgccatgcagctgtacagcgtggacagaaaggtgagccagcccatcgagggccacgccgccgccttcgccgagttcaagatggagggcaacgccaagcccgccaccctgttctgcttcgccgtgagaaaccccaccggcggcaagctgcacatcatcgaggtgggccagcccgccgccggcaaccagcccttcgtgaagaaggccgtggacgtgttcttcccccccgaggcccagaacgacttccccgtggccatgcagatcggcgccaagcacggcgtgatctacctgatcaccaagtacggctacctgcacctgtacgacctggagagcggcgtgtgcatctgcatgaacagaatcagcgccgacaccatcttcgtgaccgccccccacaagcccaccagcggcatcatcggcgtgaacaagaagggccaggtgctgagcgtgtgcgtggaggaggacaacatcgtgaactacgccaccaacgtgctgcagaaccccgacctgggcctgagactggccgtgagaagcaacctggccggcgccgagaagctgttcgtgagaaagttcaacaccctgttcgcccagggcagctacgccgaggccgccaaggtggccgccagcgcccccaagggcatcctgagaaccagagagaccgtgcagaagttccagagcatccccgcccagagcggccaggccagccccctgctgcagtacttcggcatcctgctggaccagggccagctgaacaagctggagagcctggagctgtgccacctggtgctgcagcagggcagaaagcagctgctggagaagtggctgaaggaggacaagctggagtgcagcgaggagctgggcgacctggtgaagaccaccgaccccatgctggccctgagcgtgtacctgagagccaacgtgcccagcaaggtgatccagtgcttcgccgagaccggccagttccagaagatcgtgctgtacgccaagaaggtgggctacacccccgactggatcttcctgctgagaggcgtgatgaagatcagccccgagcagggcctgcagttcagcagaatgctggtgcaggacgaggagcccctggccaacatcagccagatcgtggacatcttcatggagaacagcctgatccagcagtgcaccagcttcctgctggacgccctgaagaacaacagacccgccgagggcctgctgcagacctggctgctggagatgaacctggtgcacgccccccaggtggccgacgccatcctgggcaacaagatgttcacccactacgacagagcccacatcgcccagctgtgcgagaaggccggcctgctgcagcaggccctggagcactacaccgacctgtacgacatcaagagagccgtggtgcacacccacctgctgaaccccgagtggctggtgaacttcttcggcagcctgagcgtggaggacagcgtggagtgcctgcacgccatgctgagcgccaacatcagacagaacctgcagctgtgcgtgcaggtggccagcaagtaccacgagcagctgggcacccaggccctggtggagctgttcgagagcttcaagagctacaagggcctgttctacttcctgggcagcatcgtgaacttcagccaggaccccgacgtgcacctgaagtacatccaggccgcctgcaagaccggccagatcaaggaggtggagagaatctgcagagagagcagctgctacaaccccgagagagtgaagaacttcctgaaggaggccaagctgaccgaccagctgcccctgatcatcgtgtgcgacagattcggcttcgtgcacgacctggtgctgtacctgtacagaaacaacctgcagagatacatcgagatctacgtgcagaaggtgaaccccagcagaacccccgccgtgatcggcggcctgctggacgtggactgcagcgaggaggtgatcaagcacctgatcatggccgtgagaggccagttcagcaccgacgagctggtggccgaggtggagaagagaaacagactgaagctgctgctgccctggctggagagccagatccaggagggctgcgaggagcccgccacccacaacgccctggccaagatctacatcgacagcaacaacagccccgagtgcttcctgagagagaacgcctactacgacagcagcgtggtgggcagatactgcgagaagagagacccccacctggcctgcgtggcctacgagagaggccagtgcgacctggagctgatcaaggtgtgcaacgagaacagcctgttcaagagcgaggccagatacctggtgtgcagaaaggaccccgagctgtgggcccacgtgctggaggagaccaaccccagcagaagacagctgatcgaccaggtggtgcagaccgccctgagcgagaccagagaccccgaggagatcagcgtgaccgtgaaggccttcatgaccgccgacctgcccaacgagctgatcgagctgctggagaagatcgtgctggacaacagcgtgttcagcgagcacagaaacctgcagaacctgctgatcctgaccgccatcaaggccgacagaaccagagtgatggagtacatcagcagactggacaactacgacgccctggacatcgccagcatcgccgtgagcagcgccctgtacgaggaggccttcaccgtgttccacaagttcgacatgaacgccagcgccatccaggtgctgatcgagcacatcggcaacctggacagagcctacgagttcgccgagagatgcaacgagcccgccgtgtggagccagctggcccaggcccagctgcagaaggacctggtgaaggaggccatcaacagctacatcagaggcgacgaccccagcagctacctggaggtggtgcagagcgccagcagaagcaacaactgggaggacctggtgaagttcctgcagatggccagaaagaagggcagagagagctacatcgagaccgagctgatcttcgccctggccaagaccagcagagtgagcgagctggaggacttcatcaacggccccaacaacgcccacatccagcaggtgggcgacagatgctacgaggagggcatgtacgaggccgccaagctgctgtacagcaacgtgagcaacttcgccagactggccagcaccctggtgcacctgggcgagtaccaggccgccgtggacaacagcagaaaggccagcagcaccagaacctggaaggaggtgtgcttcgcctgcatggacggccaggagttcagattcgcccagctgtgcggcctgcacatcgtgatccacgccgacgagctggaggagctgatgtgctactaccaggacagaggctacttcgaggagctgatcctgctgctggaggccgccctgggcctggagagagcccacatgggcatgttcaccgagctggccatcctgtacagcaagttcaagccccagaagatgctggagcacctggagctgttctggagcagagtgaacatccccaaggtgctgagagccgccgagcaggcccacctgtgggccgagctggtgttcctgtacgacaagtacgaggagtacgacaacgccgtgctgaccatgatgagccaccccaccgaggcctggaaggagggccagttcaaggacatcatcaccaaggtggccaacgtggagctgtgctacagagccctgcagttctacctggactacaagcccctgctgatcaacgacctgctgctggtgctgagccccagactggaccacacctggaccgtgagcttcttcagcaaggccggccagctgcccctggtgaagccctacctgagaagcgtgcagagccacaacaacaagagcgtgaacgaggccctgaaccacctgctgaccgaggaggaggactaccaggacgccatgcagcacgccgccgagagcagagacgccgagctggcccagaagctgctgcagtggttcctggaggagggcaagagagagtgcttcgccgcctgcctgttcacctgctacgacctgctgagacccgacatggtgctggagctggcctggagacacaacctggtggacctggccatgccctacttcatccaggtgatgagagagtacctgagcaaggtggacaagctggacgccctggagagcctgagaaagcaggaggagcacgtgaccgagcccgcccccctggtgttcgacttcgacggccacgagtag

SEQ ID NO: 77030 - DNA, 4923 bp, Artificial Sequence; identical to SEQ ID NO: 77028
  Description of Artificial Sequence: Synthetic coding sequence

SEQ ID NO: 77031 - DNA, 747 bp, Artificial Sequence
  Description of Artificial Sequence: Synthetic coding sequence
atggccgagctggaccccttcggcgcccccgccggcgcccccggcggccccgccctgggcaacggcgtggccggcgccggcgaggaggaccccgccgccgccttcctggcccagcaggagagcgagatcgccggcatcgagaacgacgaggccttcgccatcctggacggcggcgcccccggcccccagccccacggcgagccccccggcggccccgacgccgtggacggcgtgatgaacggcgagtactaccaggagagcaacggccccaccgacagctacgccgccatcagccaggtggacagactgcagagcgagcccgagagcatcagaaagtggagagaggagcagatggagagactggaggccctggacgccaacagcagaaagcaggaggccgagtggaaggagaaggccatcaaggagctggaggagtggtacgccagacaggacgagcagctgcagaagaccaaggccaacaacagagtggccgacgaggccttctacaagcagcccttcgccgacgtgatcggctacgtgaccaacatcaaccacccctgctacagcctggagcaggccgccgaggaggccttcgtgaacgacatcgacgagagcagccccggcaccgagtgggagagagtggccagactgtgcgacttcaaccccaagagcagcaagcaggccaaggacgtgagcagaatgagaagcgtgctgatcagcctgaagcaggcccccctggtgcactag

SEQ ID NO: 77032 - DNA, 657 bp, Artificial Sequence
  Description of Artificial Sequence: Synthetic coding sequence
atggccgagctggaccccttcggcgcccccgccggcgcccccggcggccccgccctgggcaacggcgtggccggcgccggcgaggaggaccccgccgccgccttcctggcccagcaggagagcgagatcgccggcatcgagaacgacgaggccttcgccatcctggacggcggcgcccccggcccccagccccacggcgagccccccggcggccccgacgccgtggacggcgtgatgaacggcgagtactaccaggagagcaacggccccaccgacagctacgccgccatcagccaggtggacagactgcagagcgagcccgagagcatcagaaagtggagagaggagcagatggagagactggaggccctggacgccaacagcagaaagcaggaggccgagtggaaggagaaggccatcaaggagctggaggagtggtacgccagacaggacgagcagctgcagaagaccaaggccaacaacagagccgccgaggaggccttcgtgaacgacatcgacgagagcagccccggcaccgagtgggagagagtggccagactgtgcgacttcaaccccaagagcagcaagcaggccaaggacgtgagcagaatgagaagcgtgctgatcagcctgaagcaggcccccctggtgcactag

SEQ ID NO: 77033 - DNA, 711 bp, Artificial Sequence
  Description of Artificial Sequence: Synthetic coding sequence
atggccgagctggaccccttcggcgcccccgccggcgcccccggcggccccgccctgggcaacggcgtggccggcgccggcgaggaggaccccgccgccgccttcctggcccagcaggagagcgagatcgccggcatcgagaacgacgaggccttcgccatcctggacggcggcgcccccggcccccagccccacggcgagccccccggcggccccgacgccgtggacggcgtgatgaacggcgagtactaccaggagagcaacggccccaccgacagctacgccgccatcagccaggtggacagactgcagagcgagcccgagagcatcagaaagtggagagaggagcagatggagagactggaggccctggacgccaacagcagaaagcaggaggccgagtggaaggagaaggccatcaaggagctggaggagtggtacgccagacaggacgagcagctgcagaagaccaaggccaacaacagagtggccgacgaggccttctacaagcagcccttcgccgacgtgatcggctacgtggccgccgaggaggccttcgtgaacgacatcgacgagagcagccccggcaccgagtgggagagagtggccagactgtgcgacttcaaccccaagagcagcaagcaggccaaggacgtgagcagaatgagaagcgtgctgatcagcctgaagcaggcccccctggtgcactag

SEQ ID NO: 77034 - DNA, 747 bp, Artificial Sequence; identical to SEQ ID NO: 77031
  Description of Artificial Sequence: Synthetic coding sequence

SEQ ID NO: 77035 - DNA, 693 bp, Artificial Sequence
  Description of Artificial Sequence: Synthetic coding sequence
atggccgagctggaccccttcggcgcccccgccggcgcccccggcggccccgccctgggcaacggcgtggccggcgccggcgaggaggaccccgccgccgccttcctggcccagcaggagagcgagatcgccggcatcgagaacgacgaggccttcgccatcctggacggcggcgcccccggcccccagccccacggcgagccccccggcggccccgacgccgtggacggcgtgatgaacggcgagtactaccaggagagcaacggccccaccgacagctacgccgccatcagccaggtggacagactgcagagcgagcccgagagcatcagaaagtggagagaggagcagatggagagactggaggccctggacgccaacagcagaaagcaggaggccgagtggaaggagaaggccatcaaggagctggaggagtggtacgccagacaggacgagcagctgcagaagaccaaggccaacaacagcaccaacatcaaccacccctgctacagcctggagcaggccgccgaggaggccttcgtgaacgacatcgacgagagcagccccggcaccgagtgggagagagtggccagactgtgcgacttcaaccccaagagcagcaagcaggccaaggacgtgagcagaatgagaagcgtgctgatcagcctgaagcaggcccccctggtgcactag

SEQ ID NO: 77036 - DNA, 693 bp, Artificial Sequence; identical to SEQ ID NO: 77035
  Description of Artificial Sequence: Synthetic coding sequence

SEQ ID NO: 77037 - DNA, 501 bp, Artificial Sequence
  Description of Artificial Sequence: Synthetic coding sequence
atggccgagctggaccccttcggcgcccccgccggcgcccccggcggccccgccctgggcaacggcgtggccggcgccggcgaggaggaccccgccgccgccttcctggcccagcaggagagcgagatcgccggcatcgagaacgacgaggccttcgccatcctggacggcggcgcccccggcccccagccccacggcgagccccccggcggccccgacgccaacagcagaaagcaggaggccgagtggaaggagaaggccatcaaggagctggaggagtggtacgccagacaggacgagcagctgcagaagaccaaggccaacaacagagccgccgaggaggccttcgtgaacgacatcgacgagagcagccccggcaccgagtgggagagagtggccagactgtgcgacttcaaccccaagagcagcaagcaggccaaggacgtgagcagaatgagaagcgtgctgatcagcctgaagcaggcccccctggtgcactag

SEQ ID NO: 77038 - DNA, 690 bp, Artificial Sequence
  Description of Artificial Sequence: Synthetic coding sequence
atggccgacgacttcggcttcttcagcagcagcgagagcggcgcccccgaggccgccgaggaggaccccgccgccgccttcctggcccagcaggagagcgagatcgccggcatcgagaacgacgagggcttcggcgcccccgccggcagccacgccgcccccgcccagcccggccccaccagcggcgccggcagcgaggacatgggcaccaccgtgaacggcgacgtgttccaggaggccaacggccccgccgacggctacgccgccatcgcccaggccgacagactgacccaggagcccgagagcatcagaaagtggagagaggagcagagaaagagactgcaggagctggacgccgccagcaaggtgaccgagcaggagtggagagagaaggccaagaaggacctggaggagtggaaccagagacagagcgagcaggtggagaagaacaagatcaacaacagaatcgccgacaaggccttctaccagcagcccgacgccgacatcatcggctacgtggccagcgaggaggccttcgtgaaggagagcaaggaggagacccccggcaccgagtgggagaaggtggcccagctgtgcgacttcaaccccaagagcagcaagcagtgcaaggacgtgagcagactgagaagcgtgctgatgagcctgaagcagacccccctgagcagatag

SEQ ID NO: 77039 - DNA, 636 bp, Artificial Sequence
  Description of Artificial Sequence: Synthetic coding sequence
atggccgacgacttcggcttcttcagcagcagcgagagcggcgcccccgaggccgccgaggaggaccccgccgccgccttcctggcccagcaggagagcgagatcgccggcatcgagaacgacgagggcttcggcgcccccgccggcagccacgccgcccccgcccagcccggccccaccagcggcgccggcagcgaggacatgggcaccaccgtgaacggcgacgtgttccaggaggccaacggccccgccgacggctacgccgccatcgcccaggccgacagactgacccaggagcccgagagcatcagaaagtggagagaggagcagagaaagagactgcaggagctggacgccgccagcaaggtgaccgagcaggagtggagagagaaggccaagaaggacctggaggagtggaaccagagacagagcgagcaggtggagaagaacaagatcaacaacagagccagcgaggaggccttcgtgaaggagagcaaggaggagacccccggcaccgagtgggagaaggtggcccagctgtgcgacttcaaccccaagagcagcaagcagtgcaaggacgtgagcagactgagaagcgtgctgatgagcctgaagcagacccccctgagcagatag

SEQ ID NO: 77040 - DNA, 405 bp, Artificial Sequence
  Description of Artificial Sequence: Synthetic coding sequence
atggccgacgacttcggcttcttcagcagcagcgagagcggcgcccccgaggccgccgaggaggaccccgccgccgccttcctggcccagcaggagagcgagatcgccggcatcgagaacgacgagggcttcggcgcccccgccggcagccacgccgcccccgcccagcccggccccaccagcggcgccggcagcgaggacatgggcaccaccgtgaacggcgacgtgttccagcccgtgcaccaccagagagtgcagctgcagacccagctgcccatccagcccaaggacgagcccgcccacaactacagcagcagcatctggcacagccagggccagggccagaagggccccgccggcctgagactgcccaccagcgcccagatcctgagccccttcccctag

SEQ ID NO: 77041 - DNA, 636 bp, Artificial Sequence
  Description of Artificial Sequence: Synthetic coding sequence
atggccaacgccggcctgcagctgctgggcttcatcctggccttcctgggctggatcggcgccatcgtgagcaccgccctgccccagtggagaatctacagctacgccggcgacaacatcgtgaccgcccaggccatgtacgagggcctgtggatgagctgcgtgagccagagcaccggccagatccagtgcaaggtgttcgacagcctgctgaacctgagcagcaccctgcaggccaccagagccctgatggtggtgggcatcctgctgggcgtgatcgccatcttcgtggccaccgtgggcatgaagtgcatgaagtgcctggaggacgacgaggtgcagaagatgagaatggccgtgatcggcggcgccatcttcctgctggccggcctggccatcctggtggccaccgcctggtacggcaacagaatcgtgcaggagttctacgaccccatgacccccgtgaacgccagatacgagttcggccaggccctgttcaccggctgggccgccgccagcctgtgcctgctgggcggcgccctgctgtgctgcagctgccccagaaagaccaccagctaccccacccccagaccctaccccaagcccgcccccagcagcggcaaggactacgtgtag

SEQ ID NO: 77042 - DNA, 501 bp, Artificial Sequence
  Description of Artificial Sequence: Synthetic coding sequence
atgtacgagggcctgtggatgagctgcgtgagccagagcaccggccagatccagtgcaaggtgttcgacagcctgctgaacctgagcagcaccctgcaggccaccagagccctgatggtggtgggcatcctgctgggcgtgatcgccatcttcgtggccaccgtgggcatgaagtgcatgaagtgcctggaggacgacgaggtgcagaagatgagaatggccgtgatcggcggcgccatcttcctgctggccggcctggccatcctggtggccaccgcctggtacggcaacagaatcgtgcaggagttctacgaccccatgacccccgtgaacgccagatacgagttcggccaggccctgttcaccggctgggccgccgccagcctgtgcctgctgggcggcgccctgctgtgctgcagctgccccagaaagaccaccagctaccccacccccagaccctaccccaagcccgcccccagcagcggcaaggactacgtgtag

SEQ ID NO: 77043 - DNA, 624 bp, Artificial Sequence
  Description of Artificial Sequence: Synthetic coding sequence
atggtggccacctgcctgcaggtggtgggcttcgtgaccagcttcgtgggctggatcggcgtgatcgtgaccaccagcaccaacgactgggtggtgacctgcggctacaccatccccacctgcagaaagctggacgagctgggcagcaagggcctgtgggccgactgcgtgatggccaccggcctgtaccactgcaagcccctggtggacatcctgatcctgcccggctacgtgcaggcctgcagagccctgatgatcgccgccagcgtgctgggcctgcccgccatcctgctgctgctgaccgtgctgccctgcatcagaatgggccaggagcccggcgtggccaagtacagaagagcccagctggccggcgtgctgctgatcctgctggccctgtgcgccctggtggccaccatctggttccccgtgtgcgcccacagagagaccaccatcgtgagcttcggctacagcctgtacgccggctggatcggcgccgtgctgtgcctggtgggcggctgcgtgatcctgtgctgcgccggcgacgcccaggccttcggcgagaacagattctactacaccgccggcagcagcagccccacccacgccaagagcgcccacgtgtag

SEQ ID NO: 77044 - DNA, 498 bp, Artificial Sequence
  Description of Artificial Sequence: Synthetic coding sequence
atggtggccacctgcctgcaggtggtgggcttcgtgaccagcttcgtgggctggatcggcgtgatcgtgaccaccagcaccaacgactgggtggtgacctgcggctacaccatccccacctgcagaaagctggacgagctgggcagcaagggcctgtgggccgactgcgtgatggccaccggcctgtaccactgcaagcccctggtggacatcctgatcctgcccggctacgtgcaggcctgcagagccctgatgatcgccgccagcgtgctgggcctgcccgccatcctgctgctgctgaccgtgctgccctgcatcagaatgggccaggagcccggcgtggccaagtacagaagagcccagctggccggcgtgctgctgatcctgctgggctgccagctgctgtgggccaagaccgagagcagcctgcacagccagcacctggtgcagttcaagcagaagtacctggaggacttcagctacctgcagggcgactag

SEQ ID NO: 77045 - DNA, 498 bp, Artificial Sequence; identical to SEQ ID NO: 77044
  Description of Artificial Sequence: Synthetic coding sequence

SEQ ID NO: 77046 - DNA, 720 bp, Artificial Sequence
  Description of Artificial Sequence: Synthetic coding sequence
atggccagcaccgccgtgcagctgctgggcttcctgctgagcttcctgggcatggtgggcaccctgatcaccaccatcctgccccactggagaagaaccgcccacgtgggcaccaacatcctgaccgccgtgagctacctgaagggcctgtggatggagtgcgtgtggcacagcaccggcatctaccagtgccagatctacagaagcctgctggccctgccccaggacctgcaggccgccagagccctgatggtgatcagctgcctgctgagcggcatcgcctgcgcctgcgccgtgatcggcatgaagtgcaccagatgcgccaagggcacccccgccaagaccaccttcgccatcctgggcggcaccctgttcatcctggccggcctgctgtgcatggtggccgtgagctggaccaccaacgacgtggtgcagaacttctacaaccccctgctgcccagcggcatgaagttcgagatcggccaggccctgtacctgggcttcatcagcagcagcctgagcctgatcggcggcaccctgctgtgcctgagctgccaggacgaggccccctacagaccctaccaggccccccccagagccaccaccaccaccgccaacaccgcccccgcctaccagccccccgccgcctacaaggacaacagagcccccagcgtgaccagcgccacccacagcggctacagactgaacgactacgtgtag

SEQ ID NO: 77047 - DNA, 720 bp, Artificial Sequence; identical to SEQ ID NO: 77046
  Description of Artificial Sequence: Synthetic coding sequence

SEQ ID NO: 77048 - DNA, 720 bp, Artificial Sequence; identical to SEQ ID NO: 77046
  Description of Artificial Sequence: Synthetic coding sequence

SEQ ID NO: 77049 - DNA, 720 bp, Artificial Sequence; identical to SEQ ID NO: 77046
  Description of Artificial Sequence: Synthetic coding sequence

SEQ ID NO: 77050 - DNA, 720 bp, Artificial Sequence; identical to SEQ ID NO: 77046
  Description of Artificial Sequence: Synthetic coding sequence

SEQ ID NO: 77051 - DNA, 918 bp, Artificial Sequence
  Description of Artificial Sequence: Synthetic coding sequence
atgaccagcagaacccccctgctggtgaccgcctgcctgtactacagctactgcaacagcagacacctgcagcagggcgtgagaaagagcaagagacccgtgttcagccactgccaggtgcccgagacccagaagaccgacaccagacacctgagcggcgccagagccggcgtgtgcccctgctgccaccccgacggcctgctggccaccatgagagacctgctgcagtacatcgcctgcttcttcgccttcttcagcgccggcttcctgatcgtggccacctggaccgactgctggatggtgaacgccgacgacagcctggaggtgagcaccaagtgcagaggcctgtggtgggagtgcgtgaccaacgccttcgacggcatcagaacctgcgacgagtacgacagcatcctggccgagcaccccctgaagctggtggtgaccagagccctgatgatcaccgccgacatcctggccggcttcggcttcctgaccctgctgctgggcctggactgcgtgaagttcctgcccgacgagccctacatcaaggtgagaatctgcttcgtggccggcgccaccctgctgatcgccggcacccccggcatcatcggcagcgtgtggtacgccgtggacgtgtacgtggagagaagcaccctggtgctgcacaacatcttcctgggcatccagtacaagttcggctggagctgctggctgggcatggccggcagcctgggctgcttcctggccggcgccgtgctgacctgctgcctgtacctgttcaaggacgtgggccccgagagaaactacccctacagcctgagaaaggcctacagcgccgccggcgtgagcatggccaagagctacagcgcccccagaaccgagaccgccaagatgtacgccgtggacaccagagtgtag

SEQ ID NO: 77052 - DNA, 360 bp, Artificial Sequence
  Description of Artificial Sequence: Synthetic coding sequence
atgaccagcagaacccccctgctggtgaccgcctgcctgtactacagctactgcaacagcagacacctgcagcagggcgtgagaaagagcaagagacccgtgttcagccactgccaggtgcccgagacccagaagaccgacaccagacacctgagcggcgccagagccggcgtgtgcccctgctgccaccccgacggcctgctggccaccatgagagacctgctgcagtacatcgcctgcttcttcgccttcttcagcgccggcttcctgatcgtggccacctggaccgactgctggatggtgaacgccgacgacagcctggagatgctggacctgagagagaccatcctgatcccctag

SEQ ID NO: 77053 - DNA, 675 bp, Artificial Sequence
  Description of Artificial Sequence: Synthetic coding sequence
atggccaacagcggcctgcagctgctgggctacttcctggccctgggcggctgggtgggcatcatcgccagcaccgccctgccccagtggaagcagagcagctacgccggcgacgccatcatcaccgccgtgggcctgtacgagggcctgtggatgagctgcgccagccagagcaccggccaggtgcagtgcaagctgtacgacagcctgctggccctggacggccacatccagagcgccagagccctgatggtggtggccgtgctgctgggcttcgtggccatggtgctgagcgtggtgggcatgaagtgcaccagagtgggcgacagcaaccccatcgccaagggcagagtggccatcgccggcggcgccctgttcatcctggccggcctgtgcaccctgaccgccgtgagctggtacgccaccctggtgacccaggagttcttcaaccccagcacccccgtgaacgccagatacgagttcggccccgccctgttcgtgggctgggccagcgccggcctggccgtgctgggcggcagcttcctgtgctgcacctgccccgagcccgagagacccaacagcagcccccagccctacagacccggccccagcgccgccgccagagagcccgtggtgaagctgcccgccagcgccaagggccccctgggcgtgtag

SEQ ID NO: 77054 - DNA, 636 bp, Artificial Sequence
  Description of Artificial Sequence: Synthetic coding sequence
atggccaacagcggcctgcagctgctgggctacttcctggccctgggcggctgggtgggcatcatcgccagcaccgccctgccccagtggaagcagagcagctacgccggcgacgccatcatcaccgccgtgggcctgtacgagggcctgtggatgagctgcgccagccagagcaccggccaggtgcagtgcaagctgtacgacagcctgctggccctggacggccacatccagagcgccagagccctgatggtggtggccgtgctgctgggcttcgtggccatggtgctgagcgtggtgggcatgaagtgcaccagagtgggcgacagcaaccccatcgccaagggcagagtggccatcgccggcggcgccctgttcatcctggccggcctgtgcaccctgaccgccgtgagctggtacgccaccctggtgacccaggagttcttcaaccccagcacccccgtgaacgccagatacgagttcggccccgccctgttcgtgggctgggccagcgccggcctggccgtgctgggcggcagcttcctgtgctgcacctgccccgagcccgagagacccaacagcagcccccagccctacagacccggccccagcgccgccgccagagagtacgtgtag

SEQ ID NO: 77055 - DNA, 657 bp, Artificial Sequence
  Description of Artificial Sequence: Synthetic coding sequence
atggccaacagcggcctgcagctgctgggctacttcctggccctgggcggctgggtgggcatcatcgccagcaccgccctgccccagtggaagcagagcagctacgccggcgacgccatcatcaccgccgtgggcctgtacgagggcctgtggatgagctgcgccagccagagcaccggccaggtgcagtgcaagctgtacgacagcctgctggccctggacggccacatccagagcgccagagccctgatggtggtggccgtgctgctgggcttcgtggccatggtgctgagcgtggtgggcatgaagtgcaccagagtgggcgacagcaaccccatcgccaagggcagagtggccatcgccggcggcgccctgttcatcctggccggcatgaacctggcccagccctgcagctgggccggcccccagctggcctggccctgctgggccgcccccagcagcgccgcccacgccagaagccagagagaccccaccgccgcccacagccccatcggcctggaccccctgctgctgcccgagagcaccagcgagctgagactgccctggcccgccccccaccccgtggcccccctgcccagcatccagcccgccagccagcaccccggccagggccactggggcatcggctgggcctag

SEQ ID NO: 77056 - DNA, 663 bp, Artificial Sequence
  Description of Artificial Sequence: Synthetic coding sequence
atgagcatgggcctggagatcaccggcaccgccctggccgtgctgggctggctgggcaccatcgtgtgctgcgccctgcccatgtggagagtgagcgccttcatcggcagcaacatcatcaccagccagaacatctgggagggcctgtggatgaactgcgtggtgcagagcaccggccagatgcagtgcaaggtgtacgacagcctgctggccctgccccaggacctgcaggccgccagagccctgatcgtggtggccatcctgctggccgccttcggcctgctggtggccctggtgggcgcccagtgcaccaactgcgtgcaggacgacaccgccaaggccaagatcaccatcgtggccggcgtgctgttcctgctggccgccctgctgaccctggtgcccgtgagctggagcgccaacaccatcatcagagacttctacaaccccgtggtgcccgaggcccagaagagagagatgggcgccggcctgtacgtgggctgggccgccgccgccctgcagctgctgggcggcgccctgctgtgctgcagctgcccccccagagagaagaagtacaccgccaccaaggtggtgtacagcgcccccagaagcaccggccccggcgccagcctgggcaccggctacgacagaaaggactacgtgtag

SEQ ID NO: 77057 - DNA, 630 bp, Artificial Sequence
  Description of Artificial Sequence: Synthetic coding sequence
atggccagcatgggcctgcaggtgatgggcatcgccctggccgtgctgggctggctggccgtgatgctgtgctgcgccctgcccatgtggagagtgaccgccttcatcggcagcaacatcgtgaccagccagaccatctgggagggcctgtggatgaactgcgtggtgcagagcaccggccagatgcagtgcaaggtgtacgacagcctgctggccctgccccaggacctgcaggccgccagagccctggtgatcatcagcatcatcgtggccgccctgggcgtgctgctgagcgtggtgggcggcaagtgcaccaactgcctggaggacgagagcgccaaggccaagaccatgatcgtggccggcgtggtgttcctgctggccggcctgatggtgatcgtgcccgtgagctggaccgcccacaacatcatccaggacttctacaaccccctggtggccagcggccagaagagagagatgggcgccagcctgtacgtgggctgggccgccagcggcctgctgctgctgggcggcggcctgctgtgctgcaactgcccccccagaaccgacaagccctacagcgccaagtacagcgccgccagaagcgccgccgccagcaactacgtgtag

SEQ ID NO: 77058 - DNA, 630 bp, Artificial Sequence; identical to SEQ ID NO: 77057
  Description of Artificial Sequence: Synthetic coding sequence

SEQ ID NO: 77059 - DNA, 630 bp, Artificial Sequence; identical to SEQ ID NO: 77057
  Description of Artificial Sequence: Synthetic coding sequence

SEQ ID NO: 77060 - DNA, 591 bp, Artificial Sequence
  Description of Artificial Sequence: Synthetic coding sequence
atggccagcatgggcctgcaggtgatgggcatcgccctggccgtgctgggctggctggccgtgatgctgtgctgcgccctgcccatgtggagagtgaccgccttcatcggcagcaacatcgtgaccagccagagcaccggccagatgcagtgcaaggtgtacgacagcctgctggccctgccccaggacctgcaggccgccagagccctggtgatcatcagcatcatcgtggccgccctgggcgtgctgctgagcgtggtgggcggcaagtgcaccaactgcctggaggacgagagcgccaaggccaagaccatgatcgtggccggcgtggtgttcctgctggccggcctgatggtgatcgtgcccgtgagctggaccgcccacaacatcatccaggacttctacaaccccctggtggccagcggccagaagagagagatgggcgccagcctgtacgtgggctgggccgccagcggcctgctgctgctgggcggcggcctgctgtgctgcaactgcccccccagaaccgacaagccctacagcgccaagtacagcgccgccagaagcgccgccgccagcaactacgtgtag

SEQ ID NO: 77061 - DNA, 912 bp, Artificial Sequence
  Description of Artificial Sequence: Synthetic coding sequence
atgaccagagccagaatcggctgcttcggccccggcggcagagccagaggcaccgagagcgcccccgagcccagcaagagagtgccccccggcagaagctggcagacccaggaggtgagacagaccagaggcgccaacggcctgggccccagagccggcagcgccggcgccaaggcccccggccccgcccagggcgccgcccagcacggcctgggcggcagcgccggcctgagagtgagagtgagccccctggccatgggcagcgccgccctggagatcctgggcctggtgctgtgcctggtgggctggggcggcctgatcctggcctgcggcctgcccatgtggcaggtgaccgccttcctggaccacaacatcgtgaccgcccagaccacctggaagggcctgtggatgagctgcgtggtgcagagcaccggccacatgcagtgcaaggtgtacgacagcgtgctggccctgagcaccgaggtgcaggccgccagagccctgaccgtgagcgccgtgctgctggccttcgtggccctgttcgtgaccctggccggcgcccagtgcaccacctgcgtggcccccggccccgccaaggccagagtggccctgaccggcggcgtgctgtacctgttctgcggcctgctggccctggtgcccctgtgctggttcgccaacatcgtggtgagagagttctacgaccccagcgtgcccgtgagccagaagtacgagctgggcgccgccctgtacatcggctgggccgccaccgccctgctgatggtgggcggctgcctgctgtgctgcggcgcctgggtgtgcaccggcagacccgacctgagcttccccgtgaagtacagcgcccccagaagacccaccgccaccggcgactacgacaagaagaactacgtgtag

SEQ ID NO: 77062 - DNA, 912 bp, Artificial Sequence; identical to SEQ ID NO: 77061
  Description of Artificial Sequence: Synthetic coding sequence

SEQ ID NO: 77063 - DNA, 912 bp, Artificial Sequence; identical to SEQ ID NO: 77061
  Description of Artificial Sequence: Synthetic coding sequence

SEQ ID NO: 77064 - DNA, 1086 bp, Artificial Sequence
  Description of Artificial Sequence: Synthetic coding sequence
atgggcgaggaggccaacgacgacaagaagcccaccaccaagttcgagctggagagagagaccgagctgagattcgaggtggaggccagccagagcgtgcagctggagctgctgaccggcatggccgagatcttcggcaccgagctgaccagaaacaagaagttcaccttcgacgccggcgccaaggtggccgtgttcacctggcacggctgcagcgtgcagctgagcggcagaaccgaggtggcctacgtgagcaaggacacccccatgctgctgtacctgaacacccacaccgccctggagcagatgagaagacaggccgagaaggaggaggagagaggccccagagtgatggtggtgggccccaccgacgtgggcaagagcaccgtgtgcagactgctgctgaactacgccatcaccagcagactggccgacgtgttcaaccagagatgcgaggtgaacagaagagccagcgtgagcggctgcgtgatcaacacctgcggctgggtgaagggcagcggctaccaggccctggtgcacgccgccagcgccttcgaggtggacgtggtggtggtgctggaccaggagagactgtacaacgagctgaagagagacctgccccacttcgtgagaaccgtgctgctgcccaagagcggcggcgtggtggagagaagcaaggacttcagaagagagtgcagagacgagagaatcagagagtacttctacggcttcagaggctgcttctacccccacgccttcaacgtgaagttcagcgacgtgaagatctacaaggtgggcgcccccaccatccccgacagctgcctgcccctgggcatgagccaggaggacaaccagctgaagctggtgcccgtgacccccggcagagacatggtgcaccacctgctgagcgtgagcaccgccgagggcaccgaggagaacctgagcgagaccagcgtggccggcttcatcgtggtgaccagcgtggacctggagcaccaggtgttcaccgtgctgagccccgcccccagacccctgcccaagaacttcctgctgatcatggacatcagattcatggacctgaagtag

SEQ ID NO: 77065 - DNA, 810 bp, Artificial Sequence
  Description of Artificial Sequence: Synthetic coding sequence
atgcaggagatcatcgccagcgtggaccacatcaagttcgacctggagatcgccgtggagcagcagctgggcgcccagcccctgcccttccccggcatggacaagagcggcgccgccgtgtgcgagttcttcctgaaggccgcctgcggcaagggcggcatgtgccccttcagacacatcagcggcgagaagaccgtggtgtgcaagcactggctgagaggcctgtgcaagaagggcgaccagtgcgagttcctgcacgagtacgacatgaccaagatgcccgagtgctacttctacagcaagttcggcgagtgcagcaacaaggagtgccccttcctgcacatcgaccccgagagcaagatcaaggactgcccctggtacgacagaggcttctgcaagcacggccccctgtgcagacacagacacaccagaagagtgatctgcgtgaactacctggtgggcttctgccccgagggccccagctgcaagttcatgcaccccagattcgagctgcccatgggcaccaccgagcagccccccctgccccagcagacccagccccccgccaagcagagcaacaacccccccctgcagagaagcagcagcctgatccagctgaccagccagaacagcagccccaaccagcagagaaccccccaggtgatcggcgtgatgcagagccagaacagcagcgccggcaacagaggccccagacccctggagcaggtgacctgctacaagtgcggcgagaagggccactacgccaacagatgcaccaagggccacctggccttcctgagcggccagtag

SEQ ID NO: 77066 - DNA, 735 bp, Artificial Sequence
  Description of Artificial Sequence: Synthetic coding sequence
atgcaggagatcatcgccagcgtggaccacatcaagttcgacctggagatcgccgtggagcagcagctgggcgcccagcccctgcccttccccggcatggacaagagcggcgccgccgtgtgcgagttcttcctgaaggccgcctgcggcaagggcggcatgtgccccttcagacacatcagcggcgagaagaccgtggtgtgcaagcactggctgagaggcctgtgcaagaagggcgaccagtgcgagttcctgcacgagtacgacatgaccaagatgcccgagtgctacttctacagcaagttcggcgagtgcagcaacaaggagtgccccttcctgcacatcgaccccgagagcaagatcaaggactgcccctggtacgacagaggcttctgcaagcacggccccctgtgcagacacagacacaccagaagagtgatctgcgtgaactacctggtgggcttctgccccgagggccccagctgcaagttcatgcaccccagattcgagctgcccatgggcaccaccgagcagccccccctgccccagcagacccagccccccgccaagcagagaaccccccaggtgatcggcgtgatgcagagccagaacagcagcgccggcaacagaggccccagacccctggagcaggtgacctgctacaagtgcggcgagaagggccactacgccaacagatgcaccaagggccacctggccttcctgagcggccagtag

SEQ ID NO: 77067 - DNA, 636 bp, Artificial Sequence
  Description of Artificial Sequence: Synthetic coding sequence
atgcaggagatcatcgccagcgtggaccacatcaagttcgacctggagatcgccgtggagcagcagctgggcgcccagcccctgcccttccccggcatggacaagagcggcgccgccgtgtgcgagttcttcctgaaggccgcctgcggcaagggcggcatgtgccccttcagacacatcagcggcgagaagaccgtggtgtgcaagcactggctgagaggcctgtgcaagaagggcgaccagtgcgagttcctgcacgagtacgacatgaccaagatgcccgagtgctacttctacagcaagttcggccccctgtgcagacacagacacaccagaagagtgatctgcgtgaactacctggtgggcttctgccccgagggccccagctgcaagttcatgcaccccagattcgagctgcccatgggcaccaccgagcagccccccctgccccagcagacccagccccccgccaagagaaccccccaggtgatcggcgtgatgcagagccagaacagcagcgccggcaacagaggccccagacccctggagcaggtgacctgctacaagtgcggcgagaagggccactacgccaacagatgcaccaagggccacctggccttcctgagcggccagtag

SEQ ID NO: 77068 - DNA, 1767 bp, Artificial Sequence
  Description of Artificial Sequence: Synthetic coding sequence
atggccgacggcgtggaccacatcgacatctacgccgacgtgggcgaggagttcaaccaggaggccgagtacggcggccacgaccagatcgacctgtacgacgacgtgatcagccccagcgccaacaacggcgacgcccccgaggacagagactacatggacaccctgccccccaccgtgggcgacgacgtgggcaagggcgccgcccccaacgtggtgtacacctacaccggcaagagaatcgccctgtacatcggcaacctgacctggtggaccaccgacgaggacctgaccgaggccgtgcacagcctgggcgtgaacgacatcctggagatcaagttcttcgagaacagagccaacggccagagcaagggcttcgccctggtgggcgtgggcagcgaggccagcagcaagaagctgatggacctgctgcccaagagagagctgcacggccagaaccccgtggtgaccccctgcaacaagcagttcctgagccagttcgagatgcagagcagaaagaccacccagagcggccagatgagcggcgagggcaaggccggcccccccggcggcagcagcagagccgccttcccccagggcggcagaggcagaggcagattccccggcgccgtgcccggcggcgacagattccccggccccgccggccccggcggcccccccccccccttccccggcaacctgatcaagcacctggtgaagggcaccagacccctgttcctggagaccagaatcccctggcacatgggccacagcatcgaggagatccccatcttcggcctgaaggccggccagaccccccccagaccccccctgggcccccccggcccccccggcccccccggcccccccccccccggccaggtgctgcccccccccctggccggcccccccaacagaggcgacagaccccccccccccgtgctgttccccggccagcccttcggccagccccccctgggccccctgccccccggcccccccccccccgtgcccggctacggccccccccccggccccccccccccccagcagggccccccccccccccccggccccttcccccccagaccccccggccccctgggcccccccctgaccctggccccccccccccacctgcccggccccccccccggcgcccccccccccgccccccacgtgaaccccgccttcttccccccccccaccaacagcggcatgcccaccagcgacagcagaggccccccccccaccgacccctacggcagaccccccccctacgacagaggcgactacggcccccccggcagagagatggacaccgccagaacccccctgagcgaggccgagttcgaggagatcatgaacagaaacagagccatcagcagcagcgccatcagcagagccgtgagcgacgccagcgccggcgactacggcagcgccatcgagaccctggtgaccgccatcagcctgatcaagcagagcaaggtgagcgccgacgacagatgcaaggtgctgatcagcagcctgcaggactgcctgcacggcatcgagagcaagagctacggcagcggcagcagaagagagagaagcagagagagagaccacagcagaagcagagagaagagcagaagacacaagagcagaagcagagacagacacgacgactactacagagagagaagcagagagagagagagacacagagacagagacagagacagagacagagagagagacagagagagagagtacagacacagatag

SEQ ID NO: 77069 - DNA, 1656 bp, Artificial Sequence
  Description of Artificial Sequence: Synthetic coding sequence
atggccgacggcgtggaccacatcgacatctacgccgacgtgggcgaggagttcaaccaggaggccgagtacggcggccacgaccagatcgacctgtacgacgacgtgatcagccccagcgccaacaacggcgacgcccccgaggacagagactacatggacaccctgccccccaccgtgggcgacgacgtgggcaagggcgccgcccccaacgtggtgtacacctacaccggcaagagaatcgccctgtacatcggcaacctgacctggtggaccaccgacgaggacctgaccgaggccgtgcacagcctgggcgtgaacgacatcctggagatcaagttcttcgagaacagagccaacggccagagcaagggcttcgccctggtgggcgtgggcagcgaggccagcagcaagaagctgatggacctgctgcccaagagagagctgcacggccagaaccccgtggtgaccccctgcaacaagcagttcctgagccagttcgagatgcagagcagaaagaccacccagagcggccagatgagcggcgagggcaaggccggcccccccggcggcagcagcagagccgccttcccccagggcggcagaggcagaggcagattccccggcgccgtgcccggcggcgacagattccccggccccgccggccccggcggcccccccccccccttccccgccggccagaccccccccagaccccccctgggcccccccggcccccccggcccccccggcccccccccccccggccaggtgctgcccccccccctggccggcccccccaacagaggcgacagaccccccccccccgtgctgttccccggccagcccttcggccagccccccctgggccccctgccccccggcccccccccccccgtgcccggctacggccccccccccggccccccccccccccagcagggccccccccccccccccggccccttcccccccagaccccccggccccctgggcccccccctgaccctggccccccccccccacctgcccggccccccccccggcgcccccccccccgccccccacgtgaaccccgccttcttccccccccccaccaacagcggcatgcccaccagcgacagcagaggccccccccccaccgacccctacggcagaccccccccctacgacagaggcgactacggcccccccggcagagagatggacaccgccagaacccccctgagcgaggccgagttcgaggagatcatgaacagaaacagagccatcagcagcagcgccatcagcagagccgtgagcgacgccagcgccggcgactacggcagcgccatcgagaccctggtgaccgccatcagcctgatcaagcagagcaaggtgagcgccgacgacagatgcaaggtgctgatcagcagcctgcaggactgcctgcacggcatcgagagcaagagctacggcagcggcagcagaagagagagaagcagagagagagaccacagcagaagcagagagaagagcagaagacacaagagcagaagcagagacagacacgacgactactacagagagagaagcagagagagagagagacacagagacagagacagagacagagacagagagagagacagagagagagagtacagacacagatag

SEQ ID NO: 77070 - DNA, 1437 bp, Artificial Sequence
  Description of Artificial Sequence: Synthetic coding sequence
atggccgacggcgtggaccacatcgacatctacgccgacgtgggcgaggagttcaaccaggaggccgagtacggcggccacgaccagatcgacctgtacgacgacgtgatcagccccagcgccaacaacggcgacgcccccgaggacagagactacatggacaccctgccccccaccgtgggcgacgacgtgggcaagggcgccgcccccaacgtggtgtacacctacaccggcaagagaatcgccctgtacatcggcaacctgacctggtggaccaccgacgaggacctgaccgaggccgtgcacagcctgggcgtgaacgacatcctggagatcaagttcttcgagaacagagccaacggccagagcaagggcttcgccctggtgggcgtgggcagcgaggccagcagcaagaagctgatggacctgctgcccaagagagagctgcacggccagaaccccgtggtgaccccctgcaacaagcagttcctgagccagttcgagatgcagagcagaaagaccacccagagcggccagatgagcggcgagggcaaggccggcccccccggcgccggcccccccaacagaggcgacagaccccccccccccgtgctgttccccggccagcccttcggccagccccccctgggccccctgccccccggcccccccccccccgtgcccggctacggccccccccccggccccccccccccccagcagggccccccccccccccccggccccttcccccccagaccccccggccccctgggcccccccctgaccctggccccccccccccacctgcccggccccccccccggcgcccccccccccgccccccacgtgaaccccgccttcttccccccccccaccaacagcggcatgcccaccagcgacagcagaggccccccccccaccgacccctacggcagaccccccccctacgacagaggcgactacggcccccccggcagagagatggacaccgccagaacccccctgagcgaggccgagttcgaggagatcatgaacagaaacagagccatcagcagcagcgccatcagcagagccgtgagcgacgccagcgccggcgactacggcagcgccatcgagaccctggtgaccgccatcagcctgatcaagcagagcaaggtgagcgccgacgacagatgcaaggtgctgatcagcagcctgcaggactgcctgcacggcatcgagagcaagagctacggcagcggcagcagaagagagagaagcagagagagagaccacagcagaagcagagagaagagcagaagacacaagagcagaagcagagacagacacgacgactactacagagagagaagcagagagagagagagacacagagacagagacagagacagagacagagagagagacagagagagagagtacagacacagatag

SEQ ID NO: 77071 - DNA, 1851 bp, Artificial Sequence
  Description of Artificial Sequence: Synthetic coding sequence
atgagcagcctggccgtgagagaccccgccatggacagaagcctgagaagcgtgttcgtgggcaacatcccctacgaggccaccgaggagcagctgaaggacatcttcagcgaggtgggcagcgtggtgagcttcagactggtgtacgacagagagaccggcaagcccaagggctacggcttctgcgagtaccaggaccaggagaccgccctgagcgccatgagaaacctgaacggcagagagttcagcggcagagccctgagagtggacaacgccgccagcgagaagaacaaggaggagctgaagagcctgggccccgccgcccccatcatcgacagcccctacggcgaccccatcgaccccgaggacgcccccgagagcatcaccagagccgtggccagcctgccccccgagcagatgttcgagctgatgaagcagatgaagctgtgcgtgcagaacagccaccaggaggccagaaacatgctgctgcagaacccccagctggcctacgccctgctgcaggcccaggtggtgatgagaatcatggaccccgagatcgccctgaagatcctgcacagaaagatccacgtgacccccctgatccccggcaagagccagagcgtgagcgtgagcggccccggccccggccccggccccggcctgtgccccggccccaacgtgctgctgaaccagcagaacccccccgccccccagccccagcacctggccagaagacccgtgaaggacatcccccccctgatgcagacccccatccagggcggcatccccgcccccggccccatccccgccgccgtgcccggcgccggccccggcagcctgacccccggcggcgccatgcagccccagctgggcatgcccggcgtgggccccgtgcccctggagagaggccaggtgcagatgagcgaccccagagcccccatccccagaggccccgtgacccccggcggcctgccccccagaggcctgctgggcgacgcccccaacgaccccagaggcggcaccctgctgagcgtgaccggcgaggtggagcccagaggctacctgggccccccccaccagggcccccccatgcaccacgccagcggccacgacaccagaggccccagcagccacgagatgagaggcggccccctgggcgaccccagactgctgatcggcgagcccagaggccccatgatcgaccagagaggcctgcccatggacggcagaggcggcagagacagcagagccatggagaccagagccatggagaccgaggtgctggagaccagagtgatggagagaagaggcatggagacctgcgccatggagaccagaggcatggaggccagaggcatggacgccagaggcctggagatgagaggccccgtgcccagcagcagaggccccatgaccggcggcatccagggccccggccccatcaacatcggcgccggcggccccccccagggccccagacaggtgcccggcatcagcggcgtgggcaaccccggcgccggcatgcagggcaccggcatccagggcaccggcatgcagggcgccggcatccagggcggcggcatgcagggcgccggcatccagggcgtgagcatccagggcggcggcatccagggcggcggcatccagggcgccagcaagcagggcggcagccagcccagcagcttcagccccggccagagccaggtgaccccccaggaccaggagaaggccgccctgatcatgcaggtgctgcagctgaccgccgaccagatcgccatgctgccccccgagcagagacagagcatcctgatcctgaaggagcagatccagaagagcaccggcgccagctag

SEQ ID NO: 77072 - DNA, 2541 bp, Artificial Sequence
  Description of Artificial Sequence: Synthetic coding sequence
atgctgttcaccgtgagctgcagcaagatgagcagcatcgtggacagagacgacagcagcatcttcgacggcctggtggaggaggacgacaaggacaaggccaagagagtgagcagaaacaagagcgagaagaagagaagagaccagttcaacgtgctgatcaaggagctgggcagcatgctgcccggcaacgccagaaagatggacaagagcaccgtgctgcagaagagcatcgacttcctgagaaagcacaaggagatcaccgcccagagcgacgccagcgagatcagacaggactggaagcccaccttcctgagcaacgaggagttcacccagctgatgctggaggccctggacggcttcttcctggccatcatgaccgacggcagcatcatctacgtgagcgagagcgtgaccagcctgctggagcacctgcccagcgacctggtggaccagagcatcttcaacttcatccccgagggcgagcacagcgaggtgtacaagatcctgagcacccacctgctggagagcgacagcctgacccccgagtacctgaagagcaagaaccagctggagttctgctgccacatgctgagaggcaccatcgaccccaaggagcccagcacctacgagtacgtgaagttcatcggcaacttcaagagcctgaacagcgtgagcagcagcgcccacaacggcttcgagggcaccatccagagaacccacagacccagctacgaggacagagtgtgcttcgtggccaccgtgagactggccaccccccagttcatcaaggagatgtgcaccgtggaggagcccaacgaggagttcaccagcagacacagcctggagtggaagttcctgttcctggaccacagagccccccccatcatcggctacctgcccttcgaggtgctgggcaccagcggctacgactactaccacgtggacgacctggagaacctggccaagtgccacgagcacctgatgcagtacggcaagggcaagagctgctactacagattcctgaccaagggccagcagtggatctggctgcagacccactactacatcacctaccaccagtggaacagcagacccgagttcatcgtgtgcacccacaccgtggtgagctacgccgaggtgagagccgagagaagaagagagctgggcatcgaggagagcctgcccgagaccgccgccgacaagagccaggacagcggcagcgacaacagaatcaacaccgtgagcctgaaggaggccctggagagattcgaccacagccccacccccagcgccagcagcagaagcagcagaaagagcagccacaccgccgtgagcgaccccagcagcacccccaccaagatccccaccgacaccagcaccccccccagacagcacctgcccgcccacgagaagatggtgcagagaagaagcagcttcagcagccagagcatcaacagccagagcgtgggcagcagcctgacccagcccgtgatgagccaggccaccaacctgcccatcccccagggcatgagccagttccagttcagcgcccagctgggcgccatgcagcacctgaaggaccagctggagcagagaaccagaatgatcgaggccaacatccacagacagcaggaggagctgagaaagatccaggagcagctgcagatggtgcacggccagggcctgcagatgttcctgcagcagagcaaccccggcctgaacttcggcagcgtgcagctgagcagcggcaacagcagcaacatccagcagctggcccccatcaacatgcagggccaggtggtgcccaccaaccagatccagagcggcatgaacaccggccacatcggcaccacccagcacatgatccagcagcagaccctgcagagcaccagcacccagagccagcagaacgtgctgagcggccacagccagcagaccagcctgcccagccagacccagagcaccctgaccgcccccctgtacaacaccatggtgatcagccagcccgccgccggcagcatggtgcagatccccagcagcatgccccagaacagcacccagagcgccgccgtgaccaccttcacccaggacagacagatcagattcagccagggccagcagctggtgaccaagctggtgaccgcccccgtggcctgcggcgccgtgatggtgcccagcaccatgctgatgggccaggtggtgaccgcctaccccaccttcgccacccagcagcagcagagccagaccctgagcgtgacccagcagcagcagcagcagagcagccaggagcagcagctgaccagcgtgcagcagcccagccaggcccagctgacccagcccccccagcagttcctgcagaccagcagactgctgcacggcaaccccagcacccagctgatcctgagcgccgccttccccctgcagcagagcaccttcccccagagccaccaccagcagcaccagagccagcagcagcagcagctgagcagacacagaaccgacagcctgcccgaccccagcaaggtgcagccccagtag

SEQ ID NO: 77073 - DNA, 1278 bp, Artificial Sequence
  Description of Artificial Sequence: Synthetic coding sequence
atgggcgaggaggccaacgacgacaagaagcccaccaccaagttcgagctggagagagagaccgagctgagattcgaggtggaggccagccagagcgtgcagctggagctgctgaccggcatggccgagatcttcggcaccgagctgaccagaaacaagaagttcaccttcgacgccggcgccaaggtggccgtgttcacctggcacggctgcagcgtgcagctgagcggcagaaccgaggtggcctacgtgagcaaggacacccccatgctgctgtacctgaacacccacaccgccctggagcagatgagaagacaggccgagaaggaggaggagagaggccccagagtgatggtggtgggccccaccgacgtgggcaagagcaccgtgtgcagactgctgctgaactacgccgtgagactgggcagaagacccacctacgtggagctggacgtgggccagggcagcgtgagcatccccggcaccatgggcgccctgtacatcgagagacccgccgacgtggaggagggcttcagcatccaggcccccctggtgtaccacttcggcagcaccacccccggcaccaacatcaagctgtacaacaagatcaccagcagactggccgacgtgttcaaccagagatgcgaggtgaacagaagagccagcgtgagcggctgcgtgatcaacacctgcggctgggtgaagggcagcggctaccaggccctggtgcacgccgccagcgccttcgaggtggacgtggtggtggtgctggaccaggagagactgtacaacgagctgaagagagacctgccccacttcgtgagaaccgtgctgctgcccaagagcggcggcgtggtggagagaagcaaggacttcagaagagagtgcagagacgagagaatcagagagtacttctacggcttcagaggctgcttctacccccacgccttcaacgtgaagttcagcgacgtgaagatctacaaggtgggcgcccccaccatccccgacagctgcctgcccctgggcatgagccaggaggacaaccagctgaagctggtgcccgtgacccccggcagagacatggtgcaccacctgctgagcgtgagcaccgccgagggcaccgaggagaacctgagcgagaccagcgtggccggcttcatcgtggtgaccagcgtggacctggagcaccaggtgttcaccgtgctgagccccgcccccagacccctgcccaagaacttcctgctgatcatggacatcagattcatggacctgaagtag

SEQ ID NO: 77074 - DNA, 1311 bp, Artificial Sequence
  Description of Artificial Sequence: Synthetic coding sequence
atgaccgacctgcacagcagctacaccgaggagatgggcgaggaggccaacgacgacaagaagcccaccaccaagttcgagctggagagagagaccgagctgagattcgaggtggaggccagccagagcgtgcagctggagctgctgaccggcatggccgagatcttcggcaccgagctgaccagaaacaagaagttcaccttcgacgccggcgccaaggtggccgtgttcacctggcacggctgcagcgtgcagctgagcggcagaaccgaggtggcctacgtgagcaaggacacccccatgctgctgtacctgaacacccacaccgccctggagcagatgagaagacaggccgagaaggaggaggagagaggccccagagtgatggtggtgggccccaccgacgtgggcaagagcaccgtgtgcagactgctgctgaactacgccgtgagactgggcagaagacccacctacgtggagctggacgtgggccagggcagcgtgagcatccccggcaccatgggcgccctgtacatcgagagacccgccgacgtggaggagggcttcagcatccaggcccccctggtgtaccacttcggcagcaccacccccggcaccaacatcaagctgtacaacaagatcaccagcagactggccgacgtgttcaaccagagatgcgaggtgaacagaagagccagcgtgagcggctgcgtgatcaacacctgcggctgggtgaagggcagcggctaccaggccctggtgcacgccgccagcgccttcgaggtggacgtggtggtggtgctggaccaggagagactgtacaacgagctgaagagagacctgccccacttcgtgagaaccgtgctgctgcccaagagcggcggcgtggtggagagaagcaaggacttcagaagagagtgcagagacgagagaatcagagagtacttctacggcttcagaggctgcttctacccccacgccttcaacgtgaagttcagcgacgtgaagatctacaaggtgggcgcccccaccatccccgacagctgcctgcccctgggcatgagccaggaggacaaccagctgaagctggtgcccgtgacccccggcagagacatggtgcaccacctgctgagcgtgagcaccgccgagggcaccgaggagaacctgagcgagaccagcgtggccggcttcatcgtggtgaccagcgtggacctggagcaccaggtgttcaccgtgctgagccccgcccccagacccctgcccaagaacttcctgctgatcatggacatcagattcatggacctgaagtag

SEQ ID NO: 77075 - DNA, 279 bp, Artificial Sequence
  Description of Artificial Sequence: Synthetic coding sequence
atgggcgaggaggccaacgacgacaagaagcccaccaccaagttcgagctggagagagagaccgagctgagattcgaggtggaggccagccagagcgtgcagctggagctgctgaccggcatggccgagatcttcggcaccgagctgaccagaaacaagaagttcaccttcgacgccggcgccaaggtggccgtgttcacctggcacggctgcagcgtgcagctgagcggcagaaccgaggtggcctacgtgagcaaggacacccccatgctgctgtag

SEQ ID NO: 77076 - DNA, 1278 bp, Artificial Sequence; identical to SEQ ID NO: 77073
  Description of Artificial Sequence: Synthetic coding sequence

SEQ ID NO: 77077 - DNA, 399 bp, Artificial Sequence
  Description of Artificial Sequence: Synthetic coding sequence
atgggcgaggaggccaacgacgacaagaagcccaccaccaagttcgagctggagagagagaccgagctgagattcgaggtggaggccagccagagcgtgcagctggagctgctgaccggcatggccgagatcttcggcaccgagctgaccagaaacaagaagttcaccttcgacgccggcgccaaggtggccgtgttcacctggcacggctgcagcgtgcagctgagcggcagaaccgaggtggcctacgtgagcaaggacacccccatgctgctgtacctgaacacccacaccgccctggagcagatgagaagacaggccgagaaggaggaggagagaggccccagagtgatggtggtgggccccaccgacgtgggcaagagcaccgtgtgcagatag

SEQ ID NO: 77078 - DNA, 834 bp, Artificial Sequence
  Description of Artificial Sequence: Synthetic coding sequence
atgtggcccggcatcctggtgggcggcgccagagtggccagctgcagataccccgccctgggccccagactggccgcccacttccccgcccagagacccccccagagaaccctgcagaacggcctggccctgcagagatgcctgcacgccaccgccaccagagccctgcccctgatccccatcgtggtggagcagaccggcagaggcgagagagcctacgacatctacagcagactgctgagagagagaatcgtgtgcgtgatgggccccatcgacgacagcgtggccagcctggtgatcgcccagctgctgttcctgcagagcgagagcaacaagaagcccatccacatgtacatcaacagccccggcggcgtggtgaccgccggcctggccatctacgacaccatgcagtacatcctgaaccccatctgcacctggtgcgtgggccaggccgccagcatgggcagcctgctgctggccgccggcacccccggcatgagacacagcctgcccaacagcagaatcatgatccaccagcccagcggcggcgccagaggccaggccaccgacatcgccatccaggccgaggagatcatgaagctgaagaagcagctgtacaacatctacgccaagcacaccaagcagagcctgcaggtgatcgagagcgccatggagagagacagatacatgagccccatggaggcccaggagttcggcatcctggacaaggtgctggtgcaccccccccaggacggcgaggacgagcccaccctggtgcagaaggagcccgtggaggccgcccccgccgccgagcccgtgcccgccagcacctag

SEQ ID NO: 77079 - DNA, 1617 bp, Artificial Sequence
  Description of Artificial Sequence: Synthetic coding sequence
atgtggagcggcagaagcagcttcaccagcctggtggtgggcgtgttcgtggtgtacgtggtgcacacctgctgggtgatgtacggcatcgtgtacaccagaccctgcagcggcgacgccaactgcatccagccctacctggccagaagacccaagctgcagctgagcgtgtacaccaccaccagaagccacctgggcgccgagaacaacatcgacctggtgctgaacgtggaggacttcgacgtggagagcaagttcgagagaaccgtgaacgtgagcgtgcccaagaagaccagaaacaacggcaccctgtacgcctacatcttcctgcaccacgccggcgtgctgccctggcacgacggcaagcaggtgcacctggtgagccccctgaccacctacatggtgcccaagcccgaggagatcaacctgctgaccggcgagagcgacacccagcagatcgaggccgagaagaagcccaccagcgccctggacgagcccgtgagccactggagacccagactggccctgaacgtgatggccgacaacttcgtgttcgacggcagcagcctgcccgccgacgtgcacagatacatgaagatgatccagctgggcaagaccgtgcactacctgcccatcctgttcatcgaccagctgagcaacagagtgaaggacctgatggtgatcaacagaagcaccaccgagctgcccctgaccgtgagctacgacaaggtgagcctgggcagactgagattctggatccacatgcaggacgccgtgtacagcctgcagcagttcggcttcagcgagaaggacgccgacgaggtgaagggcatcttcgtggacaccaacctgtacttcctggccctgaccttcttcgtggccgccttccacctgctgttcgacttcctggccttcaagaacgacatcagcttctggaagaagaagaagagcatgatcggcatgagcaccaaggccgtgctgtggagatgcttcagcaccgtggtgatcttcctgttcctgctggacgagcagaccagcctgctggtgctggtgcccgccggcgtgggcgccgccatcgagctgtggaaggtgaagaaggccctgaagatgaccatcttctggagaggcctgatgcccgagttccagttcggcacctacagcgagagcgagagaaagaccgaggagtacgacacccaggccatgaagtacctgagctacctgctgtaccccctgtgcgtgggcggcgccgtgtacagcctgctgaacatcaagtacaagagctggtacagctggctgatcaacagcttcgtgaacggcgtgtacgccttcggcttcctgttcatgctgccccagctgttcgtgaactacaagctgaagagcgtggcccacctgccctggaaggccttcacctacaaggccttcaacaccttcatcgacgacgtgttcgccttcatcatcaccatgcccaccagccacagactggcctgcttcagagacgacgtggtgttcctggtgtacctgtaccagagatggctgtaccccgtggacaagagaagagtgaacgagttcggcgagagctacgaggagaaggccaccagagccccccacaccgactag

SEQ ID NO: 77080 - DNA, 1509 bp, Artificial Sequence
  Description of Artificial Sequence: Synthetic coding sequence
atgtggagcggcagaagcagcttcaccagcctggtggtgggcgtgttcgtggtgtacgtggtgcacacctgctgggtgatgtacggcatcgtgtacaccagaccctgcagcggcgacgccaactgcatccagccctacctggccagaagacccaagctgcagctgagcgtgtacaccaccaccagaagccacctgggcgccgagaacaacatcgacctggtgctgaacgtggaggacttcgacgtggagagcaagttcgagagaaccgtgaacgtgagcgtgcccaagaagaccagaaacaacggcaccctgtacgcctacatcttcctgcaccacgccggcgtgctgccctggcacgacggcaagcaggtgcacctggtgagccccctgaccacctacatggtgcccaagcccgaggagatcaacctgctgaccggcgagagcgacacccagcagatcgaggccgagaagaagcccaccagcgccctggacgagcccgtgagccactggagacccagactggccctgaacgtgatggccgacaacttcgtgttcgacggcagcagcctgcccgccgacgtgcacagatacatgaagatgatccagctgggcaagaccgtgcactacctgcccatcctgttcatcgaccagctgagcaacagagtgaaggacctgatggtgatcaacagaagcaccaccgagctgcccctgaccgtgagctacgacaaggtgagcctgggcagactgagattctggatccacatgcaggacgccgtgtacagcctgcagcagttcggcttcagcgagaaggacgccgacgaggtgaagggcatcttcgtggacaccaacctgtacttcctggccctgaccttcttcgtggccgccttccacctgctgttcgacttcctggccttcaagaacgacatcagcttctggaagaagaagaagagcatgatcggcatgagcaccaagctgtggaaggtgaagaaggccctgaagatgaccatcttctggagaggcctgatgcccgagttccagttcggcacctacagcgagagcgagagaaagaccgaggagtacgacacccaggccatgaagtacctgagctacctgctgtaccccctgtgcgtgggcggcgccgtgtacagcctgctgaacatcaagtacaagagctggtacagctggctgatcaacagcttcgtgaacggcgtgtacgccttcggcttcctgttcatgctgccccagctgttcgtgaactacaagctgaagagcgtggcccacctgccctggaaggccttcacctacaaggccttcaacaccttcatcgacgacgtgttcgccttcatcatcaccatgcccaccagccacagactggcctgcttcagagacgacgtggtgttcctggtgtacctgtaccagagatggctgtaccccgtggacaagagaagagtgaacgagttcggcgagagctacgaggagaaggccaccagagccccccacaccgactag

SEQ ID NO: 77081 - DNA, 1350 bp, Artificial Sequence
  Description of Artificial Sequence: Synthetic coding sequence
atgatgaagaccctgctgctgttcgtgggcctgctgctgacctgggagagcggccaggtgctgggcgaccagaccgtgagcgacaacgagctgcaggagatgagcaaccagggcagcaagtacgtgaacaaggagatccagaacgccgtgaacggcgtgaagcagatcaagaccctgatcgagaagaccaacgaggagagaaagaccctgctgagcaacctggaggaggccaagaagaagaaggaggacgccctgaacgagaccagagagagcgagaccaagctgaaggagctgcccggcgtgtgcaacgagaccatgatggccctgtgggaggagtgcaagccctgcctgaagcagacctgcatgaagttctacgccagagtgtgcagaagcggcagcggcctggtgggcagacagctggaggagttcctgaaccagagcagccccttctacttctggatgaacggcgacagaatcgacagcctgctggagaacgacagacagcagacccacatgctggacgtgatgcaggaccacttcagcagagccagcagcatcatcgacgagctgttccaggacagattcttcaccagagagccccaggacacctaccactacctgcccttcagcctgccccacagaagaccccacttcttcttccccaagagcagaatcgtgagaagcctgatgcccttcagcccctacgagcccctgaacttccacgccatgttccagcccttcctggagatgatccacgaggcccagcaggccatggacatccacttccacagccccgccttccagcacccccccaccgagttcatcagagagggcgacgacgacagaaccgtgtgcagagagatcagacacaacagcaccggctgcctgagaatgaaggaccagtgcgacaagtgcagagagatcctgagcgtggactgcagcaccaacaaccccagccaggccaagctgagaagagagctggacgagagcctgcaggtggccgagagactgaccagaaagtacaacgagctgctgaagagctaccagtggaagatgctgaacaccagcagcctgctggagcagctgaacgagcagttcaactgggtgagcagactggccaacctgacccagggcgaggaccagtactacctgagagtgaccaccgtggccagccacaccagcgacagcgacgtgcccagcggcgtgaccgaggtggtggtgaagctgttcgacagcgaccccatcaccgtgaccgtgcccgtggaggtgagcagaaagaaccccaagttcatggagaccgtggccgagaaggccctgcaggagtacagaaagaagcacagagaggagtag

SEQ ID NO: 77082 - DNA, 825 bp, Artificial Sequence
  Description of Artificial Sequence: Synthetic coding sequence
atgcaggaccacttcagcagagccagcagcatcatcgacgagctgttccaggacagattcttcaccagagagccccaggacacctaccactacctgcccttcagcctgccccacagaagaccccacttcttcttccccaagagcagaatcgtgagaagcctgatgcccttcagcccctacgagcccctgaacttccacgccatgttccagcccttcctggagatgatccacgaggcccagcaggccatggacatccacttccacagccccgccttccagcacccccccaccgagttcatcagagagggcgacgacgacagaaccgtgtgcagagagatcagacacaacagcaccggctgcctgagaatgaaggaccagtgcgacaagtgcagagagatcctgagcgtggactgcagcaccaacaaccccagccaggccaagctgagaagagagctggacgagagcctgcaggtggccgagagactgaccagaaagtacaacgagctgctgaagagctaccagtggaagatgctgaacaccagcagcctgctggagcagctgaacgagcagttcaactgggtgagcagactggccaacctgacccagggcgaggaccagtactacctgagagtgaccaccgtggccagccacaccagcgacagcgacgtgcccagcggcgtgaccgaggtggtggtgaagctgttcgacagcgaccccatcaccgtgaccgtgcccgtggaggtgagcagaaagaaccccaagttcatggagaccgtggccgagaaggccctgcaggagtacagaaagaagcacagagaggagtag

SEQ ID NO: 77083 - DNA, 1350 bp, Artificial Sequence; identical to SEQ ID NO: 77081
  Description of Artificial Sequence: Synthetic coding sequence

SEQ ID NO: 77084 - DNA, 615 bp, Artificial Sequence
  Description of Artificial Sequence: Synthetic coding sequence
atgatgaagaccctgctgctgttcgtgggcctgctgctgacctgggagagcggccaggtgctgggcgaccagaccgtgagcgacaacgagctgcaggagatgagcaaccagggcagcaagtacgtgaacaaggagatccagaacgccgtgaacggcgtgaagcagatcaagaccctgatcgagaagaccaacgaggagagaaagaccctgctgagcaacctggaggaggccaagaagaagaaggaggacgccctgaacgagaccagagagagcgagaccaagctgaaggagctgcccggcgtgtgcaacgagaccatgatggccctgtgggaggagtgcaagccctgcctgaagcagacctgcatgaagttctacgccagagtgtgcagaagcggcagcggcctggtgggcagacagctggaggagttcctgaaccagagcagccccttctacttctggatgaacggcgacagaatcgacagcctgctggagaacgacagacagcagacccacatgctggacgtgatgcaggaccacttcagcagagccagcagcatcatcgacgagctgttccaggacagattcttcaccagagagccccaggacacctactag

SEQ ID NO: 77085 - DNA, 1350 bp, Artificial Sequence; identical to SEQ ID NO: 77081
  Description of Artificial Sequence: Synthetic coding sequence

SEQ ID NO: 77086 - DNA, 816 bp, Artificial Sequence
  Description of Artificial Sequence: Synthetic coding sequence
atgatgaagaccctgctgctgttcgtgggcctgctgctgacctgggagagcggccaggtgctgggcgaccagaccgtgagcgacaacgagctgcaggagatgagcaaccagggcagcaagtacgtgaacaaggagatccagaacgccgtgaacggcgtgaagcagatcaagaccctgatcgagaagaccaacgaggagagaaagaccctgctgagcaacctggaggaggccaagaagaagaaggaggacgccctgaacgagaccagagagagcgagaccaagctgaaggagctgcccggcgtgtgcaacgagaccatgatggccctgtgggaggagtgcaagccctgcctgaagcagacctgcatgaagttctacgccagagtgtgcagaagcggcagcggcctggtgggcagacagctggaggagttcctgaaccagagcagccccttctacttctggatgaacggcgacagaatcgacagcctgctggagaacgacagacagcagacccacatgctggacgtgatgcaggaccacttcagcagagccagcagcatcatcgacgagctgttccaggacagcctgatgcccttcagcccctacgagcccctgaacttccacgccatgttccagcccttcctggagatgatccacgaggcccagcaggccatggacatccacttccacagccccgccttccagcacccccccaccgagttcatcagagagggcgacgacgacagaaccgtgtgcagagagatcagacacaacagcaccggctgcctgagaatgaaggaccagtgcgacaagtgctag

SEQ ID NO: 77087 - DNA, 1383 bp, Artificial Sequence
  Description of Artificial Sequence: Synthetic coding sequence
atggaggcctgcaaggacagcagaatcggcggcatgatgaagaccctgctgctgttcgtgggcctgctgctgacctgggagagcggccaggtgctgggcgaccagaccgtgagcgacaacgagctgcaggagatgagcaaccagggcagcaagtacgtgaacaaggagatccagaacgccgtgaacggcgtgaagcagatcaagaccctgatcgagaagaccaacgaggagagaaagaccctgctgagcaacctggaggaggccaagaagaagaaggaggacgccctgaacgagaccagagagagcgagaccaagctgaaggagctgcccggcgtgtgcaacgagaccatgatggccctgtgggaggagtgcaagccctgcctgaagcagacctgcatgaagttctacgccagagtgtgcagaagcggcagcggcctggtgggcagacagctggaggagttcctgaaccagagcagccccttctacttctggatgaacggcgacagaatcgacagcctgctggagaacgacagacagcagacccacatgctggacgtgatgcaggaccacttcagcagagccagcagcatcatcgacgagctgttccaggacagattcttcaccagagagccccaggacacctaccactacctgcccttcagcctgccccacagaagaccccacttcttcttccccaagagcagaatcgtgagaagcctgatgcccttcagcccctacgagcccctgaacttccacgccatgttccagcccttcctggagatgatccacgaggcccagcaggccatggacatccacttccacagccccgccttccagcacccccccaccgagttcatcagagagggcgacgacgacagaaccgtgtgcagagagatcagacacaacagcaccggctgcctgagaatgaaggaccagtgcgacaagtgcagagagatcctgagcgtggactgcagcaccaacaaccccagccaggccaagctgagaagagagctggacgagagcctgcaggtggccgagagactgaccagaaagtacaacgagctgctgaagagctaccagtggaagatgctgaacaccagcagcctgctggagcagctgaacgagcagttcaactgggtgagcagactggccaacctgacccagggcgaggaccagtactacctgagagtgaccaccgtggccagccacaccagcgacagcgacgtgcccagcggcgtgaccgaggtggtggtgaagctgttcgacagcgaccccatcaccgtgaccgtgcccgtggaggtgagcagaaagaaccccaagttcatggagaccgtggccgagaaggccctgcaggagtacagaaagaagcacagagaggagtag

SEQ ID NO: 77088 - DNA, 1506 bp, Artificial Sequence
  Description of Artificial Sequence: Synthetic coding sequence
atgcaggtgtgcagccagccccagagaggctgcgtgagagagcagagcgccatcaacaccgccccccccagcgcccacaacgccgccagccccggcggcgccagaggccacagagtgcccctgaccgaggcctgcaaggacagcagaatcggcggcatgatgaagaccctgctgctgttcgtgggcctgctgctgacctgggagagcggccaggtgctgggcgaccagaccgtgagcgacaacgagctgcaggagatgagcaaccagggcagcaagtacgtgaacaaggagatccagaacgccgtgaacggcgtgaagcagatcaagaccctgatcgagaagaccaacgaggagagaaagaccctgctgagcaacctggaggaggccaagaagaagaaggaggacgccctgaacgagaccagagagagcgagaccaagctgaaggagctgcccggcgtgtgcaacgagaccatgatggccctgtgggaggagtgcaagccctgcctgaagcagacctgcatgaagttctacgccagagtgtgcagaagcggcagcggcctggtgggcagacagctggaggagttcctgaaccagagcagccccttctacttctggatgaacggcgacagaatcgacagcctgctggagaacgacagacagcagacccacatgctggacgtgatgcaggaccacttcagcagagccagcagcatcatcgacgagctgttccaggacagattcttcaccagagagccccaggacacctaccactacctgcccttcagcctgccccacagaagaccccacttcttcttccccaagagcagaatcgtgagaagcctgatgcccttcagcccctacgagcccctgaacttccacgccatgttccagcccttcctggagatgatccacgaggcccagcaggccatggacatccacttccacagccccgccttccagcacccccccaccgagttcatcagagagggcgacgacgacagaaccgtgtgcagagagatcagacacaacagcaccggctgcctgagaatgaaggaccagtgcgacaagtgcagagagatcctgagcgtggactgcagcaccaacaaccccagccaggccaagctgagaagagagctggacgagagcctgcaggtggccgagagactgaccagaaagtacaacgagctgctgaagagctaccagtggaagatgctgaacaccagcagcctgctggagcagctgaacgagcagttcaactgggtgagcagactggccaacctgacccagggcgaggaccagtactacctgagagtgaccaccgtggccagccacaccagcgacagcgacgtgcccagcggcgtgaccgaggtggtggtgaagctgttcgacagcgaccccatcaccgtgaccgtgcccgtggaggtgagcagaaagaaccccaagttcatggagaccgtggccgagaaggccctgcaggagtacagaaagaagcacagagaggagtag

SEQ ID NO: 77089 - DNA, 894 bp, Artificial Sequence
  Description of Artificial Sequence: Synthetic coding sequence
atggaggcctgcaaggacagcagaatcggcggcatgatgaagaccctgctgctgttcgtgggcctgctgctgacctgggagagcggccaggtgctgggcgaccagaccgtgagcgacaacgagctgcaggagatgagcaaccagggcagcaagtacgtgaacaaggagatccagaacgccgtgaacggcgtgaagcagatcaagaccctgatcgagaagaccaacgaggagagaaagaccctgctgagcaacctggaggaggccaagaagaagaaggaggacgccctgaacgagaccagagagagcgagaccaagctgaaggagctgcccggcgtgtgcaacgagaccatgatggccctgtgggaggagtgcaagccctgcctgaagcagacctgcatgaagttctacgccagagtgtgcagaagcggcagcggcctggtgggcagacagctggaggagttcctgaaccagagcagccccttctacttctggatgaacggcgacagaatcgacagcctgctggagaacgacagacagcagacccacatgctggacgtgatgcaggaccacttcagcagagccagcagcatcatcgacgagctgttccaggacagattcttcaccagagagccccaggacacctaccactacctgcccttcagcctgccccacagaagaccccacttcttcttccccaagagcagaatcgtgagaagcctgatgcccttcagcccctacgagcccctgaacttccacgccatgttccagcccttcctggagatgatccacgaggcccagcaggccatggacatccacttccacagccccgccttccagcacccccccaccgagttcatcagagagggcgacgacgacagaaccgtgtgcagatag

SEQ ID NO: 77090 - DNA, 2040 bp, Artificial Sequence
  Description of Artificial Sequence: Synthetic coding sequence
ctgggccagttcgagcagcccaccggctacatggagaacagcgtgagctacagcgccatcgaggacgtgcagctgctgagctgggagaacgcccccaagtactgcctgcagctgaccatccccggcggcaccgtgctgctgcaggccgccaacagctacctgagagaccagtggttccacagcctgcagtggaagaagaagatctacaagtacaagaaggtgctgagcaaccccagcagatgggaggtggtgctgaaggagatcagaaccctggtggacatggccctgaccagccccctgcaggacgacagcatcaaccaggcccccctggagatcgtgagcaagctgctgagcgagaacaccaacctgaccacccaggagcacgagaacatcatcgtggccatcgcccccctgctggagaacaaccaccccccccccgacctgtgcgagttcttctgcaagcactgcagagagagacccagaagcatggtggtgatcgaggtgttcacccccgtggtgcagagaatcctgaagcacaacatggacttcggcaagtgccccagactgagactgttcacccaggagtacatcctggccctgaacgagctgaacgccggcatggaggtggtgaagaagttcatccagagcatgcacggccccaccggccactgcccccaccccagagtgctgcccaacctggtggccgtgtgcctggccgccatctacagctgctacgaggagttcatcaacagcagagacaacagccccagcctgaaggagatcagaaacggctgccagcagccctgcgacagaaagcccaccctgcccctgagactgctgcaccccagccccgacctggtgagccaggaggccaccctgagcgaggccagactgaagagcgtggtggtggccagcagcgagatccacgtggaggtggagagaaccagcaccgccaagcccgccctgaccgccagcgccggcaacgacagcgagcccaacctgatcgactgcctgatggtgagccccgcctgcagcaccatgagcatcgagctgggcccccaggccgacagaaccctgggctgctacgtggagatcctgaagctgctgagcgactacgacgactggagacccagcctggccagcctgctgcagcccatccccttccccaaggaggccctggcccacgagaagttcaccaaggagctgaagtacgtgatccagagattcgccgaggaccccagacaggaggtgcacagctgcctgctgagcgtgagagccggcaaggacggctggttccagctgtacagccccggcggcgtggcctgcgacgacgacggcgagctgttcgccagcatggtgcacatcctgatgggcagctgctacaagaccaagaagttcctgctgagcctggccgagaacaagctgggcccctgcatgctgctggccctgagaggcaaccagaccatggtggagatcctgtgcctgatgctggagtacaacatcatcgacaacaacgacacccagctgcagatcatcagcaccctggagagcaccgacgtgggcaagagaatgtacgagcagctgtgcgacagacagagagagctgaaggagctgcagagaaagggcggccccaccagactgaccctgcccagcaagagcaccgacgccgacctggccagactgctgagcagcggcagcttcggcaacctggagaacctgagcctggccttcaccaacgtgaccagcgcctgcgccgagcacctgatcaagctgcccagcctgaagcagctgaacctgtggagcacccagttcggcgacgccggcctgagactgctgagcgagcacctgaccatgctgcaggtgctgaacctgtgcgagacccccgtgaccgacgccggcctgctggccctgagcagcatgaagagcctgtgcagcctgaacatgaacagcaccaagctgagcgccgacacctacgaggacctgaaggccaagctgcccaacctgaaggaggtggacgtgagatacaccgaggcctggtag

SEQ ID NO: 77091 - DNA, 2322 bp, Artificial Sequence
  Description of Artificial Sequence: Synthetic coding sequence
atggacgtgaccagcagcagcggcggcggcggcgaccccagacagatcgaggagaccaagcccctgctgggcggcgacgtgagcgcccccgagggcaccaagatgggcgccgtgccctgcagaagagccctgctgctgtgcaacggcatgagatacaagctgctgcaggagggcgacatccaggtgtgcgtgatcagacaccccagaaccttcctgagcaagatcctgaccagcaagttcctgagaagatgggagccccaccacctgaccctggccgacaacagcctggccagcgccacccccaccggctacatggagaacagcgtgagctacagcgccatcgaggacgtgcagctgctgagctgggagaacgcccccaagtactgcctgcagctgaccatccccggcggcaccgtgctgctgcaggccgccaacagctacctgagagaccagtggttccacagcctgcagtggaagaagaagatctacaagtacaagaaggtgctgagcaaccccagcagatgggaggtggtgctgaaggagatcagaaccctggtggacatggccctgaccagccccctgcaggacgacagcatcaaccaggcccccctggagatcgtgagcaagctgctgagcgagaacaccaacctgaccacccaggagcacgagaacatcatcgtggccatcgcccccctgctggagaacaaccaccccccccccgacctgtgcgagttcttctgcaagcactgcagagagagacccagaagcatggtggtgatcgaggtgttcacccccgtggtgcagagaatcctgaagcacaacatggacttcggcaagtgccccagactgagactgttcacccaggagtacatcctggccctgaacgagctgaacgccggcatggaggtggtgaagaagttcatccagagcatgcacggccccaccggccactgcccccaccccagagtgctgcccaacctggtggccgtgtgcctggccgccatctacagctgctacgaggagttcatcaacagcagagacaacagccccagcctgaaggagatcagaaacggctgccagcagccctgcgacagaaagcccaccctgcccctgagactgctgcaccccagccccgacctggtgagccaggaggccaccctgagcgaggccagactgaagagcgtggtggtggccagcagcgagatccacgtggaggtggagagaaccagcaccgccaagcccgccctgaccgccagcgccggcaacgacagcgagcccaacctgatcgactgcctgatggtgagccccgcctgcagcaccatgagcatcgagctgggcccccaggccgacagaaccctgggctgctacgtggagatcctgaagctgctgagcgactacgacgactggagacccagcctggccagcctgctgcagcccatccccttccccaaggaggccctggcccacgagaagttcaccaaggagctgaagtacgtgatccagagattcgccgaggaccccagacaggaggtgcacagctgcctgctgagcgtgagagccggcaaggacggctggttccagctgtacagccccggcggcgtggcctgcgacgacgacggcgagctgttcgccagcatggtgcacatcctgatgggcagctgctacaagaccaagaagttcctgctgagcctggccgagaacaagctgggcccctgcatgctgctggccctgagaggcaaccagaccatggtggagatcctgtgcctgatgctggagtacaacatcatcgacaacaacgacacccagctgcagatcatcagcaccctggagagcaccgacgtgggcaagagaatgtacgagcagctgtgcgacagacagagagagctgaaggagctgcagagaaagggcggccccaccagactgaccctgcccagcaagagcaccgacgccgacctggccagactgctgagcagcggcagcttcggcaacctggagaacctgagcctggccttcaccaacgtgaccagcgcctgcgccgagcacctgatcaagctgcccagcctgaagcagctgaacctgtggagcacccagttcggcgacgccggcctgagactgctgagcgagcacctgaccatgctgcaggtgctgaacctgtgcgagacccccgtgaccgacgccggcctgctggccctgagcagcatgaagagcctgtgcagcctgaacatgaacagcaccaagctgagcgccgacacctacgaggacctgaaggccaagctgcccaacctgaaggaggtggacgtgagatacaccgaggcctggtag

SEQ ID NO: 77092 - DNA, 2040 bp, Artificial Sequence
  Description of Artificial Sequence: Synthetic coding sequence
atgggccaggccgccgagcccaccggctacatggagaacagcgtgagctacagcgccatcgaggacgtgcagctgctgagctgggagaacgcccccaagtactgcctgcagctgaccatccccggcggcaccgtgctgctgcaggccgccaacagctacctgagagaccagtggttccacagcctgcagtggaagaagaagatctacaagtacaagaaggtgctgagcaaccccagcagatgggaggtggtgctgaaggagatcagaaccctggtggacatggccctgaccagccccctgcaggacgacagcatcaaccaggcccccctggagatcgtgagcaagctgctgagcgagaacaccaacctgaccacccaggagcacgagaacatcatcgtggccatcgcccccctgctggagaacaaccaccccccccccgacctgtgcgagttcttctgcaagcactgcagagagagacccagaagcatggtggtgatcgaggtgttcacccccgtggtgcagagaatcctgaagcacaacatggacttcggcaagtgccccagactgagactgttcacccaggagtacatcctggccctgaacgagctgaacgccggcatggaggtggtgaagaagttcatccagagcatgcacggccccaccggccactgcccccaccccagagtgctgcccaacctggtggccgtgtgcctggccgccatctacagctgctacgaggagttcatcaacagcagagacaacagccccagcctgaaggagatcagaaacggctgccagcagccctgcgacagaaagcccaccctgcccctgagactgctgcaccccagccccgacctggtgagccaggaggccaccctgagcgaggccagactgaagagcgtggtggtggccagcagcgagatccacgtggaggtggagagaaccagcaccgccaagcccgccctgaccgccagcgccggcaacgacagcgagcccaacctgatcgactgcctgatggtgagccccgcctgcagcaccatgagcatcgagctgggcccccaggccgacagaaccctgggctgctacgtggagatcctgaagctgctgagcgactacgacgactggagacccagcctggccagcctgctgcagcccatccccttccccaaggaggccctggcccacgagaagttcaccaaggagctgaagtacgtgatccagagattcgccgaggaccccagacaggaggtgcacagctgcctgctgagcgtgagagccggcaaggacggctggttccagctgtacagccccggcggcgtggcctgcgacgacgacggcgagctgttcgccagcatggtgcacatcctgatgggcagctgctacaagaccaagaagttcctgctgagcctggccgagaacaagctgggcccctgcatgctgctggccctgagaggcaaccagaccatggtggagatcctgtgcctgatgctggagtacaacatcatcgacaacaacgacacccagctgcagatcatcagcaccctggagagcaccgacgtgggcaagagaatgtacgagcagctgtgcgacagacagagagagctgaaggagctgcagagaaagggcggccccaccagactgaccctgcccagcaagagcaccgacgccgacctggccagactgctgagcagcggcagcttcggcaacctggagaacctgagcctggccttcaccaacgtgaccagcgcctgcgccgagcacctgatcaagctgcccagcctgaagcagctgaacctgtggagcacccagttcggcgacgccggcctgagactgctgagcgagcacctgaccatgctgcaggtgctgaacctgtgcgagacccccgtgaccgacgccggcctgctggccctgagcagcatgaagagcctgtgcagcctgaacatgaacagcaccaagctgagcgccgacacctacgaggacctgaaggccaagctgcccaacctgaaggaggtggacgtgagatacaccgaggcctggtag

SEQ ID NO: 77093 - DNA, 1761 bp, Artificial Sequence
  Description of Artificial Sequence: Synthetic coding sequence
atggccctgaccagccccctgcaggacgacagcatcaaccaggcccccctggagatcgtgagcaagctgctgagcgagaacaccaacctgaccacccaggagcacgagaacatcatcgtggccatcgcccccctgctggagaacaaccaccccccccccgacctgtgcgagttcttctgcaagcactgcagagagagacccagaagcatggtggtgatcgaggtgttcacccccgtggtgcagagaatcctgaagcacaacatggacttcggcaagtgccccagactgagactgttcacccaggagtacatcctggccctgaacgagctgaacgccggcatggaggtggtgaagaagttcatccagagcatgcacggccccaccggccactgcccccaccccagagtgctgcccaacctggtggccgtgtgcctggccgccatctacagctgctacgaggagttcatcaacagcagagacaacagccccagcctgaaggagatcagaaacggctgccagcagccctgcgacagaaagcccaccctgcccctgagactgctgcaccccagccccgacctggtgagccaggaggccaccctgagcgaggccagactgaagagcgtggtggtggccagcagcgagatccacgtggaggtggagagaaccagcaccgccaagcccgccctgaccgccagcgccggcaacgacagcgagcccaacctgatcgactgcctgatggtgagccccgcctgcagcaccatgagcatcgagctgggcccccaggccgacagaaccctgggctgctacgtggagatcctgaagctgctgagcgactacgacgactggagacccagcctggccagcctgctgcagcccatccccttccccaaggaggccctggcccacgagaagttcaccaaggagctgaagtacgtgatccagagattcgccgaggaccccagacaggaggtgcacagctgcctgctgagcgtgagagccggcaaggacggctggttccagctgtacagccccggcggcgtggcctgcgacgacgacggcgagctgttcgccagcatggtgcacatcctgatgggcagctgctacaagaccaagaagttcctgctgagcctggccgagaacaagctgggcccctgcatgctgctggccctgagaggcaaccagaccatggtggagatcctgtgcctgatgctggagtacaacatcatcgacaacaacgacacccagctgcagatcatcagcaccctggagagcaccgacgtgggcaagagaatgtacgagcagctgtgcgacagacagagagagctgaaggagctgcagagaaagggcggccccaccagactgaccctgcccagcaagagcaccgacgccgacctggccagactgctgagcagcggcagcttcggcaacctggagaacctgagcctggccttcaccaacgtgaccagcgcctgcgccgagcacctgatcaagctgcccagcctgaagcagctgaacctgtggagcacccagttcggcgacgccggcctgagactgctgagcgagcacctgaccatgctgcaggtgctgaacctgtgcgagacccccgtgaccgacgccggcctgctggccctgagcagcatgaagagcctgtgcagcctgaacatgaacagcaccaagctgagcgccgacacctacgaggacctgaaggccaagctgcccaacctgaaggaggtggacgtgagatacaccgaggcctggtag

SEQ ID NO: 77094 - DNA, 312 bp, Artificial Sequence
  Description of Artificial Sequence: Synthetic coding sequence
atggcccactacaaggccgccgacagcaagagagagcagttcagaagatacctggagaagagcggcgtgctggacaccctgaccaaggtgctggtggccctgtacgaggagcccgagaagcccaacagcgccctggacttcctgaagcaccacctgggcgccgccacccccgagaaccccgagatcgagctgctgagactggagctggccgagatgaaggagaagtacgaggccatcgtggaggagaacaagaagctgaaggccaagctggcccagtacgagcccccccaggaggagaagagagccgagtag

SEQ ID NO: 77095 - DNA, 1695 bp, Artificial Sequence
  Description of Artificial Sequence: Synthetic coding sequence
atggccgtgttcagaagcggcctgctggtgctgaccacccccctggccagcctggcccccagactggccagcatcctgaccagcgccgccagactggtgaaccacaccctgtacgtgcacctgcagcccggcatgagcctggagggccccgcccagccccagagcagccccgtgcaggccaccttcgaggtgctggacttcatcacccacctgtacgccggcgccgacgtgcacagacacctggacgtgagaatcctgctgaccaacatcagaaccaagagcaccttcctgccccccctgcccaccagcgtgcagaacctggcccacccccccgaggtggtgctgaccgacttccagaccctggacggcagccagtacaaccccgtgaagcagcagctggtgagatacgccaccagctgctacagctgctgccccagactggccagcgtgctgctgtacagcgactacggcatcggcgaggtgcccgtggagcccctggacgtgcccctgcccagcaccatcagacccgccagccccgtggccggcagccccaagcagcccgtgagaggctactacagaggcgccgtgggcggcaccttcgacagactgcacaacgcccacaaggtgctgctgagcgtggcctgcatcctggcccaggagcagctggtggtgggcgtggccgacaaggacctgctgaagagcaagctgctgcccgagctgctgcagccctacaccgagagagtggagcacctgagcgagttcctggtggacatcaagcccagcctgaccttcgacgtgatccccctgctggacccctacggccccgccggcagcgaccccagcctggagttcctggtggtgagcgaggagacctacagaggcggcatggccatcaacagattcagactggagaacgacctggaggagctggccctgtaccagatccagctgctgaaggacctgagacacaccgagaacgaggaggacaaggtgagcagcagcagcttcagacagagaatgctgggcaacctgctgagacccccctacgagagacccgagctgcccacctgcctgtacgtgatcggcctgaccggcatcagcggcagcggcaagagcagcatcgcccagagactgaagggcctgggcgccttcgtgatcgacagcgaccacctgggccacagagcctacgcccccggcggccccgcctaccagcccgtggtggaggccttcggcaccgacatcctgcacaaggacggcatcatcaacagaaaggtgctgggcagcagagtgttcggcaacaagaagcagctgaagatcctgaccgacatcatgtggcccatcatcgccaagctggccagagaggagatggacagagccgtggccgagggcaagagagtgtgcgtgatcgacgccgccgtgctgctggaggccggctggcagaacctggtgcacgaggtgtggaccgccgtgatccccgagaccgaggccgtgagaagaatcgtggagagagacggcctgagcgaggccgccgcccagagcagactgcagagccagatgagcggccagcagctggtggagcagagccacgtggtgctgagcaccctgtgggagccccacatcacccagagacaggtggagaaggcctgggccctgctgcagaagagaatccccaagacccaccaggccctggactag

SEQ ID NO: 77096 - DNA, 1695 bp, Artificial Sequence; identical to SEQ ID NO: 77095
  Description of Artificial Sequence: Synthetic coding sequence

SEQ ID NO: 77097 - DNA, 1782 bp, Artificial Sequence
  Description of Artificial Sequence: Synthetic coding sequence
atgagaacccccagactgagagcccagcccagaggcgccgtgtaccaggcccccagccccccccccgcccccgtgggcctgggcagcatggccgtgttcagaagcggcctgctggtgctgaccacccccctggccagcctggcccccagactggccagcatcctgaccagcgccgccagactggtgaaccacaccctgtacgtgcacctgcagcccggcatgagcctggagggccccgcccagccccagagcagccccgtgcaggccaccttcgaggtgctggacttcatcacccacctgtacgccggcgccgacgtgcacagacacctggacgtgagaatcctgctgaccaacatcagaaccaagagcaccttcctgccccccctgcccaccagcgtgcagaacctggcccacccccccgaggtggtgctgaccgacttccagaccctggacggcagccagtacaaccccgtgaagcagcagctggtgagatacgccaccagctgctacagctgctgccccagactggccagcgtgctgctgtacagcgactacggcatcggcgaggtgcccgtggagcccctggacgtgcccctgcccagcaccatcagacccgccagccccgtggccggcagccccaagcagcccgtgagaggctactacagaggcgccgtgggcggcaccttcgacagactgcacaacgcccacaaggtgctgctgagcgtggcctgcatcctggcccaggagcagctggtggtgggcgtggccgacaaggacctgctgaagagcaagctgctgcccgagctgctgcagccctacaccgagagagtggagcacctgagcgagttcctggtggacatcaagcccagcctgaccttcgacgtgatccccctgctggacccctacggccccgccggcagcgaccccagcctggagttcctggtggtgagcgaggagacctacagaggcggcatggccatcaacagattcagactggagaacgacctggaggagctggccctgtaccagatccagctgctgaaggacctgagacacaccgagaacgaggaggacaaggtgagcagcagcagcttcagacagagaatgctgggcaacctgctgagacccccctacgagagacccgagctgcccacctgcctgtacgtgatcggcctgaccggcatcagcggcagcggcaagagcagcatcgcccagagactgaagggcctgggcgccttcgtgatcgacagcgaccacctgggccacagagcctacgcccccggcggccccgcctaccagcccgtggtggaggccttcggcaccgacatcctgcacaaggacggcatcatcaacagaaaggtgctgggcagcagagtgttcggcaacaagaagcagctgaagatcctgaccgacatcatgtggcccatcatcgccaagctggccagagaggagatggacagagccgtggccgagggcaagagagtgtgcgtgatcgacgccgccgtgctgctggaggccggctggcagaacctggtgcacgaggtgtggaccgccgtgatccccgagaccgaggccgtgagaagaatcgtggagagagacggcctgagcgaggccgccgcccagagcagactgcagagccagatgagcggccagcagctggtggagcagagccacgtggtgctgagcaccctgtgggagccccacatcacccagagacaggtggagaaggcctgggccctgctgcagaagagaatccccaagacccaccaggccctggactag

SEQ ID NO: 77098 - DNA, 528 bp, Artificial Sequence
  Description of Artificial Sequence: Synthetic coding sequence
atggccgtgttcagaagcggcctgctggtgctgaccacccccctggccagcctggcccccagactggccagcatcctgaccagcgccgccagactggtgaaccacaccctgtacgtgcacctgcagcccggcatgagcctggagggccccgcccagccccagagcagccccgtgcaggccaccttcgaggtgctggacttcatcacccacctgagccccagccccgcccacctgagccccgagagcagaccccccgccagaagcagagtggacagattccccgaccccggctggaagcccgtgcagcccggccagaccgccgccagcgccctgagacaccagctgctgcagctgctgagcgccaccggcctgggcgccgccatcctgagactgtgggacagaagaagcgccagaggcgcccccggctgccccctgaccctgcacgaccaggccagcttccccagaggcagagtgagcaaggccgccggcgcctggctgctgccctggagatgcagatggcacgtgtag

SEQ ID NO: 77099 - DNA, 810 bp, Artificial Sequence
  Description of Artificial Sequence: Synthetic coding sequence
atggccatcaacagattcagactggagaacgacctggaggagctggccctgtaccagatccagctgctgaaggacctgagacacaccgagaacgaggaggacaaggtgagcagcagcagcttcagacagagaatgctgggcaacctgctgagacccccctacgagagacccgagctgcccacctgcctgtacgtgatcggcctgaccggcatcagcggcagcggcaagagcagcatcgcccagagactgaagggcctgggcgccttcgtgatcgacagcgaccacctgggccacagagcctacgcccccggcggccccgcctaccagcccgtggtggaggccttcggcaccgacatcctgcacaaggacggcatcatcaacagaaaggtgctgggcagcagagtgttcggcaacaagaagcagctgaagatcctgaccgacatcatgtggcccatcatcgccaagctggccagagaggagatggacagagccgtggccgagggcaagagagtgtgcgtgatcgacgccgccgtgctgctggaggccggctggcagaacctggtgcacgaggtgtggaccgccgtgatccccgagaccgaggccgtgagaagaatcgtggagagagacggcctgagcgaggccgccgcccagagcagactgcagagccagatgagcggccagcagctggtggagcagagccacgtggtgctgagcaccctgtgggagccccacatcacccagagacaggtggagaaggcctgggccctgctgcagaagagaatccccaagacccaccaggccctggactag

SEQ ID NO: 77100 - DNA, 1782 bp, Artificial Sequence; identical to SEQ ID NO: 77097
  Description of Artificial Sequence: Synthetic coding sequence

SEQ ID NO: 77101 - DNA, 429 bp, Artificial Sequence
  Description of Artificial Sequence: Synthetic coding sequence
atggccaccaagatcgacaaggaggcctgcagagccgcctacaacctggtgagagacgacggcagcgccgtgatctgggtgaccttcaagtacgacggcagcaccatcgtgcccggcgagcagggcgccgagtaccagcacttcatccagcagtgcaccgacgacgtgagactgttcgccttcgtgagattcaccaccggcgacgccatgagcaagagaagcaagttcgccctgatcacctggatcggcgagaacgtgagcggcctgcagagagccaagaccggcaccgacaagaccctggtgaaggaggtggtgcagaacttcgccaaggagttcgtgatcagcgacagaaaggagctggaggaggacttcatcaagagcgagctgaagaaggccggcggcgccaactacgacgcccagaccgagtag

SEQ ID NO: 77102 - DNA, 1731 bp, Artificial Sequence
  Description of Artificial Sequence: Synthetic coding sequence
atgagaggccccaacagcggcaccgagaagggcagactggtgatccccgagaagcagggcttcgacttcctgtgcatgcccgtgttccaccccagattcaagagagagttcatccaggagcccgccaagaacagacccggcccccagaccagaagcgacctgctgctgagcggcagagccttcctgctgcccctgaaccaggaggacaacaccaacctggccagagtgctgaccaaccacatccacaccggccaccacagcagcatgttctggatgagagtgcccctggtggcccccgaggacctgagagacgacatcatcgagaacgcccccaccacccacaccgaggagtacagcggcgaggagaagacctggatgtggtggcacaacttcagaaccctgtgcgactacagcaagagaatcgccgtggccctggagatcggcgccgacctgcccagcaaccacgtgatcgacagatggctgggcgagcccatcaaggccgccatcctgcccaccagcatcttcctgaccaacaagaagggcttccccgtgctgagcaagatgcaccagagactgatcttcagactgctgaagctggaggtgcagttcatcatcaccggcaccaaccaccacagcgagaaggagttctgcagctacctgcagtacctggagtacctgagccagaacagacccccccccaacgcctacgagctgttcgccaagggctacgaggactacctgcagagccccctgcagcccctgatggacaacctggagagccagacctacgaggtgttcgagaaggaccccatcaagtacagccagtaccagcaggccatctacaagtgcctgctggacagagtgcccgaggaggagaaggacaccaacgtgcaggtgctgatggtgctgggcgccggcagaggccccctggtgaacgccagcctgagagccgccaagcaggccgacagaagaatcaagctgtacgccgtggagaagaaccccaacgccgtggtgaccctggagaactggcagttcgaggagtggggcagccaggtgaccgtggtgagcagcgacatgagagagtgggtggcccccgagaaggccgacatcatcgtgagcgagctgctgggcagcttcgccgacaacgagctgagccccgagtgcctggacggcgcccagcacttcctgaaggacgacggcgtgagcatccccggcgagtacaccagcttcctggcccccatcagcagcagcaagctgtacaacgaggtgagagcctgcagagagaaggacagagaccccgaggcccagttcgagatgccctacgtggtgagactgcacaacttccaccagctgagcgccccccagccctgcttcaccttcagccaccccaacagagaccccatgatcgacaacaacagatactgcaccctggagttccccgtggaggtgaacaccgtgctgcacggcttcgccggctacttcgagaccgtgctgtaccaggacatcaccctgagcatcagacccgagacccacagccccggcatgttcagctggttccccatcctgttccccatcaagcagcccatcaccgtgagagagggccagaccatctgcgtgagattctggagatgcagcaacagcaagaaggtgtggtacgagtgggccgtgaccgcccccgtgtgcagcgccatccacaaccccaccggcagaagctacaccatcggcctgtag

SEQ ID NO: 77103 - DNA, 1206 bp, Artificial Sequence
  Description of Artificial Sequence: Synthetic coding sequence
atgctgggcatcggcaccgagggcccccacgtgggcctggtgcaggccagcgagcaccccaagatcgagttctacctgaagaacttcaccagcgccaaggacgtgctgttcgccatcaaggaggtgggcttcagaggcggcaacagcaacaccgacatcaccctggagaagtacctgttcgtgatgctgaagagaagcgagaaccagcagacctacctgatgaacgccgacgtggccgagagaatgagcagcaccaccgtggacagcgaggagagactgctgagaggcaaggccctgaagcacaccgcccagaagttcttcaccgtggacgccggcgtgagaaagggcatccccaaggtggtggtggtgttcatcgacggctggcccagcgacgacatcgaggaggccggcatcgtggccagagagttcggcgtgaacgtgttcatcgtgagcgtggccaagcccatccccgaggagctgggcatggtgcaggacgtgaccttcgtggacaaggccgtgtgcagaaacaacggcttcttcagctaccacatgcccaactggttcggcaccaccaagtacgtgaagcccctggtgcagaagctgtgcacccacgagcagatgatgtgcagcaagacctgctacaacagcgtgaacatcgccttcctgatcgacggcagcagcagcgtgggcgacagcaacttcagactgatgctggagttcgtgagcaacatcgccaagaccttcgagatcagcgacatcggcgccaagatcgccgccgtgcagttcacctacgaccagagaaccgagttcagcttcaccgactacagcaccaaggagaacgtgctggccgtgatcagaaacatcagatacatgagcggcggcaccgccaccggcgacgccatcagcttcaccgtgagaaacgtgttcggccccatcagagagagccccaacaagaacttcctggtgatcgtgaccgacggccagagctacgacgacgtgcagggccccgccgccgccgcccacgacgccggcatcaccatcttcagcgtgggcgtggcctgggcccccctggacgacctgaaggacatggccagcaagcccaaggagagccacgccttcttcaccagagagttcaccggcctggagcccatcgtgagcgacgtgatcagaggcatctgcagagacttcctggagagccagcagtag

SEQ ID NO: 77104 - DNA, 1653 bp, Artificial Sequence; identical to SEQ ID NO: 71960
  Description of Artificial Sequence: Synthetic coding sequence

SEQ ID NO: 77105 - DNA, 732 bp, Artificial Sequence
  Description of Artificial Sequence: Synthetic coding sequence
atgctgagcagatggagcgccagcttcaccgtgaccaagggcaagagcagcacccaggaggccaccggccaggccgtgagcaccgcccacccccccaccggcaagagactgaagaagacccccgagaagaagaccggcaacaaggactgcaaggccgacatcgccttcctgatcgacggcagcttcaacatcggccagagaagattcaacctgcagaagaacttcgtgggcaaggtggccctgatgctgggcatcggcaccgagggcccccacgtgggcctggtgcaggccagcgagcaccccaagatcgagttctacctgaagaacttcaccagcgccaaggacgtgctgttcgccatcaaggaggtgggcttcagaggcggcaacagcaacaccggcaaggccctgaagcacaccgcccagaagttcttcaccgtggacgccggcgtgagaaagggcatccccaaggtggtggtggtgttcatcgacggctggcccagcgacgacatcgaggaggccggcatcgtggccagagagttcggcgtgaacgtgttcatcgtgagcgtggccaagcccatccccgaggagctgggcatggtgcaggacgtgaccttcgtggacaaggccgtgtgcagaaacaacggcttcttcagctaccacatgcccaactggttcggcaccaccaagtacgtgagcctgtggtacagaagctgcgccctgatgaacaagtag

SEQ ID NO: 77106 - DNA, 1278 bp, Artificial Sequence
  Description of Artificial Sequence: Synthetic coding sequence
atgggccccagaagactgctgctggtggccgcctgcttcagcctgtgcggccccctgctgagcgccagaaccagagccagaagacccgagagcaaggccaccaacgccaccctggaccccagaagcttcctgctgagaaaccccaacgacaagtacgagcccttctgggaggacgaggagaagaacgagagcggcctgaccgagtacagactggtgagcatcaacaagagcagccccctgcagaagcagctgcccgccttcatcagcgaggacgccagcggctacctgaccagcagctggctgaccctgttcgtgcccagcgtgtacaccggcgtgttcgtggtgagcctgcccctgaacatcatggccatcgtggtgttcatcctgaagatgaaggtgaagaagcccgccgtggtgtacatgctgcacctggccaccgccgacgtgctgttcgtgagcgtgctgcccttcaagatcagctactacttcagcggcagcgactggcagttcggcagcgagctgtgcagattcgtgaccgccgccttctactgcaacatgtacgccagcatcctgctgatgaccgtgatcagcatcgacagattcctggccgtggtgtaccccatgcagagcctgagctggagaaccctgggcagagccagcttcacctgcctggccatctgggccctggccatcgccggcgtggtgcccctgctgctgaaggagcagaccatccaggtgcccggcctgaacatcaccacctgccacgacgtgctgaacgagaccctgctggagggctactacgcctactacttcagcgccttcagcgccgtgttcttcttcgtgcccctgatcatcagcaccgtgtgctacgtgagcatcatcagatgcctgagcagcagcgccgtggccaacagaagcaagaagagcagagccctgttcctgagcgccgccgtgttctgcatcttcatcatctgcttcggccccaccaacgtgctgctgatcgcccactacagcttcctgagccacaccagcaccaccgaggccgcctacttcgcctacctgctgtgcgtgtgcgtgagcagcatcagctgctgcatcgaccccctgatctactactacgccagcagcgagtgccagagatacgtgtacagcatcctgtgctgcaaggagagcagcgaccccagcagctacaacagcagcggccagctgatggccagcaagatggacacctgcagcagcaacctgaacaacagcatctacaagaagctgctgacctag

SEQ ID NO: 77107 - DNA, 1194 bp, Artificial Sequence
  Description of Artificial Sequence: Synthetic coding sequence
atgagaagccccagcgccgcctggctgctgggcgccgccatcctgctggccgccagcctgagctgcagcggcaccatccagggcaccagcagaagcagcaagggcagaagcctgatcggcaaggtggacggcaccagccacgtgaccggcaagggcgtgaccgtggagaccgtgttcagcgtggacgagttcagcgccagcgtgctgaccggcaagctgaccaccgtgttcctgcccatcgtgtacaccatcgtgttcgtggtgggcctgcccagcaacggcatggccctgtgggtgttcctgttcagaaccaagaagaagcaccccgccgtgatctacatggccaacctggccctggccgacctgctgagcgtgatctggttccccctgaagatcgcctaccacatccacggcaacaactggatctacggcgaggccctgtgcaacgtgctgatcggcttcttctacggcaacatgtactgcagcatcctgttcatgacctgcctgagcgtgcagagatactgggtgatcgtgaaccccatgggccacagcagaaagaaggccaacatcgccatcggcatcagcctggccatctggctgctgatcctgctggtgaccatccccctgtacgtggtgaagcagaccatcttcatccccgccctgaacatcaccacctgccacgacgtgctgcccgagcagctgctggtgggcgacatgttcaactacttcctgagcctggccatcggcgtgttcctgttccccgccttcctgaccgccagcgcctacgtgctgatgatcagaatgctgagaagcagcgccatggacgagaacagcgagaagaagagaaagagagccatcaagctgatcgtgaccgtgctggccatgtacctgatctgcttcacccccagcaacctgctgctggtggtgcactacttcctgatcaagagccagggccagagccacgtgtacgccctgtacatcgtggccctgtgcctgagcaccctgaacagctgcatcgaccccttcgtgtactacttcgtgagccacgacttcagagaccacgccaagaacgccctgctgtgcagaagcgtgagaaccgtgaagcagatgcaggtgagcctgaccagcaagaagcacagcagaaagagcagcagctacagcagcagcagcaccaccgtgaagaccagctactag

SEQ ID NO: 77108 - DNA, 1125 bp, Artificial Sequence
  Description of Artificial Sequence: Synthetic coding sequence
atgaaggccctgatcttcgccgccgccggcctgctgctgctgctgcccaccttctgccagagcggcatggagaacgacaccaacaacctggccaagcccaccctgcccatcaagaccttcagaggcgccccccccaacagcttcgaggagttccccttcagcgccctggagggctggaccggcgccaccatcaccgtgaagatcaagtgccccgaggagagcgccagccacctgcacgtgaagaacgccaccatgggctacctgaccagcagcctgagcaccaagctgatccccgccatctacctgctggtgttcgtggtgggcgtgcccgccaacgccgtgaccctgtggatgctgttcttcagaaccagaagcatctgcaccaccgtgttctacaccaacctggccatcgccgacttcctgttctgcgtgaccctgcccttcaagatcgcctaccacctgaacggcaacaactgggtgttcggcgaggtgctgtgcagagccaccaccgtgatcttctacggcaacatgtactgcagcatcctgctgctggcctgcatcagcatcaacagatacctggccatcgtgcaccccttcacctacagaggcctgcccaagcacacctacgccctggtgacctgcggcctggtgtgggccaccgtgttcctgtacatgctgcccttcttcatcctgaagcaggagtactacctggtgcagcccgacatcaccacctgccacgacgtgcacaacacctgcgagagcagcagccccttccagctgtactacttcatcagcctggccttcttcggcttcctgatccccttcgtgctgatcatctactgctacgccgccatcatcagaaccctgaacgcctacgaccacagatggctgtggtacgtgaaggccagcctgctgatcctggtgatcttcaccatctgcttcgcccccagcaacatcatcctgatcatccaccacgccaactactactacaacaacaccgacggcctgtacttcatctacctgatcgccctgtgcctgggcagcctgaacagctgcctggaccccttcctgtacttcctgatgagcaagaccagaaaccacagcaccgcctacctgaccaagtag

SEQ ID NO: 77109 - DNA, 1059 bp, Artificial Sequence
  Description of Artificial Sequence: Synthetic coding sequence
atggagaacgacaccaacaacctggccaagcccaccctgcccatcaagaccttcagaggcgccccccccaacagcttcgaggagttccccttcagcgccctggagggctggaccggcgccaccatcaccgtgaagatcaagtgccccgaggagagcgccagccacctgcacgtgaagaacgccaccatgggctacctgaccagcagcctgagcaccaagctgatccccgccatctacctgctggtgttcgtggtgggcgtgcccgccaacgccgtgaccctgtggatgctgttcttcagaaccagaagcatctgcaccaccgtgttctacaccaacctggccatcgccgacttcctgttctgcgtgaccctgcccttcaagatcgcctaccacctgaacggcaacaactgggtgttcggcgaggtgctgtgcagagccaccaccgtgatcttctacggcaacatgtactgcagcatcctgctgctggcctgcatcagcatcaacagatacctggccatcgtgcaccccttcacctacagaggcctgcccaagcacacctacgccctggtgacctgcggcctggtgtgggccaccgtgttcctgtacatgctgcccttcttcatcctgaagcaggagtactacctggtgcagcccgacatcaccacctgccacgacgtgcacaacacctgcgagagcagcagccccttccagctgtactacttcatcagcctggccttcttcggcttcctgatccccttcgtgctgatcatctactgctacgccgccatcatcagaaccctgaacgcctacgaccacagatggctgtggtacgtgaaggccagcctgctgatcctggtgatcttcaccatctgcttcgcccccagcaacatcatcctgatcatccaccacgccaactactactacaacaacaccgacggcctgtacttcatctacctgatcgccctgtgcctgggcagcctgaacagctgcctggaccccttcctgtacttcctgatgagcaagaccagaaaccacagcaccgcctacctgaccaagtag

SEQ ID NO: 77110 - DNA, 1158 bp, Artificial Sequence
  Description of Artificial Sequence: Synthetic coding sequence
atgtggggcagactgctgctgtggcccctggtgctgggcttcagcctgagcggcggcacccagacccccagcgtgtacgacgagagcggcagcaccggcggcggcgacgacagcacccccagcatcctgcccgcccccagaggctaccccggccaggtgtgcgccaacgacagcgacaccctggagctgcccgacagcagcagagccctgctgctgggctgggtgcccaccagactggtgcccgccctgtacggcctggtgctggtggtgggcctgcccgccaacggcctggccctgtgggtgctggccacccaggcccccagactgcccagcaccatgctgctgatgaacctggccgccgccgacctgctgctggccctggccctgccccccagaatcgcctaccacctgagaggccagagatggcccttcggcgaggccgcctgcagactggccaccgccgccctgtacggccacatgtacggcagcgtgctgctgctggccgccgtgagcctggacagatacctggccctggtgcaccccctgagagccagagccctgagaggcagaagactggccctgggcctgtgcatggccgcctggctgatggccgccgccctggccctgcccctgaccctgcagagacagaccttcagactggccagaagcgacagagtgctgtgccacgacgccctgcccctggacgcccaggccagccactggcagcccgccttcacctgcctggccctgctgggctgcttcctgcccctgctggccatgctgctgtgctacggcgccaccctgcacaccctggccgccagcggcagaagatacggccacgccctgagactgaccgccgtggtgctggccagcgccgtggccttcttcgtgcccagcaacctgctgctgctgctgcactacagcgaccccagccccagcgcctggggcaacctgtacggcgcctacgtgcccagcctggccctgagcaccctgaacagctgcgtggaccccttcatctactactacgtgagcgccgagttcagagacaaggtgagagccggcctgttccagagaagccccggcgacaccgtggccagcaaggccagcgccgagggcggcagcagaggcatgggcacccacagcagcctgctgcagtag

SEQ ID NO: 77111 - DNA, 1848 bp, Artificial Sequence
  Description of Artificial Sequence: Synthetic coding sequence
atgagagccctgctgctgctgggcttcctgctggtgagcctggagagcaccctgagcatccccccctgggaggcccccaaggagcacaagtacaaggccgaggagcacaccgtggtgctgaccgtgaccggcgagccctgccacttccccttccagtaccacagacagctgtaccacaagtgcacccacaagggcagacccggcccccagccctggtgcgccaccacccccaacttcgaccaggaccagagatggggctactgcctggagcccaagaaggtgaaggaccactgcagcaagcacagcccctgccagaagggcggcacctgcgtgaacatgcccagcggcccccactgcctgtgcccccagcacctgaccggcaaccactgccagaaggagaagtgcttcgagccccagctgctgagattcttccacaagaacgagatctggtacagaaccgagcaggccgccgtggccagatgccagtgcaagggccccgacgcccactgccagagactggccagccaggcctgcagaaccaacccctgcctgcacggcggcagatgcctggaggtggagggccacagactgtgccactgccccgtgggctacaccggcgccttctgcgacgtggacaccaaggccagctgctacgacggcagaggcctgagctacagaggcctggccagaaccaccctgagcggcgccccctgccagccctgggccagcgaggccacctacagaaacgtgaccgccgagcaggccagaaactggggcctgggcggccacgccttctgcagaaaccccgacaacgacatcagaccctggtgcttcgtgctgaacagagacagactgagctgggagtactgcgacctggcccagtgccagacccccacccaggccgccccccccacccccgtgagccccagactgcacgtgcccctgatgcccgcccagcccgccccccccaagccccagcccaccaccagaacccccccccagagccagacccccggcgccctgcccgccaagagagagcagccccccagcctgaccagaaacggccccctgagctgcggccagagactgagaaagagcctgagcagcatgaccagagtggtgggcggcctggtggccctgagaggcgcccacccctacatcgccgccctgtactggggccacagcttctgcgccggcagcctgatcgccccctgctgggtgctgaccgccgcccactgcctgcaggacagacccgcccccgaggacctgaccgtggtgctgggccaggagagaagaaaccacagctgcgagccctgccagaccctggccgtgagaagctacagactgcacgaggccttcagccccgtgagctaccagcacgacctggccctgctgagactgcaggaggacgccgacggcagctgcgccctgctgagcccctacgtgcagcccgtgtgcctgcccagcggcgccgccagacccagcgagaccaccctgtgccaggtggccggctggggccaccagttcgagggcgccgaggagtacgccagcttcctgcaggaggcccaggtgcccttcctgagcctggagagatgcagcgcccccgacgtgcacggcagcagcatcctgcccggcatgctgtgcgccggcttcctggagggcggcaccgacgcctgccagggcgacagcggcggccccctggtgtgcgaggaccaggccgccgagagaagactgaccctgcagggcatcatcagctggggcagcggctgcggcgacagaaacaagcccggcgtgtacaccgacgtggcctactacctggcctggatcagagagcacaccgtgagctag

SEQ ID NO: 77112 - DNA, 1986 bp, Artificial Sequence
  Description of Artificial Sequence: Synthetic coding sequence
atgagactgaagaacctgaccttcatcatcatcctgatcatcagcggcgagctgtacgccgaggagaagccctgcggcttcccccacgtggagaacggcagaatcgcccagtactactacaccttcaagagcttctacttccccatgagcatcgacaagaagctgagcttcttctgcctggccggctacaccaccgagagcggcagacaggaggagcagaccacctgcaccaccgagggctggagccccgagcccagatgcttcaagaagtgcaccaagcccgacctgagcaacggctacatcagcgacgtgaagctgctgtacaagatccaggagaacatgagatacggctgcgccagcggctacaagaccaccggcggcaaggacgaggaggtggtgcagtgcctgagcgacggctggagcagccagcccacctgcagaaaggagcacgagacctgcctggcccccgagctgtacaacggcaactacagcaccacccagaagaccttcaaggtgaaggacaaggtgcagtacgagtgcgccaccggctactacaccgccggcggcaagaagaccgaggaggtggagtgcctgacctacggctggagcctgacccccaagtgcaccaagctgaagtgcagcagcctgagactgatcgagaacggctacttccaccccgtgaagcagacctacgaggagggcgacgtggtgcagttcttctgccacgagaactactacctgagcggcagcgacctgatccagtgctacaacttcggctggtaccccgagagccccgtgtgcgagggcagaagaaacagatgcccccccccccccctgcccatcaacagcaagatccagacccacagcaccacctacagacacggcgagatcgtgcacatcgagtgcgagctgaacttcgagatccacggcagcgccgagatcagatgcgaggacggcaagtggaccgagccccccaagtgcatcgagggccaggagaaggtggcctgcgaggagccccccttcatcgagaacggcgccgccaacctgcacagcaagatctactacaacggcgacaaggtgacctacgcctgcaagagcggctacctgctgcacggcagcaacgagatcacctgcaacagaggcaagtggaccctgccccccgagtgcgtggagaacaacgagaactgcaagcacccccccgtggtgatgaacggcgccgtggccgacggcatcctggccagctacgccaccggcagcagcgtggagtacagatgcaacgagtactacctgctgagaggcagcaagatcagcagatgcgagcagggcaagtggagcagcccccccgtgtgcctggagccctgcaccgtgaacgtggactacatgaacagaaacaacatcgagatgaagtggaagtacgagggcaaggtgctgcacggcgacctgatcgacttcgtgtgcaagcagggctacgacctgagccccctgacccccctgagcgagctgagcgtgcagtgcaacagaggcgaggtgaagtaccccctgtgcaccagaaaggagagcaagggcatgtgcaccagcccccccctgatcaagcacggcgtgatcatcagcagcaccgtggacacctacgagaacggcagcagcgtggagtacagatgcttcgaccaccacttcctggagggcagcagagaggcctactgcctggacggcatgtggaccaccccccccctgtgcctggagccctgcaccctgagcttcaccgagatggagaagaacaacctgctgctgaagtgggacttcgacaacagaccccacatcctgcacggcgagtacatcgagttcatctgcagaggcgacacctaccccgccgagctgtacatcaccggcagcatcctgagaatgcagtgcgacagaggccagctgaagtaccccagatgcatccccagacagagcaccctgagctaccaggagcccctgagaacctag

SEQ ID NO: 77113 - DNA, 3675 bp, Artificial Sequence
  Description of Artificial Sequence: Synthetic coding sequence
atgctgaccaagttcgagaccaagagcgccagagtgaagggcctgagcttccaccccaagagaccctggatcctgaccagcctgcacaacggcgtgatccagctgtgggactacagaatgtgcaccctgatcgacaagttcgacgagcacgacggccccgtgagaggcatcgacttccacaagcagcagcccctgttcgtgagcggcggcgacgactacaagatcaaggtgtggaactacaagctgagaagatgcctgttcaccctgctgggccacctggactacatcagaaccaccttcttccaccacgagtacccctggatcctgagcgccagcgacgaccagaccatcagagtgtggaactggcagagcagaacctgcgtgtgcgtgctgaccggccacaaccactacgtgatgtgcgcccagttccaccccaccgaggacctggtggtgagcgccagcctggaccagaccgtgagagtgtgggacatcagcggcctgagaaagaagaacctgagccccggcgccgtggagagcgacgtgagaggcatcaccggcgtggacctgttcggcaccaccgacgccgtggtgaagcacgtgctggagggccacgacagaggcgtgaactgggccgccttccaccccaccatgcccctgatcgtgagcggcgccgacgacagacaggtgaagatctggagaatgaacgagagcaaggcctgggaggtggacacctgcagaggccactacaacaacgtgagctgcgccgtgttccaccccagacaggagctgatcctgagcaacagcgaggacaagagcatcagagtgtgggacatgagcaagagaaccggcgtgcagaccttcagaagagaccacgacagattctgggtgctggccgcccaccccaacctgaacctgttcgccgccggccacgacggcggcatgatcgtgttcaagctggagagagagagacccgcctacgccgtgcacggcaacatgctgcactacgtgaaggacagattcctgagacagctggacttcaacagcagcaaggacgtggccgtgatgcagctgagaagcggcagcaagttccccgtgttcaacatgagctacaaccccgccgagaacgccgtgctgctgtgcaccagagccagcaacctggagaacagcacctacgacctgtacaccatccccaaggacgccgacagccagaaccccgacgcccccgagggcaagagaagcagcggcctgaccgccgtgtgggtggccagaaacagattcgccgtgctggacagaatgcacagcctgctgatcaagaacctgaagaacgagatcaccaagaaggtgcaggtgcccaactgcgacgagatcttctacgccggcaccggcaacctgctgctgagagacgccgacagcatcaccctgttcgacgtgcagcagaagagaaccctggccagcgtgaagatcagcaaggtgaagtacgtgatctggagcgccgacatgagccacgtggccctgctggccaagcacgccatcgtgatctgcaacagaaagctggacgccctgtgcaacatccacgagaacatcagagtgaagagcggcgcctgggacgagagcggcgtgttcatctacaccaccagcaaccacatcaagtacgccgtgaccaccggcgaccacggcatcatcagaaccctggacctgcccatctacgtgaccagagtgaagggcaacaacgtgtactgcctggacagagagtgcagacccagagtgctgaccatcgaccccaccgagttcaagttcaagctggccctgatcaacagaaagtacgacgaggtgctgcacatggtgagaaacgccaagctggtgggccagagcatcatcgcctacctgcagaagaagggctaccccgaggtggccctgcacttcgtgaaggacgagaagaccagattcagcctggccctggagtgcggcaacatcgagatcgccctggaggccgccaaggccctggacgacaagaactgctgggagaagctgggcgaggtggccctgctgcagggcaaccaccagatcgtggagatgtgctaccagagaaccaagaacttcgacaagctgagcttcctgtacctgatcaccggcaacctggagaagctgagaaagatgatgaagatcgccgagatcagaaaggacatgagcggccactaccagaacgccctgtacctgggcgacgtgagcgagagagtgagaatcctgaagaactgcggccagaagagcctggcctacctgaccgccgccacccacggcctggacgaggaggccgagagcctgaaggagaccttcgaccccgagaaggagaccatccccgacatcgaccccaacgccaagctgctgcagccccccgcccccatcatgcccctggacaccaactggcccctgctgaccgtgagcaagggcttcttcgagggcaccatcgccagcaagggcaagggcggcgccctggccgccgacatcgacatcgacaccgtgggcaccgagggctggggcgaggacgccgagctgcagctggacgaggacggcttcgtggaggccaccgagggcctgggcgacgacgccctgggcaagggccaggaggagggcggcggctgggacgtggaggaggacctggagctgccccccgagctggacatcagccccggcgccgccggcggcgccgaggacggcttcttcgtgccccccaccaagggcaccagccccacccagatctggtgcaacaacagccagctgcccgtggaccacatcctggccggcagcttcgagaccgccatgagactgctgcacgaccaggtgggcgtgatccagttcggcccctacaagcagctgttcctgcagacctacgccagaggcagaaccacctaccaggccctgccctgcctgcccagcatgtacggctaccccaacagaaactggaaggacgccggcctgaagaacggcgtgcccgccgtgggcctgaagctgaacgacctgatccagagactgcagctgtgctaccagctgaccaccgtgggcaagttcgaggaggccgtggagaagttcagaagcatcctgctgagcgtgcccctgctggtggtggacaacaagcaggagatcgccgaggcccagcagctgatcaccatctgcagagagtacatcgtgggcctgagcgtggagaccgagagaaagaagctgcccaaggagaccctggagcagcagaagagaatctgcgagatggccgcctacttcacccacagcaacctgcagcccgtgcacatgatcctggtgctgagaaccgccctgaacctgttcttcaagctgaagaacttcaagaccgccgccaccttcgccagaagactgctggagctgggccccaagcccgaggtggcccagcagaccagaaagatcctgagcgcctgcgagaagaaccccaccgacgcctaccagctgaactacgacatgcacaaccccttcgacatctgcgccgccagctacagacccatctacagaggcaagcccgtggagaagtgccccctgagcggcgcctgctacagccccgagttcaagggccagatctgcagagtgaccaccgtgaccgagatcggcaaggacgtgatcggcctgagaatcagccccctgcagttcagatag

SEQ ID NO: 77114 - DNA, 3702 bp, Artificial Sequence
  Description of Artificial Sequence: Synthetic coding sequence
atgctgaccaagttcgagaccaagagcgccagagtgaagggcctgagcttccaccccaagagaccctggatcctgaccagcctgcacaacggcgtgatccagctgtgggactacagaatgtgcaccctgatcgacaagttcgacgagcacgacggccccgtgagaggcatcgacttccacaagcagcagcccctgttcgtgagcggcggcgacgactacaagatcaaggtgtggaactacaagctgagaagatgcctgttcaccctgctgggccacctggactacatcagaaccaccttcttccaccacgagtacccctggatcctgagcgccagcgacgaccagaccatcagagtgtggaactggcagagcagaacctgcgtgtgcgtgctgaccggccacaaccactacgtgatgtgcgcccagttccaccccaccgaggacctggtggtgagcgccagcctggaccagaccgtgagagtgtgggacatcagcggcctgagaaagaagaacctgagccccggcgccgtggagagcgacgtgagaggcatcaccggcgtggacctgttcggcaccaccgacgccgtggtgaagcacgtgctggagggccacgacagaggcgtgaactgggccgccttccaccccaccatgcccctgatcgtgagcggcgccgacgacagacaggtgaagatctggagaatgaacgagagcaaggcctgggaggtggacacctgcagaggccactacaacaacgtgagctgcgccgtgttccaccccagacaggagctgatcctgagcaacagcgaggacaagagcatcagagtgtgggacatgagcaagagaaccggcgtgcagaccttcagaagagaccacgacagattctgggtgctggccgcccaccccaacctgaacctgttcgccgccggccacgacggcggcatgatcgtgttcaagctggagagagagagacccgcctacgccgtgcacggcaacatgctgcactacgtgaaggacagattcctgagacagctggacttcaacagcagcaaggacgtggccgtgatgcagctgagaagcggcagcaagttccccgtgttcaacatgagctacaaccccgccgagaacgccgtgctgctgtgcaccagagccagcaacctggagaacagcacctacgacctgtacaccatccccaaggacgccgacagccagaaccccgacgcccccgagggcaagagaagcagcggcctgaccgccgtgtgggtggccagaaacagattcgccgtgctggacagaatgcacagcctgctgatcaagaacctgaagaacgagatcaccaagaaggtgcaggtgcccaactgcgacgagatcttctacgccggcaccggcaacctgctgctgagagacgccgacagcatcaccctgttcgacgtgcagcagaagagaaccctggccagcgtgaagatcagcaaggtgaagtacgtgatctggagcgccgacatgagccacgtggccctgctggccaagcacgagcacagctgccccctgcccctgaccgccatcgtgatctgcaacagaaagctggacgccctgtgcaacatccacgagaacatcagagtgaagagcggcgcctgggacgagagcggcgtgttcatctacaccaccagcaaccacatcaagtacgccgtgaccaccggcgaccacggcatcatcagaaccctggacctgcccatctacgtgaccagagtgaagggcaacaacgtgtactgcctggacagagagtgcagacccagagtgctgaccatcgaccccaccgagttcaagttcaagctggccctgatcaacagaaagtacgacgaggtgctgcacatggtgagaaacgccaagctggtgggccagagcatcatcgcctacctgcagaagaagggctaccccgaggtggccctgcacttcgtgaaggacgagaagaccagattcagcctggccctggagtgcggcaacatcgagatcgccctggaggccgccaaggccctggacgacaagaactgctgggagaagctgggcgaggtggccctgctgcagggcaaccaccagatcgtggagatgtgctaccagagaaccaagaacttcgacaagctgagcttcctgtacctgatcaccggcaacctggagaagctgagaaagatgatgaagatcgccgagatcagaaaggacatgagcggccactaccagaacgccctgtacctgggcgacgtgagcgagagagtgagaatcctgaagaactgcggccagaagagcctggcctacctgaccgccgccacccacggcctggacgaggaggccgagagcctgaaggagaccttcgaccccgagaaggagaccatccccgacatcgaccccaacgccaagctgctgcagccccccgcccccatcatgcccctggacaccaactggcccctgctgaccgtgagcaagggcttcttcgagggcaccatcgccagcaagggcaagggcggcgccctggccgccgacatcgacatcgacaccgtgggcaccgagggctggggcgaggacgccgagctgcagctggacgaggacggcttcgtggaggccaccgagggcctgggcgacgacgccctgggcaagggccaggaggagggcggcggctgggacgtggaggaggacctggagctgccccccgagctggacatcagccccggcgccgccggcggcgccgaggacggcttcttcgtgccccccaccaagggcaccagccccacccagatctggtgcaacaacagccagctgcccgtggaccacatcctggccggcagcttcgagaccgccatgagactgctgcacgaccaggtgggcgtgatccagttcggcccctacaagcagctgttcctgcagacctacgccagaggcagaaccacctaccaggccctgccctgcctgcccagcatgtacggctaccccaacagaaactggaaggacgccggcctgaagaacggcgtgcccgccgtgggcctgaagctgaacgacctgatccagagactgcagctgtgctaccagctgaccaccgtgggcaagttcgaggaggccgtggagaagttcagaagcatcctgctgagcgtgcccctgctggtggtggacaacaagcaggagatcgccgaggcccagcagctgatcaccatctgcagagagtacatcgtgggcctgagcgtggagaccgagagaaagaagctgcccaaggagaccctggagcagcagaagagaatctgcgagatggccgcctacttcacccacagcaacctgcagcccgtgcacatgatcctggtgctgagaaccgccctgaacctgttcttcaagctgaagaacttcaagaccgccgccaccttcgccagaagactgctggagctgggccccaagcccgaggtggcccagcagaccagaaagatcctgagcgcctgcgagaagaaccccaccgacgcctaccagctgaactacgacatgcacaaccccttcgacatctgcgccgccagctacagacccatctacagaggcaagcccgtggagaagtgccccctgagcggcgcctgctacagccccgagttcaagggccagatctgcagagtgaccaccgtgaccgagatcggcaaggacgtgatcggcctgagaatcagccccctgcagttcagatag

SEQ ID NO: 77115 - DNA, 2862 bp, Artificial Sequence
  Description of Artificial Sequence: Synthetic coding sequence
atgaccgccgccgagaacgtgtgctacaccctgatcaacgtgcccatggacagcgagccccccagcgagatcagcctgaagaacgacctggagaagggcgacgtgaagagcaagaccgaggccctgaagaaggtgatcatcatgatcctgaacggcgagaagctgcccggcctgctgatgaccatcatcagattcgtgctgcccctgcaggaccacaccatcaagaagctgctgctggtgttctgggagatcgtgcccaagaccacccccgacggcagactgctgcacgagatgatcctggtgtgcgacgcctacagaaaggacctgcagcaccccaacgagttcatcagaggcagcaccctgagattcctgtgcaagctgaaggaggccgagctgctggagcccctgatgcccgccatcagagcctgcctggagcacagacacagctacgtgagaagaaacgccgtgctggccatctacaccatctacagaaacttcgagcacctgatccccgacgcccccgagctgatccacgacttcctggtgaacgagaaggacgccagctgcaagagaaacgccttcatgatgctgatccacgccgaccaggacagagccctggactacctgagcacctgcatcgaccaggtgcagaccttcggcgacatcctgcagctggtgatcgtggagctgatctacaaggtgtgccacgccaaccccagcgagagagccagattcatcagatgcatctacaacctgctgcagagcagcagccccgccgtgaagtacgaggccgccggcaccctggtgaccctgagcagcgcccccaccgccatcaaggccgccgcccagtgctacatcgacctgatcatcaaggagagcgacaacaacgtgaagctgatcgtgctggacagactgatcgagctgaaggagcaccccgcccacgagagagtgctgcaggacctggtgatggacatcctgagagtgctgagcacccccgacctggaggtgagaaagaagaccctgcagctggccctggacctggtgagcagcagaaacgtggaggagctggtgatcgtgctgaagaaggaggtgatcaagaccaacaacgtgagcgagcacgaggacaccgacaagtacagacagctgctggtgagaaccctgcacagctgcagcgtgagattccccgacatggccgccaacgtgatccccgtgctgatggagttcctgagcgacaacaacgaggccgccgccgccgacgtgctggagttcgtgagagaggccatccagagattcgacaacctgagaatgctgatcgtggagaagatgctggaggtgttccacgccatcaagagcgtgaagatctacagaggcgccctgtggatcctgggcgagtactgcagcaccaaggaggacatccagagcgtgatgaccgagatcagaagaagcctgggcgagatccccatcgtggagagcgagatcaagaaggaggccggcgagctgaagcccgaggaggagatcaccgtgggccccgtgcagaagctggtgaccgagatgggcacctacgccacccagagcgccctgagcagcagcagacccaccaagaaggaggaggacagaccccccctgagaggcttcctgctggacggcgacttcttcgtggccgccagcctggccaccaccctgaccaagatcgccctgagatacgtggccctggtgcaggagaagaagaagcagaacagcttcgtggccgaggccatgctgctgatggccaccatcctgcacctgggcaagagcagcctgcccaagaagcccatcaccgacgacgacgtggacagaatcagcctgtgcctgaaggtgctgagcgagtgcagccccctgatgaacgacatcttcaacaaggagtgcagacagagcctgagccacatgctgagcgccaagctggaggaggagaagctgagccagaagaaggagagcgagaagagaaacgtgaccgtgcagcccgacgaccccatcagcttcatgcagctgaccgccaagaacgagatgaactgcaaggaggaccagttccagctgagcctgctggccgccatgggcaacacccagagaaaggaggccgccgaccccctggccagcaagctgaacaaggtgacccagctgaccggcttcagcgaccccgtgtacgccgaggcctacgtgcacgtgaaccagtacgacatcgtgctggacgtgctggtggtgaaccagaccagcgacaccctgcagaactgcaccctggagctggccaccctgggcgacctgaagctggtggagaagcccagccccctgaccctggccccccacgacttcgccaacatcaaggccaacgtgaaggtggccagcaccgagaacggcatcatcttcggcaacatcgtgtacgacgtgagcggcgccgccagcgacagaaactgcgtggtgctgagcgacatccacatcgacatcatggactacatccagcccgccacctgcaccgacgccgagttcagacagatgtgggccgagttcgagtgggagaacaaggtgaccgtgaacaccaacatggtggacctgaacgactacctgcagcacatcctgaagagcaccaacatgaagtgcctgacccccgagaaggccctgagcggctactgcggcttcatggccgccaacctgtacgccagaagcatcttcggcgaggacgccctggccaacgtgagcatcgagaagcccatccaccagggccccgacgccgccgtgaccggccacatcagaatcagagccaagagccagggcatggccctgagcctgggcgacaagatcaacctgagccagaagaagaccagcatctag

SEQ ID NO: 77116 - DNA, 2862 bp, Artificial Sequence; identical to SEQ ID NO: 77115
  Description of Artificial Sequence: Synthetic coding sequence

SEQ ID NO: 77117 - DNA, 2721 bp, Artificial Sequence
  Description of Artificial Sequence: Synthetic coding sequence
atgcccctgagactggacatcaagagaaagctgaccgccagaagcgacagagtgaagagcgtggacctgcaccccaccgagccctggatgctggccagcctgtacaacggcagcgtgtgcgtgtggaaccacgagacccagaccctggtgaagaccttcgaggtgtgcgacctgcccgtgagagccgccaagttcgtggccagaaagaactgggtggtgaccggcgccgacgacatgcagatcagagtgttcaactacaacaccctggagagagtgcacatgttcgaggcccacagcgactacatcagatgcatcgccgtgcaccccacccagcccttcatcctgaccagcagcgacgacatgctgatcaagctgtgggactgggacaagaagtggagctgcagccaggtgttcgagggccacacccactacgtgatgcagatcgtgatcaaccccaaggacaacaaccagttcgccagcgccagcctggacagaaccatcaaggtgtggcagctgggcagcagcagccccaacttcaccctggagggccacgagaagggcgtgaactgcatcgactactacagcggcggcgacaagccctacctgatcagcggcgccgacgacagactggtgaagatctgggactaccagaacaagacctgcgtgcagaccctggagggccacgcccagaacgtgagctgcgccagcttccaccccgagctgcccatcatcatcaccggcagcgaggacggcaccgtgagaatctggcacagcagcacctacagactggagagcaccctgaactacggcatggagagagtgtggtgcgtggccagcctgagaggcagcaacaacgtggccctgggctacgacgagggcagcatcatcgtgaagctgggcagagaggagcccgccatgagcatggacgccaacggcaagatcatctgggccaagcacagcgaggtgcagcaggccaacctgaaggccatgggcgacgccgagatcaaggacggcgagagactgcccctggccgtgaaggacatgggcagctgcgagatctacccccagaccatccagcacaaccccaacggcagattcgtggtggtgtgcggcgacggcgagtacatcatctacaccgccatggccctgagaaacaagagcttcggcagcgcccaggagttcgcctgggcccacgacagcagcgagtacgccatcagagagagcaacagcatcgtgaagatcttcaagaacttcaaggagaagaagagcttcaagcccgacttcggcgccgagagcatctacggcggcttcctgctgggcgtgagaagcgtgaacggcctggccttctacgactgggacaacaccgagctgatcagaagaatcgagatccagcccaagcacatcttctggagcgacagcggcgagctggtgtgcatcgccaccgaggagagcttcttcatcctgaagtacctgagcgagaaggtgctggccgcccaggagacccacgagggcgtgaccgaggacggcatcgaggacgccttcgaggtgctgggcgagatccaggagatcgtgaagaccggcctgtgggtgggcgactgcttcatctacaccagcagcgtgaacagactgaactactacgtgggcggcgagatcgtgaccatcgcccacctggacagaaccatgtacctgctgggctacatccccaaggacaacagactgtacctgggcgacaaggagctgaacatcatcagctacagcctgctggtgagcgtgctggagtaccagaccgccgtgatgagaagagacttcagcatggccgacaaggtgctgcccaccatccccaaggagcagagaaccagagtggcccacttcctggagaagcagggcttcaagcagcaggccctgaccgtgagcaccgaccccgagcacagattcgagctggccctgcagctgggcgagctgaagatcgcctaccagctggccgtggaggccgagagcgagcagaagtggaagcagctggccgagctggccatcagcaagtgccagttcggcctggcccaggagtgcctgcaccacgcccaggactacggcggcctgctgctgctggccaccgccagcggcaacgccaacatggtgaacaagctggccgagggcgccgagagagacggcaagaacaacgtggccttcatgagctacttcctgcagggcaaggtggacgcctgcctggagctgctgatcagaaccggcagactgcccgaggccgccttcctggccagaacctacctgcccagccaggtgagcagagtggtgaagctgtggagagagaacctgagcaaggtgaaccagaaggccgccgagagcctggccgaccccaccgagtacgagaacctgttccccggcctgaaggaggccttcgtggtggaggagtgggtgaaggagacccacgccgacctgtggcccgccaagcagtaccccctggtgacccccaacgaggagagaaacgtgatggaggagggcaaggacttccagcccagcagaagcaccgcccagcaggagctggacggcaagcccgccagccccacccccgtgatcgtggccagccacaccgccaacaaggaggagaagagcctgctggagctggaggtggacctggacaacctggagctggaggacatcgacaccaccgacatcaacctggacgaggacatcctggacgactag

SEQ ID NO: 77118 - DNA, 2634 bp, Artificial Sequence
  Description of Artificial Sequence: Synthetic coding sequence
atgctggccagcctgtacaacggcagcgtgtgcgtgtggaaccacgagacccagaccctggtgaagaccttcgaggtgtgcgacctgcccgtgagagccgccaagttcgtggccagaaagaactgggtggtgaccggcgccgacgacatgcagatcagagtgttcaactacaacaccctggagagagtgcacatgttcgaggcccacagcgactacatcagatgcatcgccgtgcaccccacccagcccttcatcctgaccagcagcgacgacatgctgatcaagctgtgggactgggacaagaagtggagctgcagccaggtgttcgagggccacacccactacgtgatgcagatcgtgatcaaccccaaggacaacaaccagttcgccagcgccagcctggacagaaccatcaaggtgtggcagctgggcagcagcagccccaacttcaccctggagggccacgagaagggcgtgaactgcatcgactactacagcggcggcgacaagccctacctgatcagcggcgccgacgacagactggtgaagatctgggactaccagaacaagacctgcgtgcagaccctggagggccacgcccagaacgtgagctgcgccagcttccaccccgagctgcccatcatcatcaccggcagcgaggacggcaccgtgagaatctggcacagcagcacctacagactggagagcaccctgaactacggcatggagagagtgtggtgcgtggccagcctgagaggcagcaacaacgtggccctgggctacgacgagggcagcatcatcgtgaagctgggcagagaggagcccgccatgagcatggacgccaacggcaagatcatctgggccaagcacagcgaggtgcagcaggccaacctgaaggccatgggcgacgccgagatcaaggacggcgagagactgcccctggccgtgaaggacatgggcagctgcgagatctacccccagaccatccagcacaaccccaacggcagattcgtggtggtgtgcggcgacggcgagtacatcatctacaccgccatggccctgagaaacaagagcttcggcagcgcccaggagttcgcctgggcccacgacagcagcgagtacgccatcagagagagcaacagcatcgtgaagatcttcaagaacttcaaggagaagaagagcttcaagcccgacttcggcgccgagagcatctacggcggcttcctgctgggcgtgagaagcgtgaacggcctggccttctacgactgggacaacaccgagctgatcagaagaatcgagatccagcccaagcacatcttctggagcgacagcggcgagctggtgtgcatcgccaccgaggagagcttcttcatcctgaagtacctgagcgagaaggtgctggccgcccaggagacccacgagggcgtgaccgaggacggcatcgaggacgccttcgaggtgctgggcgagatccaggagatcgtgaagaccggcctgtgggtgggcgactgcttcatctacaccagcagcgtgaacagactgaactactacgtgggcggcgagatcgtgaccatcgcccacctggacagaaccatgtacctgctgggctacatccccaaggacaacagactgtacctgggcgacaaggagctgaacatcatcagctacagcctgctggtgagcgtgctggagtaccagaccgccgtgatgagaagagacttcagcatggccgacaaggtgctgcccaccatccccaaggagcagagaaccagagtggcccacttcctggagaagcagggcttcaagcagcaggccctgaccgtgagcaccgaccccgagcacagattcgagctggccctgcagctgggcgagctgaagatcgcctaccagctggccgtggaggccgagagcgagcagaagtggaagcagctggccgagctggccatcagcaagtgccagttcggcctggcccaggagtgcctgcaccacgcccaggactacggcggcctgctgctgctggccaccgccagcggcaacgccaacatggtgaacaagctggccgagggcgccgagagagacggcaagaacaacgtggccttcatgagctacttcctgcagggcaaggtggacgcctgcctggagctgctgatcagaaccggcagactgcccgaggccgccttcctggccagaacctacctgcccagccaggtgagcagagtggtgaagctgtggagagagaacctgagcaaggtgaaccagaaggccgccgagagcctggccgaccccaccgagtacgagaacctgttccccggcctgaaggaggccttcgtggtggaggagtgggtgaaggagacccacgccgacctgtggcccgccaagcagtaccccctggtgacccccaacgaggagagaaacgtgatggaggagggcaaggacttccagcccagcagaagcaccgcccagcaggagctggacggcaagcccgccagccccacccccgtgatcgtggccagccacaccgccaacaaggaggagaagagcctgctggagctggaggtggacctggacaacctggagctggaggacatcgacaccaccgacatcaacctggacgaggacatcctggacgactag

SEQ ID NO: 77119 - DNA, 927 bp, Artificial Sequence
  Description of Artificial Sequence: Synthetic coding sequence
atggccccccccgcccccggccccgccagcggcggcagcggcgaggtggacgagctgttcgacgtgaagaacgccttctacatcggcagctaccagcagtgcatcaacgaggcccagagagtgaagctgagcagccccgagagagacgtggagagagacgtgttcctgtacagagcctacctggcccagagaaagttcggcgtggtgctggacgagatcaagcccagcagcgcccccgagctgcaggccgtgagaatgttcgccgactacctggcccacgagagcagaagagacagcatcgtggccgagctggacagagagatgagcagaagcgtggacgtgaccaacaccaccttcctgctgatggccgccagcatctacctgcacgaccagaaccccgacgccgccctgagagccctgcaccagggcgacagcctggagtgcaccgccatgaccgtgcagatcctgctgaagctggacagactggacctggccagaaaggagctgaagagaatgcaggacctggacgaggacgccaccctgacccagctggccaccgcctgggtgagcctggccaccggcggcgagaagctgcaggacgcctactacatcttccaggagatggccgacaagtgcagccccaccctgctgctgctgaacggccaggccgcctgccacatggcccagggcagatgggaggccgccgagggcctgctgcaggaggccctggacaaggacagcggctaccccgagaccctggtgaacctgatcgtgctgagccagcacctgggcaagccccccgaggtgaccaacagatacctgagccagctgaaggacgcccacagaagccaccccttcatcaaggagtaccaggccaaggagaacgacttcgacagactggtgctgcagtacgcccccagcgcctag

SEQ ID NO: 77120 - DNA, 771 bp, Artificial Sequence
  Description of Artificial Sequence: Synthetic coding sequence
atggccccccccgcccccggccccgccagcggcggcagcggcgaggtggacgagctgttcgacgtgaagaacgccttctacatcggcagctaccagcagtgcatcaacgaggcccagagagtgaagctgagcagccccgagagagacgtggagagagacgtgttcctgtacagagcctacctggcccagagaaagttcggcgtggtgctggacgagatcaagcccagcagcgcccccgagctgcaggccgtgagaatgttcgccgactacctggcccacgagagcagaagagacagcatcgtggccgagctggacagagagatgagcagaagcgtggacgtgaccaacaccaccttcctgctgatggccgccagcatctacctgcacgaccagaaccccgacgccgccctgagagccctgcaccagggcgacagcctggagtgcaccgccatgaccgtgcagatcctgctgaagctggacagactggacctggccagaaaggagctgaagagaatgcaggacctggacgaggacgccaccctgacccagctggccaccgcctgggtgagcctggccaccgacagcggctaccccgagaccctggtgaacctgatcgtgctgagccagcacctgggcaagccccccgaggtgaccaacagatacctgagccagctgaaggacgcccacagaagccaccccttcatcaaggagtaccaggccaaggagaacgacttcgacagactggtgctgcagtacgcccccagcgcctag

SEQ ID NO: 77121 - DNA, 774 bp, Artificial Sequence
  Description of Artificial Sequence: Synthetic coding sequence
atggccccccccgcccccggccccgccagcggcggcagcggcgaggtggacgagctgttcgacgtgaagaacgccttctacatcggcagctaccagcagtgcatcaacgaggcccagagagtgaagctgagcagccccgagagagacgtggagagagacgtgttcctgtacagagcctacctggcccagagaaagttcggcgtggtgctggacgagatcaagcccagcagcgcccccgagctgcaggccgtgagaatgttcgccgactacctggcccacgagagcagaagcaccgccatgaccgtgcagatcctgctgaagctggacagactggacctggccagaaaggagctgaagagaatgcaggacctggacgaggacgccaccctgacccagctggccaccgcctgggtgagcctggccaccggcggcgagaagctgcaggacgcctactacatcttccaggagatggccgacaagtgcagccccaccctgctgctgctgaacggccaggccgcctgccacatggcccagggcagatgggaggccgccgagggcctgctgcaggaggccctggacaaggacagcggctaccccgagaccctggtgaacctgatcgtgctgagccagcacctgggcaagccccccgaggtgaccaacagatacctgagccagctgaaggacgcccacagaagccaccccttcatcaaggagtaccaggccaaggagaacgacttcgacagactggtgctgcagtacgcccccagcgcctag

SEQ ID NO: 77122 - DNA, 924 bp, Artificial Sequence
  Description of Artificial Sequence: Synthetic coding sequence
atggccccccccgcccccgccggcctgagaggcagcggcgaggtggacgagctgttcgacgtgaagaacgccttctacatcggcagctaccagcagtgcatcaacgaggcccagagagtgaagctgagcagccccgagagagacgtggagagagacgtgttcctgtacagagcctacctggcccagagaaagttcggcgtggtgctggacgagatcaagcccagcagcgcccccgagctgcaggccgtgagaatgttcgccgactacctggcccacgagagcagaagagacagcatcgtggccgagctggacagagagatgagcagaagcgtggacgtgaccaacaccaccttcctgctgatggccgccagcatctacctgcacgaccagaaccccgacgccgccctgagagccctgcaccagggcgacagcctggagtgcaccgccatgaccgtgcagatcctgctgaagctggacagactggacctggccagaaaggagctgaagagaatgcaggacctggacgaggacgccaccctgacccagctggccaccgcctgggtgagcctggccaccggcggcgagaagctgcaggacgcctactacatcttccaggagatggccgacaagtgcagccccaccctgctgctgctgaacggccaggccgcctgccacatggcccagggcagatgggaggccgccgagggcctgctgcaggaggccctggacaaggacagcggctaccccgagaccctggtgaacctgatcgtgctgagccagcacctgggcaagccccccgaggtgaccaacagatacctgagccagctgaaggacgcccacagaagccaccccttcatcaaggagtaccaggccaaggagaacgacttcgacagactggtgctgcagtacgcccccagcgcctag

SEQ ID NO: 77123 - DNA, 741 bp, Artificial Sequence
  Description of Artificial Sequence: Synthetic coding sequence
atgatcaagaagttcgacaagaaggacgaggagagcggcagcggcagcaaccccttccagcacctggagaagagcgccgtgctgcaggaggccagaatcttcaacgagacccccatcaaccccagaagatgcctgcacatcctgaccaagatcctgtacctgctgaaccagggcgagcacttcggcaccaccgaggccaccgaggccttcttcgccatgaccagactgttccagagcaacgaccagaccctgagaagaatgtgctacctgaccatcaaggagatggccaccatcagcgaggacgtgatcatcgtgaccagcagcctgaccaaggacatgaccggcaaggaggacgtgtacagaggccccgccatcagagccctgtgcagaatcaccgacggcaccatgctgcaggccatcgagagatacatgaagcaggccatcgtggacaaggtgagcagcgtgagcagcagcgccctggtgagcagcctgcacatgatgaagatcagctacgacgtggtgaagagatggatcaacgaggcccaggaggccgccagcagcgacaacatcatggtgcagtaccacgccctgggcgtgctgtaccacctgagaaagaacgacagactggccgtgagcaagatgctgaacaagttcaccaagagcggcctgaagagccagttcgcctactgcatgctgatcagaatcgccagcagactgctgaaggagaccgaggacggctag

SEQ ID NO: 77124 - DNA, 468 bp, Artificial Sequence
  Description of Artificial Sequence: Synthetic coding sequence
tgagccggcagcttcagctgcaccatgaagttcaccgtgagagactgcgaccccaacaccggcgtgcccgacgaggacggctacgacgacgagtacgtgctggaggacctggaggtgaccgtgagcgaccacatccagaaggtgctgaagcccaacttcgccgccgcctgggaggaggtgggcgacaccttcgagaaggaggagaccttcgccctgagcagcaccaagaccctggaggaggccgtgaacaacatcatcaccttcctgggcatgcagccctgcgagagaagcgacaaggtgcccgagaacaagaacagccacagcctgtacctggccggcatcttcagaggcggctacgacctgctggtgagaagcagactggccctggccgacggcgtgaccatgcaggtgaccgtgagaagcaaggagagaacccccgtggacgtgatcctggccagcgtgggctag

SEQ ID NO: 77125 - DNA, 741 bp, Artificial Sequence; identical to SEQ ID NO: 77123
  Description of Artificial Sequence: Synthetic coding sequence

SEQ ID NO: 77126 - DNA, 1080 bp, Artificial Sequence
  Description of Artificial Sequence: Synthetic coding sequence
atgtacttcaagagagccgccagagccttccccgtgctgctgaccggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacgccatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgctgggcagaaacctggacaaggacatcctgaagcagctgttcatcgccaccgtgaccgagaccgagaagcagtggaccaccagattccaggaggaccaggtgtgcacctag

SEQ ID NO: 77127 - DNA, 1188 bp, Artificial Sequence
  Description of Artificial Sequence: Synthetic coding sequence
atgctgcccgccgtgggcagcgccgacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacgccatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgctgggcagaaacctggacaaggacatcctgaagcagctgttcatcgccaccgtgaccgagaccgagaagcagtggaccaccagattccaggaggaccaggtgtgcacctag

SEQ ID NO: 77128 - DNA, 543 bp, Artificial Sequence
  Description of Artificial Sequence: Synthetic coding sequence
atgctgcccgccgtgggcagcgccgacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaaggtgaagtaccactag

SEQ ID NO: 77129 - DNA, 1044 bp, Artificial Sequence
  Description of Artificial Sequence: Synthetic coding sequence
atgctgcccgccgtgggcagcgccgacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagaagcatcaacggcctgggccagatcctggagacccagagaagcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgctgggcagaaacctggacaaggacatcctgaagcagctgttcatcgccaccgtgaccgagaccgagaagcagtggaccaccagattccaggaggaccaggtgtgcacctag

SEQ ID NO: 77130 - DNA, 753 bp, Artificial Sequence
  Description of Artificial Sequence: Synthetic coding sequence
atgctgcccgccgtgggcagcgccgacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacgccatcctgatcaacaagaccgacctggtgcccgaggaggacgtgaagaagctgagaaccaccatcagatacgagatgatcagcgtgctgagcgcctacagaagcatgctgtacacccagaacatcttctacagcgactgctgccccgtggagacctag

SEQ ID NO: 77131 - DNA, 234 bp, Artificial Sequence
  Description of Artificial Sequence: Synthetic coding sequence
atgtacttcaagagagccgccagagccttccccgtgctgctgaccggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaagtag

SEQ ID NO: 77132 - DNA, 342 bp, Artificial Sequence
  Description of Artificial Sequence: Synthetic coding sequence
atgctgcccgccgtgggcagcgccgacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaagtag

SEQ ID NO: 77133 - DNA, 1131 bp, Artificial Sequence
  Description of Artificial Sequence: Synthetic coding sequence
atgctgcccgccgtgggcagcgccgacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacgccatcctgatcaacaagaccgacctggtgcccgaggaggacgtgaagaagctgagaaccaccatcagaagcatcaacggcctgggccagatcctggagacccagagaagcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgctgggcagaaacctggacaaggacatcctgaagcagctgttcatcgccaccgtgaccgagaccgagaagcagtggaccaccagattccaggaggaccaggtgtgcacctag

SEQ ID NO: 77134 - DNA, 483 bp, Artificial Sequence
  Description of Artificial Sequence: Synthetic coding sequence
atgctgcccgccgtgggcagcgccgacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcatcatcaccatcgtggacagcaagtacggcctgaaggtgaagtaccactag

SEQ ID NO: 77135 - DNA, 441 bp, Artificial Sequence
  Description of Artificial Sequence: Synthetic coding sequence
atgtacttcaagagagccgccagagccttccccgtgctgctgaccggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacagcggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaaggccaagaactggaccacctag

SEQ ID NO: 77136 - DNA, 1188 bp, Artificial Sequence
  Description of Artificial Sequence: Synthetic coding sequence
atgctgcccgccgtgggcagcgccgacgaggaggaggaccccgccgaggaggactgccccgagctggtgcccatggagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctggccgaggagaagcccgacggcctgatcaacgaggccaccagacaggtggccctggccgacgccatcctgatcaacaagaccgacctggtgcccgaggaggacgtgaagaagctgagagccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgctgggcagaaacctggacaaggacatcctgaagcagctgttcatcgccaccgtgaccgagaccgagaagcagtggaccacccacttcaaggaggaccaggtgtgcacctag

SEQ ID NO: 77137 - DNA, 543 bp, Artificial Sequence
  Description of Artificial Sequence: Synthetic coding sequence
atgctgcccgccgtgggcagcgccgacgaggaggaggaccccgccgaggaggactgccccgagctggtgcccatggagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaaggtgaagtaccactag

SEQ ID NO: 77138 - DNA, 1131 bp, Artificial Sequence
  Description of Artificial Sequence: Synthetic coding sequence
atgctgcccgccgtgggcagcgccgacgaggaggaggaccccgccgaggaggactgccccgagctggtgcccatggagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctggccgaggagaagcccgacggcctgatcaacgaggccaccagacaggtggccctggccgacgccatcctgatcaacaagaccgacctggtgcccgaggaggacgtgaagaagctgagagccaccatcagaagcatcaacggcctgggccagatcctggagacccagagaagcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgctgggcagaaacctggacaaggacatcctgaagcagctgttcatcgccaccgtgaccgagaccgagaagcagtggaccacccacttcaaggaggaccaggtgtgcacctag

SEQ ID NO: 77139 - DNA, 1080 bp, Artificial Sequence
  Description of Artificial Sequence: Synthetic coding sequence
atgtacttcaagagagccgccagagccttccccgtgctgctgaccggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgactacatcctgctggagaccaccggcctggccgaccccggcgccgtggccagcatgttctgggtggacgccgagctgggcagcgacatctacctggacggcatcatcaccatcgtggacagcaagtacggcctgaagcacctggccgaggagaagcccgacggcctgatcaacgaggccaccagacaggtggccctggccgacgccatcctgatcaacaagaccgacctggtgcccgaggaggacgtgaagaagctgagagccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgctgggcagaaacctggacaaggacatcctgaagcagctgttcatcgccaccgtgaccgagaccgagaagcagtggaccacccacttcaaggaggaccaggtgtgcacctag

SEQ ID NO: 77140 - DNA, 483 bp, Artificial Sequence
  Description of Artificial Sequence: Synthetic coding sequence
atgctgcccgccgtgggcagcgccgacgaggaggaggaccccgccgaggaggactgccccgagctggtgcccatggagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagttcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgactacatcctgctggagaccaccggcctggccgaccccggcatcatcaccatcgtggacagcaagtacggcctgaaggtgaagtaccactag

SEQ ID NO: 77141 - DNA, 1188 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 77142 - DNA, 258 bp, Artificial Sequence
  Description of Artificial Sequence: Synthetic coding sequence
atggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 77143 - DNA, 258 bp, Artificial Sequence; identical to SEQ ID NO: 77142
  Description of Artificial Sequence: Synthetic coding sequence

SEQ ID NO: 77144 - DNA, 132 bp, Artificial Sequence
  Description of Artificial Sequence: Synthetic coding sequence
atgttcatccagaacctgctgtgggagaagaacgtgagaaacaaggacaaccactgcatggaggtgatcagactgaaggtgcagttcaccgtggccgacttctggaccaagagcttcagctggctgctgtag

SEQ ID NO: 77145 - DNA, 1128 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 77146 - DNA, 1080 bp, Artificial Sequence
  Description of Artificial Sequence: Synthetic coding sequence
atgtacttcaagagagcccccagagccttccccgtgctgctgaccggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 77147 - DNA, 234 bp, Artificial Sequence
  Description of Artificial Sequence: Synthetic coding sequence
atgtacttcaagagagcccccagagccttccccgtgctgctgaccggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaagtag

SEQ ID NO: 77148 - DNA, 1131 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 77149 - DNA, 225 bp, Artificial Sequence
  Description of Artificial Sequence: Synthetic coding sequence
atgtacttcaagagagcccccagagccttccccgtgctgctgaccggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgctag

SEQ ID NO: 77150 - DNA, 543 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaaggtgaagtaccactag

SEQ ID NO: 77151 - DNA, 1044 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagaagcatcaacggcctgggccagatcctggagacccagagaagcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 77152 - DNA, 987 bp, Artificial Sequence
  Description of Artificial Sequence: Synthetic coding sequence
atgctgggcagcagagccgccggcttcgccagaggcctgagagccgtggccctggcctggctgcccggctggagaggcagaagcttcgccctggccagagccgccggcgccccccacggcggcgacctgcagccccccgcctgccccgagcccagaggcagacagctgagcctgagcgccgccgccgtggtggacagcgcccccagacccctgcagccctacctgagactgatgagactggacaagcccatcggcacctggctgctgtacctgccctgcacctggagcatcggcctggccgccgagcccggctgcttccccgactggtacatgctgagcctgttcggcaccggcgccatcctgatgagaggcgccggctgcaccatcaacgacatgtgggaccaggactacgacaagaaggtgaccagaaccgccaacagacccatcgccgccggcgacatcagcaccttccagagcttcgtgttcctgggcggccagctgaccctggccctgggcgtgctgctgtgcctgaactactacagcatcgccctgggcgccggcagcctgctgctggtgatcacctaccccctgatgaagagaatcagctactggccccagctggccctgggcctgaccttcaactggggcgccctgctgggctggagcgccatcaagggcagctgcgaccccagcgtgtgcctgcccctgtacttcagcggcgtgatgtggaccctgatctacgacaccatctacgcccaccaggacaagagagacgacgtgctgatcggcctgaagagcaccgccctgagattcggcgagaacaccaagccctggctgagcggcttcagcgtggccatgctgggcgccctgagcctggtgggcgtgaacagcggccagaccgccccctactacgccgccctgggcgccgtgggcgcccacctgacccaccagaagtggggcctggagatcctgcccagactggtgtag

SEQ ID NO: 77153 - DNA, 1266 bp, Artificial Sequence
  Description of Artificial Sequence: Synthetic coding sequence
atgacccccatcagccaggtgagaatgagaaagggcagcgcccacaccgccgcccagcccggcagactgggcctgcaccccgccggcgccaccgcccacgcctgcagaggcatgaccagcatcagagccagacccggcctgaccagcgccatgctgggcagcagagccgccggcttcgccagaggcctgagagccgtggccctggcctggctgcccggctggagaggcagaagcttcgccctggccagagccgccggcgccccccacggcggcgacctgcagccccccgcctgccccgagcccagaggcagacagctgagcctgagcgccgccgccgtggtggacagcgcccccagacccctgcagccctacctgagactgatgagactggacaagcccatcggcacctggctgctgtacctgccctgcacctggagcatcggcctggccgccgagcccggctgcttccccgactggtacatgctgagcctgttcggcaccggcgccatcctgatgagaggcgccggctgcaccatcaacgacatgtgggaccaggactacgacaagaaggtgaccagaaccgccaacagacccatcgccgccggcgacatcagcaccttccagagcttcgtgttcctgggcggccagctgaccctggccctgggcgtgctgctgtgcctgaactactacagcatcgccctgggcgccggcagcctgctgctggtgatcacctaccccctgatgaagagaatcagctactggccccagctggccctgggcctgaccttcaactggggcgccctgctgggctggagcgccatcaagggcagctgcgaccccagcgtgtgcctgcccctgtacttcagcggcgtgatgtggaccctgatctacgacaccatctacgcccaccaggacaagagagacgacgtgctgatcggcctgaagagcaccgccctgagattcggcgagaacaccaagccctggctgagcggcttcagcgtggccatgctgggcgccctgagcctggtgggcgtgaacagcggccagaccgccccctactacgccgccctgggcgccgtgggcgcccacctgacccaccagatctacaccctggacatccacagacccgaggactgctggaacaagttcatcagcaacagaaccctgggcctgatcgtgttcctgggcatcgtgctgggcaacctgtggaaggagaagaagaccgacaagaccaagaagggcatcgagaacaagatcgagaactag

SEQ ID NO: 77154 - DNA, 1155 bp, Artificial Sequence
  Description of Artificial Sequence: Synthetic coding sequence
atgaccagcatcagagccagacccggcctgaccagcgccatgctgggcagcagagccgccggcttcgccagaggcctgagagccgtggccctggcctggctgcccggctggagaggcagaagcttcgccctggccagagccgccggcgccccccacggcggcgacctgcagccccccgcctgccccgagcccagaggcagacagctgagcctgagcgccgccgccgtggtggacagcgcccccagacccctgcagccctacctgagactgatgagactggacaagcccatcggcacctggctgctgtacctgccctgcacctggagcatcggcctggccgccgagcccggctgcttccccgactggtacatgctgagcctgttcggcaccggcgccatcctgatgagaggcgccggctgcaccatcaacgacatgtgggaccaggactacgacaagaaggtgaccagaaccgccaacagacccatcgccgccggcgacatcagcaccttccagagcttcgtgttcctgggcggccagctgaccctggccctgggcgtgctgctgtgcctgaactactacagcatcgccctgggcgccggcagcctgctgctggtgatcacctaccccctgatgaagagaatcagctactggccccagctggccctgggcctgaccttcaactggggcgccctgctgggctggagcgccatcaagggcagctgcgaccccagcgtgtgcctgcccctgtacttcagcggcgtgatgtggaccctgatctacgacaccatctacgcccaccaggacaagagagacgacgtgctgatcggcctgaagagcaccgccctgagattcggcgagaacaccaagccctggctgagcggcttcagcgtggccatgctgggcgccctgagcctggtgggcgtgaacagcggccagaccgccccctactacgccgccctgggcgccgtgggcgcccacctgacccaccagatctacaccctggacatccacagacccgaggactgctggaacaagttcatcagcaacagaaccctgggcctgatcgtgttcctgggcatcgtgctgggcaacctgtggaaggagaagaagaccgacaagaccaagaagggcatcgagaacaagatcgagaactag

SEQ ID NO: 77155 - DNA, 798 bp, Artificial Sequence
  Description of Artificial Sequence: Synthetic coding sequence
atggccaccctgctgagacccgtgctgagaagactgtgcggcctgcccggcctgcagagacccgccgccgagatgcccctgagagccagaagcgacggcgccggccccctgtacagccaccacctgcccaccagccccctgcagaagggcctgctggccgccggcagcgccgccatggccctgtacaacccctacagacacgacatggtggccgtgctgggcgagaccaccggccacagaaccctgaaggtgctgagagaccagatgagaagagaccccgagggcgcccagatcctgcaggagagacccagaatcagcaccagcaccctggacctgggcaagctgcagagcctgcccgagggcagcctgggcagagagtacctgagattcctggacgtgaacagagtgagccccgacaccagagcccccaccagattcgtggacgacgaggagctggcctacgtgatccagagatacagagaggtgcacgacatgctgcacaccctgctgggcatgcccaccaacatcctgggcgagatcgtggtgaagtggttcgaggccgtgcagaccggcctgcccatgtgcatcctgggcgccttcttcggccccatcagactgggcgcccagagcctgcaggtgctggtgagcgagctgatcccctgggccgtgcagaacggcagaagagccccctgcgtgctgaacctgtactacgagagaagatgggagcagagcctgagagccctgagagaggagctgggcatcaccgccccccccatgcacgtgcagggcctggcctag

SEQ ID NO: 77156 - DNA, 456 bp, Artificial Sequence
  Description of Artificial Sequence: Synthetic coding sequence
atggccaccctgctgagacccgtgctgagaagactgtgcggcctgcccggcctgcagagacccgccgccgagatgcccctgagagccagaagcgacggcgccggccccctgtacagccaccacctgcccaccagccccctgcagaagggcctgctggccgccggcagcgccgccatggccctgtacaacccctacagacacgacatggtggccgtgctgggcgagaccaccggccacagaaccctgaaggtgctgagagaccagatgagaagagaccccgagggcgcccagatcctgcaggagagacccagaatcagcaccagcaccctggacctgggcaagctgcagagcctgcccgagggcagcctgggcagagagtacctgagattcctggacgtgaacgtgagcttccagctgctgtgcatctggcagagccccgacagaaccgaggagtag

SEQ ID NO: 77157 - DNA, 654 bp, Artificial Sequence
  Description of Artificial Sequence: Synthetic coding sequence
atgagctgcgccggcgccgccgccgcccccagactgtggagactgagacccggcgccagaagaagcctgagcgcctacggcagaagaaccagcgtgagattcagaagcagcggcatgaccctggacaacatcagcagagccgccgtggacagaatcatcagagtggaccacgccggcgagtacggcgccaacagaatctacgccggccagatggccgtgctgggcagaaccagcgtgggccccgtgatccagaagatgtgggaccaggagaaggaccacctgaagaagttcaacgagctgatggtgaccttcagagtgagacccaccgtgctgatgcccctgtggaacgtgctgggcttcgccctgggcgccggcaccgccctgctgggcaaggagggcgccatggcctgcaccgtggccgtggaggagagcatcgcccaccactacaacaaccagatcagaaccctgatggaggaggaccccgagaagtacgaggagctgctgcagctgatcaagaagttcagagacgaggagctggagcaccacgacatcggcctggaccacgacgccgagctggcccccgcctacgccgtgctgaagagcatcatccaggccggctgcagagtggccatctacctgagcgagagactgtag

SEQ ID NO: 77158 - DNA, 540 bp, Artificial Sequence
  Description of Artificial Sequence: Synthetic coding sequence
atgaccctggacaacatcagcagagccgccgtggacagaatcatcagagtggaccacgccggcgagtacggcgccaacagaatctacgccggccagatggccgtgctgggcagaaccagcgtgggccccgtgatccagaagatgtgggaccaggagaaggaccacctgaagaagttcaacgagctgatggtgaccttcagagtgagacccaccgtgctgatgcccctgtggaacgtgctgggcttcgccctgggcgccggcaccgccctgctgggcaaggagggcgccatggcctgcaccgtggccgtggaggagagcatcgcccaccactacaacaaccagatcagaaccctgatggaggaggaccccgagaagtacgaggagctgctgcagctgatcaagaagttcagagacgaggagctggagcaccacgacatcggcctggaccacgacgccgagctggcccccgcctacgccgtgctgaagagcatcatccaggccggctgcagagtggccatctacctgagcgagagactgtag

SEQ ID NO: 77159 - DNA, 957 bp, Artificial Sequence
  Description of Artificial Sequence: Synthetic coding sequence
atggccgccgccgccgtgagcggcgccctgggcagagccggctggagactgctgcagctgagatgcctgcccgtggccagatgcagacaggccctggtgcccagagccttccacgccagcgccgtgggcctgagaagcagcgacgagcagaagcagcagccccccaacagcttcagccagcagcacagcgagacccagggcgccgagaagcccgaccccgagagcagccacagcccccccagatacaccgaccagggcggcgaggaggaggaggactacgagagcgaggagcagctgcagcacagaatcctgaccgccgccctggagttcgtgcccgcccacggctggaccgccgaggccatcgccgagggcgcccagagcctgggcctgagcagcgccgccgccagcatgttcggcaaggacggcagcgagctgatcctgcacttcgtgacccagtgcaacaccagactgaccagagtgctggaggaggagcagaagctggtgcagctgggccaggccgagaagagaaagaccgaccagttcctgagagacgccgtggagaccagactgagaatgctgatcccctacatcgagcactggcccagagccctgagcatcctgatgctgccccacaacatccccagcagcctgagcctgctgaccagcatggtggacgacatgtggcactacgccggcgaccagagcaccgacttcaactggtacaccagaagagccatgctggccgccatctacaacaccaccgagctggtgatgatgcaggacagcagccccgacttcgaggacacctggagattcctggagaacagagtgaacgacgccatgaacatgggccacaccgccaagcaggtgaagagcaccggcgaggccctggtgcagggcctgatgggcgccgccgtgaccctgaagaacctgaccggcctgaaccagagaagatag

SEQ ID NO: 77160 - DNA, 1743 bp, Artificial Sequence
  Description of Artificial Sequence: Synthetic coding sequence
atgttcgccggcctgcaggacctgggcgtggccaacggcgaggacctgaaggagaccctgaccaactgcaccgagcccctgaaggccatcgagcagttccagaccgagaacggcgtgctgctgcccagcctgcagagcgccctgcccttcctggacctgcacggcacccccagactggagttccaccagagcgtgttcgacgagctgagagacaagctgctggagagagtgagcgccatcgccagcgagggcaaggccgaggagagatacaagaagctggaggacctgctggagaagagcttcagcctggtgaagatgcccagcctgcagcccgtggtgatgtgcgtgatgaagcacctgcccaaggtgcccgagaagaagctgaagctggtgatggccgacaaggagctgtacagagcctgcgccgtggaggtgaagagacagatctggcaggacaaccaggccctgttcggcgacgaggtgagccccctgctgaagcagtacatcctggagaaggagagcgccctgttcagcaccgagctgagcgtgctgcacaacttcttcagccccagccccaagaccagaagacagggcgaggtggtgcagagactgaccagaatggtgggcaagaacgtgaagctgtacgacatggtgctgcagttcctgagaaccctgttcctgagaaccagaaacgtgcactactgcaccctgagagccgagctgctgatgagcctgcacgacctggacgtgggcgagatctgcaccgtggacccctgccacaagttcacctggtgcctggacgcctgcatcagagagagattcgtggacagcaagagagccagagagctgcagggcttcctggacggcgtgaagaagggccaggagcaggtgctgggcgacctgagcatgatcctgtgcgaccccttcgccatcaacaccctggccctgagcaccgtgagacacctgcaggagctggtgggccaggagaccctgcccagagacagccccgacctgctgctgctgctgagactgctggccctgggccagggcgcctgggacatgatcgacagccaggtgttcaaggagcccaagatggaggtggagctgatcaccagattcctgcccatgctgatgagcttcctggtggacgactacaccttcaacgtggaccagaagctgcccgccgaggagaaggcccccgtgagctaccccaacaccctgcccgagagcttcaccaagttcctgcaggagcagagaatggcctgcgaggtgggcctgtactacgtgctgcacatcaccaagcagagaaacaagaacgccctgctgagactgctgcccggcctggtggagaccttcggcgacctggccttcggcgacatcttcctgcacctgctgaccggcaacctggccctgctggccgacgagttcgccctggaggacttctgcagcagcctgttcgacggcttcttcctgaccgccagccccagaaaggagaacgtgcacagacacgccctgagactgctgatccacctgcaccccagagtggcccccagcaagctggaggccctgcagaaggccctggagcccaccggccagagcggcgaggccgtgaaggagctgtacagccagctgggcgagaagctggagcagctggaccacagaaagcccagccccgcccaggccgccgagacccccgccctggagctgcccctgcccagcgtgcccgcccccgcccccctgtag

SEQ ID NO: 77161 - DNA, 501 bp, Artificial Sequence
  Description of Artificial Sequence: Synthetic coding sequence
atggccagcggcgtgaccgtgaacgacgaggtgatcaaggtgttcaacgacatgaaggtgagaaagagcagcacccaggaggagatcaagaagagaaagaaggccgtgctgttctgcctgagcgacgacaagagacagatcatcgtggaggaggccaagcagatcctggtgggcgacatcggcgacaccgtggaggacccctacaccagcttcgtgaagctgctgcccctgaacgactgcagatacgccctgtacgacgccacctacgagaccaaggagagcaagaaggaggacctggtgttcatcttctgggcccccgagagcgcccccctgaagagcaagatgatctacgccagcagcaaggacgccatcaagaagaagttcaccggcatcaagcacgagtggcaggtgaacggcctggacgacatcaaggacagaagcaccctgggcgagaagctgggcggcaacgtggtggtgagcctggagggcaagcccctgtag

SEQ ID NO: 77162 - DNA, 501 bp, Artificial Sequence; identical to SEQ ID NO: 77161
  Description of Artificial Sequence: Synthetic coding sequence

SEQ ID NO: 77163 - DNA, 1722 bp, Artificial Sequence
  Description of Artificial Sequence: Synthetic coding sequence
atgagaagatacgacagaggcctgaagaccctggagaacctgctggccagcatcagaaagggcaacgccatcgacgaggccgacatccccccccccgtggccatcggcaagggccccgccagcacccccacctacagccccgcccccacccagcccgcccccagaatcgccagcgcccccgagcccagagtgaccctggagggccccagcgccaccgcccccgccagcagccccggcctggccaagccccagatgccccccggcccctgcagccccggccccctggcccagctgcagagcagacagagagactacaagctggccgccctgcacgccaagcagcagcagctggccttcctggagggcagaaagaagcagctgctgcaggccgccctgagagccaagcagaagaacgacgtggagggcgccaagatgcacctgagacaggccaagggcctggagcccatgctggaggccagcagaaacggcctgcccgtggacatcaccaaggtgccccccgcccccgtgaacaaggacgacttcgccctggtgcagagacccggccccggcctgagccaggaggccgccagaagatacggcgagctgaccaagctgatcagacagcagcacgagatgtgcctgaaccacagcaaccagttcacccagctgggcaacatcaccgagaccaccaagttcgagaagctggccgaggactgcaagagaagcatggacatcctgaagcaggccttcgtgagaggcctgcccacccccaccgccagattcgagcagagaaccttcagcgtgatcaagatcttccccgacctgagcagcaacgacatgctgctgttcatcgtgaagggcatcaacctgcccaccccccccggcctgagccccggcgacctggacgtgttcgtgagattcgacttcccctaccccaacgtggaggaggcccagaaggacaagaccagcgtgatcaagaacaccgacagccccgagttcaaggagcagttcaagctgtgcatcaacagaagccacagaggcttcagaagagccatccagaccaagggcatcaagttcgaggtggtgcacaagggcggcctgttcaagaccgacagagtgctgggcaccgcccagctgaagctggacgccctggagatcgcctgcgaggtgagagagatcctggaggtgctggacggcagaagacccaccggcggcagactggaggtgatggtgagaatcagagagcccctgaccgcccagcagctggagaccaccaccgagagatggctggtgatcgaccccgtgcccgccgccgtgcccaccgtggccggccccaagggcaaggccccccccgtgcccgcccccgccagagagagcggcaacagaagcgccagacccctgcacagcctgagcgtgctggccttcgaccaggagagactggagagaaagatcctggccctgagacaggccagaagacccgtgccccccgaggtggcccagcagtaccaggacatcatgcagagaagccagtggcagagagcccagctggagcagggcggcgtgggcatcagaagagagtacgccgcccagctggagagacagctgcagttctacaccgaggccgccagaagactgggcaacgacggcagcagagacgccgccaaggaggccctgtacagaagaaacctggtggagagcgagctgcagagactgagaagatag

SEQ ID NO: 77164 - DNA, 2856 bp, Artificial Sequence
  Description of Artificial Sequence: Synthetic coding sequence
atgcacaagagaaagggcccccccggcccccccggcagaggcgccgccgccgccagacagctgggcctgctggtggacctgagccccgacggcctgatgatccccgaggacggcgccaacgacgaggagctggaggccgagttcctggccctggtgggcggccagccccccgccctggagaagctgaagggcaagggccccctgcccatggaggccatcgagaagatggccagcctgtgcatgagagaccccgacgaggacgaggaggagggcaccgacgaggacgacctggaggccgacgacgacctgctggccgagctgaacgaggtgctgggcgaggagcagaaggccagcgagacccccccccccgtggcccagcccaagcccgaggccccccaccccggcctggagaccaccctgcaggagagactggccctgtaccagaccgccatcgagagcgccagacaggccggcgacagcgccaagatgagaagatacgacagaggcctgaagaccctggagaacctgctggccagcatcagaaagggcaacgccatcgacgaggccgacatccccccccccgtggccatcggcaagggccccgccagcacccccacctacagccccgcccccacccagcccgcccccagaatcgccagcgcccccgagcccagagtgaccctggagggccccagcgccaccgcccccgccagcagccccggcctggccaagccccagatgccccccggcccctgcagccccggccccctggcccagctgcagagcagacagagagactacaagctggccgccctgcacgccaagcagcagggcgacaccaccgccgccgccagacacttcagagtggccaagagcttcgacgccgtgctggaggccctgagcagaggcgagcccgtggacctgagctgcctgccccccccccccgaccagctgccccccgacccccccagcccccccagccagccccccacccccgccaccgcccccagcaccaccgaggtgccccccccccccagaaccctgctggaggccctggagcagagaatggagagataccaggtggccgccgcccaggccaagagcaagggcgaccagagaaaggccagaatgcacgagagaatcgtgaagcagtaccaggacgccatcagagcccacaaggccggcagagccgtggacgtggccgagctgcccgtgccccccggcttcccccccatccagggcctggaggccaccaagcccacccagcagagcctggtgggcgtgctggagaccgccatgaagctggccaaccaggacgagggccccgaggacgaggaggacgaggtgcccaagaagcagaacagccccgtggcccccaccgcccagcccaaggccccccccagcagaaccccccagagcggcagcgcccccaccgccaaggccccccccaaggccaccagcaccagagcccagcagcagctggccttcctggagggcagaaagaagcagctgctgcaggccgccctgagagccaagcagaagaacgacgtggagggcgccaagatgcacctgagacaggccaagggcctggagcccatgctggaggccagcagaaacggcctgcccgtggacatcaccaaggtgccccccgcccccgtgaacaaggacgacttcgccctggtgcagagacccggccccggcctgagccaggaggccgccagaagatacggcgagctgaccaagctgatcagacagcagcacgagatgtgcctgaaccacagcaaccagttcacccagctgggcaacatcaccgagaccaccaagttcgagaagctggccgaggactgcaagagaagcatggacatcctgaagcaggccttcgtgagaggcctgcccacccccaccgccagattcgagcagagaaccttcagcgtgatcaagatcttccccgacctgagcagcaacgacatgctgctgttcatcgtgaagggcatcaacctgcccaccccccccggcctgagccccggcgacctggacgtgttcgtgagattcgacttcccctaccccaacgtggaggaggcccagaaggacaagaccagcgtgatcaagaacaccgacagccccgagttcaaggagcagttcaagctgtgcatcaacagaagccacagaggcttcagaagagccatccagaccaagggcatcaagttcgaggtggtgcacaagggcggcctgttcaagaccgacagagtgctgggcaccgcccagctgaagctggacgccctggagatcgcctgcgaggtgagagagatcctggaggtgctggacggcagaagacccaccggcggcagactggaggtgatggtgagaatcagagagcccctgaccgcccagcagctggagaccaccaccgagagatggctggtgatcgaccccgtgcccgccgccgtgcccacccaggtggccggccccaagggcaaggccccccccgtgcccgcccccgccagagagagcggcaacagaagcgccagacccctgcacagcctgagcgtgctggccttcgaccaggagagactggagagaaagatcctggccctgagacaggccagaagacccgtgccccccgaggtggcccagcagtaccaggacatcatgcagagaagccagtggcagagagcccagctggagcagggcggcgtgggcatcagaagagagtacgccgcccagctggagagacagctgcagttctacaccgaggccgccagaagactgggcaacgacggcagcagagacgccgccaaggaggccctgtacagaagaaacctggtggagagcgagctgcagagactgagaagatag

SEQ ID NO: 77165 - DNA, 711 bp, Artificial Sequence
  Description of Artificial Sequence: Synthetic coding sequence
tggcacagccccgacggcctgatgatccccgaggacggcgccaacgacgaggagctggaggccgagttcctggccctggtgggcggccagccccccgccctggagaagctgaagggcaagggccccctgcccatggaggccatcgagaagatggccagcctgtgcatgagagaccccgacgaggacgaggaggagggcaccgacgaggacgacctggaggccgacgacgacctgctggccgagctgaacgaggtgctgggcgaggagcagaaggccagcgagacccccccccccgtggcccagcccaagcccgaggccccccaccccggcctggagaccaccctgcaggagagactggccctgtaccagaccgccatcgagagcgccagacaggccggcgacagcgccaagatgagaagatacgacagaggcctgaagaccctggagaacctgctggccagcatcagaaagggcaacgccatcgacgaggccgacatccccccccccgtggccatcggcaagggccccgccagcacccccacctacagccccgcccccacccagcccgcccccagaatcgccagcgcccccgagcccagagtgaccctggagggccccagcgccaccgcccccgccagcagccccggcctggccaagccccagatgccccccggcccctgcagccccggccccctggcccagctgcagtag

SEQ ID NO: 77166 - DNA, 1116 bp, Artificial Sequence
  Description of Artificial Sequence: Synthetic coding sequence
atgccccccggcccctgcagccccggccccctggcccagctgcagagcagacagagagactacaagctggccgccctgcacgccaagcagcagggcgacaccaccgccgccgccagacacttcagagtggccaagagcttcgacgccgtgctggaggccctgagcagaggcgagcccgtggacctgagctgcctgccccccccccccgaccagctgccccccgacccccccagcccccccagccagccccccacccccgccaccgcccccagcaccaccgaggtgccccccccccccagaaccctgctggaggccctggagcagagaatggagagataccaggtggccgccgcccaggccaagagcaagggcgaccagagaaaggccagaatgcacgagagaatcgtgaagcagtaccaggacgccatcagagcccacaaggccggcagagccgtggacgtggccgagctgcccgtgccccccggcttcccccccatccagggcctggaggccaccaagcccacccagcagagcctggtgggcgtgctggagaccgccatgaagctggccaaccaggacgagggccccgaggacgaggaggacgaggtgcccaagaagcagaacagccccgtggcccccaccgcccagcccaaggccccccccagcagaaccccccagagcggcagcgcccccaccgccaaggccccccccaaggccaccagcaccagagcccagcagcagctggccttcctggagggcagaaagaagcagctgctgcaggccgccctgagagccaagcagaagaacgacgtggagggcgccaagatgcacctgagacaggccaagggcctggagcccatgctggaggccagcagaaacggcctgcccgtggacatcaccaaggtgccccccgcccccgtgaacaaggacgacttcgccctggtgcagagacccggccccggcctgagccaggaggccgccagaagatacggcgagctgaccaagctgatcagacagcagcacgagatgtgcctgaaccacagcaaccagttcacccagctgggcaacatcaccgagaccaccaaggccaacatggtgaagccctgcttctactag

SEQ ID NO: 77167 - DNA, 4539 bp, Artificial Sequence
  Description of Artificial Sequence: Synthetic coding sequence
atggtgagcgagaagagccacctgggcaacccccaggagcccgtgcaggaggagcccaagaccagactgctgagcatgaccgtgagaagaggccccagaagcctgccccccatccccagcaccagcagaaccggcttcgccgagttcagcatgagaggcagaatgagagagaagctgcaggccgccagaagcaaggccgagagcgccctgctgcaggagatccccacccccagacccagaagactgagaagccccagcaagaaggagctggagaccgagttcggcaccgagcccggcaaggaggtggagagaacccagcaggaggtggacagccagagctacagcagagtgaagttccacgacagcgccagaaagatcaagcccaagccccaggtgccccccggcttccccagcgccgaggaggcctacaacttcttcaccttcaacttcgaccccgagcccgagggcagcgaggagaagcccaaggccagacacagagccggcaccaaccaggaggaggaggagggcgaggaggaggagccccccgcccagggcggcggcaaggagatggacgaggaggagctgctgaacggcgacgacgccgaggacttcctgctgggcctggaccacgtggccgacgacttcgtggccgtgagacccgccgactacgagagcatccacgacagactgcagatggagagagagatgctgttcatccccagcagacagaccgtgcccacctacaagaagctgcccgagaacgtgcagcccagattcctggaggacgagggcctgtacaccggcgtgagacccgaggtggccagaaccaaccagaacatcatggagaacagactgctgatgcaggaccccgagagaagatggttcggcgacgacggcagaatcctggccctgcccaaccccatcaagcccttccccagcagaccccccgtgctgacccaggagcagagcatcaaggccgagctggagaccctgtacaagaaggccgtgaagtacgtgcacagcagccagcacgtgatcagaagcggcgacccccccggcaacttccagctggacatcgacatcagcggcctgatcttcacccaccacccctgcttcagcagagagcacgtgctggccgccaagctggcccagctgtacgaccagtacctggccagacaccagagaaacaaggccaagttcctgaccgacaagctgcaggccctgagaaacgccgtgcagaccggcctggaccccgagaagccccaccagagcctggacaccatccagaagaccatcaacgagtacaagagcgagatcagacagaccagaaagttcagagacgccgagcaggagaaggacagaaccctgctgaagaccatcatcaaggtgtggaaggagatgaagagcctgagagagttccagagattcaccaacacccccctgaagctggtgctgagaaaggagaaggccgaccagaaggccgacgaggaggcctacgaggccgagatccaggccgagatcagcgagctgctggaggagcacaccgaggagtacgcccagaagatggaggagtacagaaccagcctgcagcagtggaaggcctggagaaaggtgcagagagccaagaagaagaagagaaagcaggccgccgaggagcaccccggcgacgagatcgccgagccctaccccgaggaggacctggtgaagcccagcccccccgagcccaccgacagagccgtgatcgagcaggaggtgagagagagagccgcccagagcagaagaagaccctgggagcccaccctggtgcccgagctgagcctggccggcagcgtgacccccaacgaccagtgccccagagccgaggtgagcagaagagaggacgtgaagaagagaagcgtgtacctgaaggtgctgttcaacaacaaggaggtgagcagaaccgtgagcagacccctgggcgccgacttcagagtgcacttcggccagatcttcaacctgcagatcgtgaactggcccgagagcctgaccctgcaggtgtacgagaccgtgggccacagcagccccaccctgctggccgaggtgttcctgcccatccccgagaccaccgtggtgaccggcagagcccccaccgaggaggtggagttcagcagcaaccagcacgtgaccctggaccacgagggcgtgggcagcggcgtgcccttcagcttcgaggccgacggcagcaaccagctgaccctgatgaccagcggcaaggtgagccacagcgtggcctgggccatcggcgagaacggcatccccctgatcccccccctgagccagcagaacatcggcttcagaagcgccctgaagaaggccgacgccatcagcagcatcggcaccagcggcctgaccgacatgaagaagctggccaagtgggccgccgagagcaagctggaccccaacgaccccaacaacgcccccctgatgcagctgatcagcgtggccaccagcggcgagagctacgtgcccgacttcttcagactggagcagctgcagcaggagttcaacttcgtgagcgaccaggagctgaacagaagcaagagattcagactgctgcacctgagaagccaggaggtgcccgagttcagaaactacaagcaggtgcccgtgtacgacagagagatcatggagaaggtgttccaggactacgagaagagactgagagacagaaacgtgatcgagaccaaggagcacatcgacacccacagagccatcgtggccaagtacctgcagcaggtgagagagagcgtgatcaacagattcctgatcgccaagcagtacttcctgctggccgacatgatcgtggaggaggaggtgcccaacatcagcatcctgggcctgagcctgttcaagctggccgagcagaagagacccctgagacccagaagaaagggcagaaagaaggtgaccgcccagaacctgagcgacggcgacatcaagctgctggtgaacatcgtgagagcctacgacatccccgtgagaaagcccgccgtgagcaagttccagcagcccagcagaagcagcagaatgttcagcgagaagcacgccgccagccccagcacctacagccccacccacaacgccgactaccccctgggccaggtgctggtgagacccttcgtggaggtgagcttccagagaaccgtgtgccacaccaccaccgccgagggccccaaccccagctggaacgaggagctggagctgcccttcagagcccccaacggcgactacagcaccgccagcctgcagagcgtgaaggacgtggtgttcatcaacatcttcgacgaggtgctgcacgacgtgctggaggacgacagagagagaggcagcggcatccacaccagaatcgagagacactggctgggctgcgtgaagatgcccttcagcaccatctacttccaggccagattcgagagccaggaggacgagaagctgctgcaggccaccgagaagttccaggccgagtgcgccctgaagttccccaacagacagtgcctgaccaccgtgatcgacatcagcggcaagaccgtgttcatcaccagatacctgaagcccctgaaccccccccaggagctgctgaacgtgtaccccaacaacctgcaggccaccgccgagctggtggccagatacgtgagcctgatccccttcctgcccgacaccgtgagcttcggcggcatctgcgacctgtggagcaccagcgaccagttcctggacctgctggccggcgacgaggaggagcacgccgtgctgctgtgcaactacttcctgagcctgggcaagaaggcctggctgctgatgggcaacgccatccccgagggccccaccgcctacgtgctgacctgggagcagggcagatacctgatctggaacccctgcagcggccacttctacggccagttcgacaccttctgccccctgaagaacgtgggctgcctgatcggccccgacaacatctggttcaacatccagagatacgagagccccctgagaatcaacttcgacgtgaccagacccaagctgtggaagagcttcttcagcagaagcctgccctaccccggcctgagcagcgtgcagcccgaggagctgatctaccagagaagcgacaaggccgccgccgccgagctgcaggacagaatcgagaagatcctgaaggagaagatcatggactggagacccagacacctgaccagatggaacagatactgcaccagcaccctgagacacttcctgcccctgctggagaagagccagggcgaggacgtggaggacgaccacagagccgagctgctgaagcagctgggcgactacagattcagcggcttccccctgcacatgccctacagcgaggtgaagcccctgatcgacgccgtgtacagcaccggcgtgcacaacatcgacgtgcccaacgtggagttcgccctggccgtgtacatccacccctaccccaagaacgtgctgagcgtgtggatctacgtggccagcctgatcagaaacagatag

SEQ ID NO: 77168 - DNA, 4863 bp, Artificial Sequence
  Description of Artificial Sequence: Synthetic coding sequence
atgaaccccagagaggagaaggtgaagatcatcaccgaggagttcatcgagaacgacgaggacgccgacatgggcagacagaacaagaacagcaaggtgagaagacagcccagaaagaagcagccccccaccgccgtgcccaaggagatggtgagcgagaagagccacctgggcaacccccaggagcccgtgcaggaggagcccaagaccagactgctgagcatgaccgtgagaagaggccccagaagcctgccccccatccccagcaccagcagaaccggcttcgccgagttcagcatgagaggcagaatgagagagaagctgcaggccgccagaagcaaggccgagagcgccctgctgcaggagatccccacccccagacccagaagactgagaagccccagcaagaaggagctggagaccgagttcggcaccgagcccggcaaggaggtggagagaacccagcaggaggtggacagccagagctacagcagagtgaagttccacgacagcgccagaaagatcaagcccaagccccaggtgccccccggcttccccagcgccgaggaggcctacaacttcttcaccttcaacttcgaccccgagcccgagggcagcgaggagaagcccaaggccagacacagagccggcaccaaccaggaggaggaggagggcgaggaggaggagccccccgcccagggcggcggcaaggagatggacgaggaggagctgctgaacggcgacgacgccgaggacttcctgctgggcctggaccacgtggccgacgacttcgtggccgtgagacccgccgactacgagagcatccacgacagactgcagatggagagagagatgctgttcatccccagcagacagaccgtgcccacctacaagaagctgcccgagaacgtgcagcccagattcctggaggacgagggcctgtacaccggcgtgagacccgaggtggccagaaccaaccagaacatcatggagaacagactgctgatgcaggaccccgagagaagatggttcggcgacgacggcagaatcctggccctgcccaaccccatcaagcccttccccagcagaccccccgtgctgacccaggagcagagcatcaaggccgagctggagaccctgtacaagaaggccgtgaagtacgtgcacagcagccagcacgtgatcagaagcggcgacccccccggcaacttccagctggacatcgacatcagcggcctgatcttcacccaccacccctgcttcagcagagagcacgtgctggccgccaagctggcccagctgtacgaccagtacctggccagacaccagagaaacaaggccaagttcctgaccgacaagctgcaggccctgagaaacgccgtgcagaccggcctggaccccgagaagccccaccagagcctggacaccatccagaagaccatcaacgagtacaagagcgagatcagacagaccagaaagttcagagacgccgagcaggagaaggacagaaccctgctgaagaccatcatcaaggtgtggaaggagatgaagagcctgagagagttccagagattcaccaacacccccctgaagctggtgctgagaaaggagaaggccgaccagaaggccgacgaggaggcctacgaggccgagatccaggccgagatcagcgagctgctggaggagcacaccgaggagtacgcccagaagatggaggagtacagaaccagcctgcagcagtggaaggcctggagaaaggtgcagagagccaagaagaagaagagaaagcaggccgccgaggagcaccccggcgacgagatcgccgagccctaccccgaggaggacctggtgaagcccagcccccccgagcccaccgacagagccgtgatcgagcaggaggtgagagagagagccgcccagagcagaagaagaccctgggagcccaccctggtgcccgagctgagcctggccggcagcgtgacccccaacgaccagtgccccagagccgaggtgagcagaagagaggacgtgaagaagagaagcgtgtacctgaaggtgctgttcaacaacaaggaggtgagcagaaccgtgagcagacccctgggcgccgacttcagagtgcacttcggccagatcttcaacctgcagatcgtgaactggcccgagagcctgaccctgcaggtgtacgagaccgtgggccacagcagccccaccctgctggccgaggtgttcctgcccatccccgagaccaccgtggtgaccggcagagcccccaccgaggaggtggagttcagcagcaaccagcacgtgaccctggaccacgagggcgtgggcagcggcgtgcccttcagcttcgaggccgacggcagcaaccagctgaccctgatgaccagcggcaaggtgagccacagcgtggcctgggccatcggcgagaacggcatccccctgatcccccccctgagccagcagaacatcggcttcagaagcgccctgaagaaggccgacgccatcagcagcatcggcaccagcggcctgaccgacatgaagaagctggccaagtgggccgccgagagcaagctggaccccaacgaccccaacaacgcccccctgatgcagctgatcagcgtggccaccagcggcgagagctacgtgcccgacttcttcagactggagcagctgcagcaggagttcaacttcgtgagcgaccaggagctgaacagaagcaagagattcagactgctgcacctgagaagccaggaggtgcccgagttcagaaactacaagcaggtgcccgtgtacgacagagagatcatggagaaggtgttccaggactacgagaagagactgagagacagaaacgtgatcgagaccaaggagcacatcgacacccacagagccatcgtggccaagtacctgcagcaggtgagagagagcgtgatcaacagattcctgatcgccaagcagtacttcctgctggccgacatgatcgtggaggaggaggtgcccaacatcagcatcctgggcctgagcctgttcaagctggccgagcagaagagacccctgagacccagaagaaagggcagaaagaaggtgaccgcccagaacctgagcgacggcgacatcaagctgctggtgaacatcgtgagagcctacgacatccccgtgagaaagcccgccgtgagcaagttccagcagcccagcagaagcagcagaatgttcagcgagaagcacgccgccagccccagcacctacagccccacccacaacgccgactaccccctgggccaggtgctggtgagacccttcgtggaggtgagcttccagagaaccgtgtgccacaccaccaccgccgagggccccaaccccagctggaacgaggagctggagctgcccttcagagcccccaacggcgactacagcaccgccagcctgcagagcgtgaaggacgtggtgttcatcaacatcttcgacgaggtgctgcacgacgtgctggaggacgacagagagagaggcagcggcatccacaccagaatcgagagacactggctgggctgcgtgaagatgcccttcagcaccatctacttccaggccagaatcgacggcaccttcaagatcgacatcccccccgtgctgctgggctacagcaaggagagaaacatgatcctggagagaggcttcgacagcgtgagaagcctgagcgagggcagctacatcaccctgttcatcaccatcgagccccagctggtgcccggcgagagcatcagagagaagttcgagagccaggaggacgagaagctgctgcaggccaccgagaagttccaggccgagtgcgccctgaagttccccaacagacagtgcctgaccaccgtgatcgacatcagcggcaagaccgtgttcatcaccagatacctgaagcccctgaaccccccccaggagctgctgaacgtgtaccccaacaacctgcaggccaccgccgagctggtggccagatacgtgagcctgatccccttcctgcccgacaccgtgagcttcggcggcatctgcgacctgtggagcaccagcgaccagttcctggacctgctggccggcgacgaggaggagcacgccgtgctgctgtgcaactacttcctgagcctgggcaagaaggcctggctgctgatgggcaacgccatccccgagggccccaccgcctacgtgctgacctgggagcagggcagatacctgatctggaacccctgcagcggccacttctacggccagttcgacaccttctgccccctgaagaacgtgggctgcctgatcggccccgacaacatctggttcaacatccagagatacgagagccccctgagaatcaacttcgacgtgaccagacccaagctgtggaagagcttcttcagcagaagcctgccctaccccggcctgagcagcgtgcagcccgaggagctgatctaccagagaagcgacaaggccgccgccgccgagctgcaggacagaatcgagaagatcctgaaggagaagatcatggactggagacccagacacctgaccagatggaacagatactgcaccagcaccctgagacacttcctgcccctgctggagaagagccagggcgaggacgtggaggacgaccacagagccgagctgctgaagcagctgggcgactacagattcagcggcttccccctgcacatgccctacagcgaggtgaagcccctgatcgacgccgtgtacagcaccggcgtgcacaacatcgacgtgcccaacgtggagttcgccctggccgtgtacatccacccctaccccaagaacgtgctgagcgtgtggatctacgtggccagcctgatcagaaacagatag

SEQ ID NO: 77169 - DNA, 4863 bp, Artificial Sequence; identical to SEQ ID NO: 77168
  Description of Artificial Sequence: Synthetic coding sequence

SEQ ID NO: 77170 - DNA, 4539 bp, Artificial Sequence; identical to SEQ ID NO: 77167
  Description of Artificial Sequence: Synthetic coding sequence

SEQ ID NO: 77171 - DNA, 369 bp, Artificial Sequence
  Description of Artificial Sequence: Synthetic coding sequence
atgaaccccagagaggagaaggtgaagatcatcaccgaggagttcatcgagaacgacgaggacgccgacatgggcagacagaacaagaacagcaaggtgagaagacagcccagaaagaagcagaagcccacccccttcagcagagcctgctggcagatcctgccccacctgagcgccggcgtgcccctgctgggctgggagcaccccgtgcagggcaagagcttccaggccaccaactgctgcccccagggcaacggcgtgagaaagatccccccctggcagccccccggcgcctgcgccggcggcgcccaggaccccccccccgagtacgacagccccgagagacccaccgagagagccggctgctag

SEQ ID NO: 77172 - DNA, 4863 bp, Artificial Sequence; identical to SEQ ID NO: 77168
  Description of Artificial Sequence: Synthetic coding sequence

SEQ ID NO: 77173 - DNA, 369 bp, Artificial Sequence; identical to SEQ ID NO: 77171
  Description of Artificial Sequence: Synthetic coding sequence

SEQ ID NO: 77174 - DNA, 4539 bp, Artificial Sequence; identical to SEQ ID NO: 77167
  Description of Artificial Sequence: Synthetic coding sequence

SEQ ID NO: 77175 - DNA, 369 bp, Artificial Sequence; identical to SEQ ID NO: 77171
  Description of Artificial Sequence: Synthetic coding sequence

SEQ ID NO: 77176 - DNA, 1767 bp, Artificial Sequence
  Description of Artificial Sequence: Synthetic coding sequence
atgaaccccagagaggagaaggtgaagatcatcaccgaggagttcatcgagaacgacgaggacgccgacatgggcagacagaacaagaacagcaaggtgagaagacagcccagaaagaagcagccccccaccgccgtgcccaaggagatggtgagcgagaagagccacctgggcaacccccaggagcccgtgcaggaggagcccaagaccagactgctgagcatgaccgtgagaagaggccccagaagcctgccccccatccccagcaccagcagaaccggcttcgccgagttcagcatgagaggcagaatgagagagaagctgcaggccgccagaagcaaggccgagagcgccctgctgcaggagatccccacccccagacccagaagactgagaagccccagcaagaaggagctggagaccgagttcggcaccgagcccggcaaggaggtggagagaacccagcaggaggtggacagccagagctacagcagagtgaagttccacgacagcgccagaaagatcaagcccaagccccaggtgccccccggcttccccagcgccgaggaggcctacaacttcttcaccttcaacttcgaccccgagcccgagggcagcgaggagaagcccaaggccagacacagagccggcaccaaccaggaggaggaggagggcgaggaggaggagccccccgcccagggcggcggcaaggagatggacgaggaggagctgctgaacggcgacgacgccgaggacttcctgctgggcctggaccacgtggccgacgacttcgtggccgtgagacccgccgactacgagagcatccacgacagactgcagatggagagagagatgctgttcatccccagcagacagaccgtgcccacctacaagaagctgcccgagaacgtgcagcccagattcctggaggacgagggcctgtacaccggcgtgagacccgaggtggccagaaccaaccagaacatcatggagaacagactgctgatgcaggaccccgagagaagatggttcggcgacgacggcagaatcctggccctgcccaaccccatcaagcccttccccagcagaccccccgtgctgacccaggagcagagcatcaaggccgagctggagaccctgtacaagaaggccgtgaagtacgtgcacagcagccagcacgtgatcagaagcggcgacccccccggcaacttccagctggacatcgacatcagcggcctgatcttcacccaccacccctgcttcagcagagagcacgtgctggccgccaagctggcccagctgtacgaccagtacctggccagacaccagagaaacaaggccaagttcctgaccgacaagctgcaggccctgagaaacgccgtgcagaccggcctggaccccgagaagccccaccagagcctggacaccatccagaagaccatcaacgagtacaagagcgagatcagacagaccagaaagttcagagacgccgagcaggagaaggacagaaccctgctgaagaccatcatcaaggtgtggaaggagatgaagagcctgagagagttccagagattcaccaacacccccctgaagctggtgctgagaaaggagaaggccgaccagaaggccgacgaggaggcctacgaggccgagatccaggccgagatcagcgagctgctggaggagcacaccgaggagtacgcccagaagatggaggagtacagaaccagcctgcagcagtggaaggcctggagaaaggtgcagtag

SEQ ID NO: 77177 - DNA, 336 bp, Artificial Sequence
  Description of Artificial Sequence: Synthetic coding sequence
atgaaccccagagaggagaaggtgaagatcatcaccgaggagttcatcgagaacgacgaggacgccgacatgggcagacagaacaagaacagcaaggtgagaagacagcccagaaagaagcagccccccaccgccgtgcccaaggagatggtgagcgagaagagccacctgggcaacccccaggagcccgtgcaggaggagcccaagaccagactgctgagcatgaccgtgagaagaggccccagaagagagctggtggtgaagaagagcctgggcagacccggcaccgtgacccacgtgtgcaaccccagcaccctggagggcagaggcggctag

SEQ ID NO: 77178 - DNA, 882 bp, Artificial Sequence
  Description of Artificial Sequence: Synthetic coding sequence
atggccctggtgagcgccgacagcagaatcgccgagctgctgaccgagctgcaccagctgatcaagcagacccaggaggagagaagcagaagcgagcacaacctggtgaacatccagaagacccacgagagaatgcagaccgagaacaagatcagcccctactacagaaccaagctgagaggcctgtacaccaccgccaaggccgacgccgaggccgagtgcaacatcctgagaaaggccctggacaagatcgccgagatcaagagcctgctggaggagagaagaatcgccgccaagatcgccggcctgtacaacgacagcgagccccccagaaagaccatgagaagaggcgtgctgatgaccctgctgcagcagagcgccatgaccctgcccctgtggatcggcaagcccggcgacaagcccccccccctgtgcggcgccatccccgccagcggcgactacgtggccagacccggcgacaaggtggccgccagagtgaaggccgtggacggcgacgagcagtggatcctggccgaggtggtgagctacagccacgccaccaacaagtacgaggtggacgacatcgacgaggagggcaaggagagacacaccctgagcagaagaagagtgatccccctgccccagtggaaggccaaccccgagaccgaccccgaggccctgttccagaaggagcagctggtgctggccctgtacccccagaccacctgcttctacagagccctgatccacgcccccccccagagaccccaggacgactacagcgtgctgttcgaggacaccagctacgccgacggctacagcccccccctgaacgtggcccagagatacgtggtggcctgcaaggagcccaagaagaagtag

SEQ ID NO: 77179 - DNA, 843 bp, Artificial Sequence
  Description of Artificial Sequence: Synthetic coding sequence
atgaacgacagaagcagcagaagaagaaccatgaaggacgacgagaccttcgagatcagcatccccttcgacgaggccccccacctggacccccagatcttctacagcctgagccccagcagaagaaacttcgaggagccccccgaggccgccagcagcgccctggccctgatgaacagcgtgaagacccagctgcacatggccctggagagaaacagctggctgcagaagagaatcgaggacctggaggaggagagagacttcctgagatgccagctggacaagttcatcagcagcgccagaatggaggccgaggaccactgcagaatgaagcccggccccagaagaatggagggcgacagcagaggcggcgccggcggcgaggccagcgaccccgagagcgccgccagcagcctgagcggcgccagcgaggagggcagcgccagcgagagaagaagacagaagcagaagggcggcgccagcagaagaagattcggcaagcccaaggccagagagagacagagagtgaaggacgccgacggcgtgctgtgcagatacaagaagatcctgggcaccttccagaagctgaagagcatgagcagagccttcgagcaccacagagtggacagaaacaccgtggccctgaccacccccatcgccgagctgctgatcgtggcccccgagaagctggccgaggtgggcgagttcgaccccagcaaggagagactgctggagtacagcagaagatgcttcctggccctggacgacgagaccctgaagaaggtgcaggccctgaagaagagcaagctgctgctgcccatcacctacagattcaagagatag

SEQ ID NO: 77180 - DNA, 495 bp, Artificial Sequence
  Description of Artificial Sequence: Synthetic coding sequence
atgatgctgacccaggcccccagcagcgtggtgagaagcagaaacagcagaaaccacaccgtgaacagcggcggcagctgcctgagcgccagcaccgtggccatccccgccatcaacgacagcagcgccgccatgagcgcctgcagcaccatcagcgcccagcccgccagcagcatggacacccagatgcacagccccaagaagcaggagagagtgaacaagagagtgatctggggcatcgaggtggccgaggagctgcactggaagggctgggagctgggcaaggagaccaccagaaacctggtgctgaagaacagaagcctgaagctgcagaagatgaagtacagataccagtacaagggcagcagaacccagtgccacagcctggagcccagaaagcaggccctgttcaagaccaagcagaacaagcagaagaagcccctgacctgccacatcaaggccagcgagtgcctgaagtacgtgcagtacgagtag

SEQ ID NO: 77181 - DNA, 495 bp, Artificial Sequence; identical to SEQ ID NO: 77180
  Description of Artificial Sequence: Synthetic coding sequence

SEQ ID NO: 77182 - DNA, 5778 bp, Artificial Sequence
  Description of Artificial Sequence: Synthetic coding sequence
atgttcaccctgaccggctgcagactggtggagaagacccagaaggtggagaaccccagcgtgagcttcgccagcagcttccccctgatccccctgctgctgagaggcaagagcgtgcagaagaagcaggccgagagcaagagccagatcaagctgcacacccagagcgcccccttcggcctgtgccccaaggacatgatgctgacccaggcccccagcagcgtggtgagaagcagaaacagcagaaaccacaccgtgaacagcggcggcagctgcctgagcgccagcaccgtggccatccccgccatcaacgacagcagcgccgccatgagcgcctgcagcaccatcagcgcccagcccgccagcagcatggacacccagatgcacagccccaagaagcaggagagagtgaacaagagagtgatctggggcatcgaggtggccgaggagctgcactggaagggctgggagctgggcaaggagaccaccagaaacctggtgctgaagaacagaagcctgaagctgcagaagatgaagtacagaccccccaagaccaagttcttcttcaccgtgatcccccagcccatcttcctgagccccggcatcaccctgaccctgcccatcgtgttcagacccctggaggccaaggagtacatggaccagctgtggttcgagaaggccgagggcatgttctgcgtgggcctgagagccaccctgccctgccacagactgatctgcagaccccccagcctgcagctgcccatgtgcgccgtgggcgacaccaccgaggccttcttctgcctggacaacgtgggcgacctgcccaccttcttcacctgggagttcagcagccccttccagatgctgcccgccaccggcctgctggagcccggccaggccagccagatcaaggtgaccttccagcccctgaccgccgtgatctacgaggtgcaggccacctgctggtacggcgccggcagcagacagagaagcagcatccagctgcaggccgtggccaagtgcgcccagctgctggtgagcatcaagcacaagtgccccgaggaccaggacgccgagggcttccagaagctgctgtacttcggcagcgtggccgtgggctgcaccagcgagagacagatcagactgcacaaccccagcgccgtgaacgcccccttcagaatcgagatcagccccgacgagctggccgaggaccaggccttcagctgccccaccgcccacggcatcgtgctgcccggcgagaagaagtgcgtgagcgtgttcttccaccccaagaccctggacaccagaaccgtggactactgcagcatcatgcccagcggctgcgccagcaagaccctgctgaaggtggtgggcttctgcagaggccccgccgtgagcctgcagcactactgcgtgaacttcagctgggtgaacctgggcgagagaagcgagcagcccctgtggatcgagaaccagagcgactgcaccgcccacttccagttcgccatcgactgcctggagagcgtgttcaccatcagacccgccttcggcaccctggtgggcaaggccagaatgaccctgcactgcgccttccagcccacccaccccatcatctgcttcagaagagtggcctgcctgatccaccaccaggaccccctgttcctggacctgatgggcacctgccacagcgacagcaccaagcccgccatcctgaagccccagcacctgacctggtacagaacccacctggccagaggcctgaccctgtacccccccgacatcctggacgccatgctgaaggagaagaagctggcccaggaccagaacggcgccctgatgatccccatccaggacctggaggacatgcccgccccccagtacccctacatcccccccatgaccgagttcttcttcgacggcaccagcgacatcaccatcttccccccccccatcagcgtggagcccgtggaggtggacttcggcgcctgccccggccccgaggcccccaaccccgtgcccctgtgcctgatgaaccacaccaagggcaagatcatggtggtgtggaccagaagaagcgactgccccttctgggtgacccccgagagctgcgacgtgccccccctgaagagcatggccatgagactgcacttccagcccccccaccccaactgcctgtacaccgtggagctggaggccttcgccatctacaaggtgctgcagagctacagcaacatcgaggaggactgcaccatgtgccccagctggtgcctgaccgtgagagccagaggccacagctacttcgccggcttcgagcaccacatcccccagtacagcctggacgtgcccaagctgttccccgccgtgagcagcggcgagcccacctacagaagcctgctgctggtgaacaaggactgcaagctgctgaccttcagcctggccccccagagaggcagcgacgtgatcctgagacccaccagcggcctggtggcccccggcgcccaccagatcatcctgatctgcacctaccccgagggcagcagctggaagcagcacaccttctacctgcagtgcaacgccagcccccagtacctgaaggaggtgagcatgtacagcagagaggagcccctgcagctgaagctggacacccacaagagcctgtacttcaagcccacctgggtgggctgcagcagcaccagccccttcaccttcagaaaccccagcagactgcccctgcagttcgagtggagagtgagcgagcagcacagaaagctgctggccgtgcagcccagcagaggcctgatccagcccaacgagagactgaccctgacctggaccttcagccccctggaggagaccaagtacctgttccaggtgggcatgtgggtgtgggaggccggcctgagccccaacgccaaccccgccgccaccacccactacatgctgagactggtgggcgtgggcctgaccagcagcctgagcgccaaggagaaggagctggccttcggcaacgtgctggtgaacagcaagcagagcagattcctggtgctgctgaacgacggcaactgcaccctgtactacagactgtacctggagcagggcagccccgaggccgtggacaaccaccccctggccctgcagctggacagaaccgagggcagcatgccccccagaagccaggacaccatctgcctgaccgcctgccccaagcagagaagccagtacagctggaccatcacctacagcctgctgagccacagagacaacaaggccggcgagaagcaggagctgtgctgcgtgagcctggtggccgtgtaccccctgctgagcatcctggacgtgagcagcatgggcagcgccgagggcatcaccagaaagcacctgtggagactgttcagcctggacctgctgaacagctacctggagagagaccccaccccctgcgagctgacctacaaggtgcccaccagacacagcatgagccagatcccccccgtgctgacccccctgagactggacttcaacttcggcgccgcccccttcaaggccccccccagcgtggtgttcctggccctgaagaacagcggcgtggtgagcctggactgggccttcctgctgcccagcgaccagagaatcgacgtggagctgtgggccgagcaggccgagctgaacagcaccgagctgcaccagatgagagtgcaggacaactgcctgttcagcatcagccccaaggccggcagcctgagccccggccaggagcagatggtggagctgaagtacagccacctgttcatcggcaccgaccacctgcccgtgctgttcaaggtgagccacggcagagagatcctgctgaacttcatcggcgtgaccgtgaagcccgagcagaagtacgtgcacttcaccagcaccacccaccagttcatccccatccccatcggcgacaccctgccccccagacagatctacgagctgtacaacggcggcagcgtgcccgtgacctacgaggtgcagaccgacgtgctgagccaggtgcaggagaagaacttcgaccaccccatcttctgctgcctgaaccccaagggcgagatccagcccggcagcaccgccagagtgctgtggatcttcagccccatcgaggccaagacctacaccgtggacgtgcccatccacatcctgggctggaacagcgccctgatccacttccagggcgtgggctacaacccccacatgatgggcgacaccgcccccttccacaacatcagcagctgggacaacagcagcatccacagcagactggtggtgcccggccagaacgtgttcctgagccagagccacatcagcctgggcaacatccccgtgcagagcaagtgcagcagactgctgttcctgaacaacatcagcaagaacgaggagatcgccttcagctggcagcccagccccctggacttcggcgaggtgagcgtgagccccatgatcggcgtggtggcccccgaggagaccgtgcccttcgtggtgaccctgagagccagcgtgcacgccagcttctacagcgccgacctggtgtgcaagctgtacagccagcagctgatgagacagtaccacaaggagctgcaggagtggaaggacgagaaggtgagacaggaggtggagttcaccatcaccgacatgaaggtgaagaagagaacctgctgcaccgcctgcgagcccgccagaaagtacaagaccctgccccccatcaagaaccagcagagcgtgagcagacccgccagctggaagctgcagacccccaaggaggaggtgagctggccctgcccccagccccccagccccggcatgctgtgcctgggcctgaccgccagagcccacgccaccgactacttcctggccaacttcttcagcgagttcccctgccacttcctgcacagagagctgcccaagagaaaggcccccagagaggagagcgagaccagcgaggagaagagccccaacaagtggggccccgtgagcaagcagaagaagcagctgctggtggacatcctgaccaccatcatcagaggcctgctggaggacaagaacttccacgaggccgtggaccagagcctggtggagcaggtgccctacttcagacagttctggaacgagcagagcaccaagttcatggaccagaagaacagcctgtacctgatgcccatcctgcccgtgcccagcagcagctgggaggacggcaagggcaagcagcccaaggaggacagacccgagcactaccccggcctgggcaagaaggaggagggcgaggaggagaagggcgaggaggaggaggaggagctggaggaggaggaggaggaggaggaggagaccgaggaggaggagctgggcaaggaggagatcgaggagaaggaggaggagagagacgagaaggaggagaaggtgagctgggccggcatcggccccaccccccagcccgagagccaggagagcatgcagtggcagtggcagcagcagctgaacgtgatggtgaaggaggagcaggagcaggacgagaaggaggccatcagaagactgcccgccttcgccaacctgcaggaggccctgctggagaacatgatccagaacatcctggtggaggccagcagaggcgaggtggtgctgaccagcagacccagagtgatcgccctgccccccttctgcgtgcccagaagcctgacccccgacaccctgctgcccacccagcaggccgaggtgctgcaccccgtggtgcccctgcccaccgacctgccctag

SEQ ID NO: 77183 - DNA, 2190 bp, Artificial Sequence
  Description of Artificial Sequence: Synthetic coding sequence
atgctgacccaggcccccagcagcgtggtgagaagcagaaacagcagaaaccacaccgtgaacagcggcggcagctgcctgagcgccagcaccgtggccatccccgccatcaacgacagcagcgccgccatgagcgcctgcagcaccatcagcgcccagcccgccagcagcatggacacccagatgcacagccccaagaagcaggagagagtgaacaagagagtgatctggggcatcgaggtggccgaggagctgcactggaagggctgggagctgggcaaggagaccaccagaaacctggtgctgaagaacagaagcctgaagctgcagaagatgaagtacagaccccccaagaccaagttcttcttcaccgtgatcccccagcccatcttcctgagccccggcatcaccctgaccctgcccatcgtgttcagacccctggaggccaaggagtacatggaccagctgtggttcgagaaggccgagggcatgttctgcgtgggcctgagagccaccctgccctgccacagactgatctgcagaccccccagcctgcagctgcccatgtgcgccgtgggcgacaccaccgaggccttcttctgcctggacaacgtgggcgacctgcccaccttcttcacctgggagttcagcagccccttccagatgctgcccgccaccggcctgctggagcccggccaggccagccagatcaaggtgaccttccagcccctgaccgccgtgatctacgaggtgcaggccacctgctggtacggcgccggcagcagacagagaagcagcatccagctgcaggccgtggccaagtgcgcccagctgctggtgagcatcaagcacaagtgccccgaggaccaggacgccgagggcttccagaagctgctgtacttcggcagcgtggccgtgggctgcaccagcgagagacagatcagactgcacaaccccagcgccgtgaacgcccccttcagaatcgagatcagccccgacgagctggccgaggaccaggccttcagctgccccaccgcccacggcatcgtgctgcccggcgagaagaagtgcgtgagcgtgttcttccaccccaagaccctggacaccagaaccgtggactactgcagcatcatgcccagcggctgcgccagcaagaccctgctgaaggtggtgggcttctgcagaggccccgccgtgagcctgcagcactactgcgtgaacttcagctgggtgaacctgggcgagagaagcgagcagcccctgtggatcgagaaccagagcgactgcaccgcccacttccagttcgccatcgactgcctggagagcgtgttcaccatcagacccgccttcggcaccctggtgggcaaggccagaatgaccctgcactgcgccttccagcccacccaccccatcatctgcttcagaagagtggcctgcctgatccaccaccaggaccccctgttcctggacctgatgggcacctgccacagcgacagcaccaagcccgccatcctgaagccccagcacctgacctggtacagaacccacctggccagaggcctgaccctgtacccccccgacatcctggacgccatgctgaaggagaagaagctggcccaggaccagaacggcgccctgatgatccccatccaggacctggaggacatgcccgccccccagtacccctacatcccccccatgaccgagttcttcttcgacggcaccagcgacatcaccatcttccccccccccatcagcgtggagcccgtggaggtggacttcggcgcctgccccggccccgaggcccccaaccccgtgcccctgtgcctgatgaaccacaccaagggcaagatcatggtggtgtggaccagaagaagcgactgccccttctgggtgacccccgagagctgcgacgtgccccccctgaagagcatggccatgagactgcacttccagcccccccaccccaactgcctgtacaccgtggagctggaggccttcgccatctacaaggtgtgcgccagaaacgagagagaggagtgcggcgtgagcgccagaagcctgagcggcctggtgggctggcaggaggtgaccgagggcagcttcagactgcaccccctgagagccagactgagcctgggctggaccgtgacccccatgagcctgagcccccccaagctgctggcctag

SEQ ID NO: 77184 - DNA, 5778 bp, Artificial Sequence; identical to SEQ ID NO: 77182
  Description of Artificial Sequence: Synthetic coding sequence

SEQ ID NO: 77185 - DNA, 5778 bp, Artificial Sequence; identical to SEQ ID NO: 77182
  Description of Artificial Sequence: Synthetic coding sequence

SEQ ID NO: 77186 - DNA, 816 bp, Artificial Sequence
  Description of Artificial Sequence: Synthetic coding sequence
atgaccctgcactgcgccttccagcccacccaccccatcatctgcttcagaagagtggcctgcctgatccaccaccaggaccccctgttcctggacctgatgggcacctgccacagcgacagcaccaagcccgccatcctgaagccccagcacctgacctggtacagaacccacctggccagaggcctgaccctgtacccccccgacatcctggacgccatgctgaaggagaagaagctggcccaggaccagaacggcgccctgatgatccccatccaggacctggaggacatgcccgccccccagtacccctacatcccccccatgaccgagttcttcttcgacggcaccagcgacatcaccatcttccccccccccatcagcgtggagcccgtggaggtggacttcggcgcctgccccggccccgaggcccccaaccccgtgcccctgtgcctgatgaaccacaccaagggcaagatcatggtggtgtggaccagaagaagcgactgccccttctgggtgacccccgagagctgcgacgtgccccccctgaagagcatggccatgagactgcacttccagcccccccaccccaactgcctgtacaccgtggagctggaggccttcgccatctacaaggtgtgcgccagaaacgagagagaggagtgcggcgtgagcgccagaagcctgagcggcctggtgggctggcaggaggtgaccgagggcagcttcagactgcaccccctgagagccagactgagcctgggctggaccgtgacccccatgagcctgagcccccccaagctgctggcctag

SEQ ID NO: 77187 - DNA, 543 bp, Artificial Sequence
  Description of Artificial Sequence: Synthetic coding sequence
atggccgccctggacctgagagccgagctggacagcctggtgctgcagctgctgggcgacctggaggagctggagggcaagagaaccgtgctgaacgccagagtggaggagggctggctgagcctggccaaggccagatacgccatgggcgccaagagcgtgggccccctgcagtacgccagccacatggagccccaggtgtgcctgcacgccagcgaggcccaggagggcctgcagaagttcaaggtggtgagagccggcgtgcacgcccccgaggaggtgggccccagagaggccggcctgagaagaagaaagggccccaccaagacccccgagcccgagagcagcgaggccccccaggaccccctgaactggttcggcatcctggtgccccacagcctgagacaggcccaggccagcttcagagacggcctgcagctggccgccgacatcgccagcctgcagaacagaatcgactggggcagaagccagctgagaggcctgcaggagaagctgaagcagctggagcccggcgccgcctag

SEQ ID NO: 77188 - DNA, 567 bp, Artificial Sequence
  Description of Artificial Sequence: Synthetic coding sequence
atgggcacccccctggacggcggcagcagagtgcccatcggctgccccgccaagctgagaagagtgaccagaaagaaggtggcccccgacctggagggctggctgagcctggccaaggccagatacgccatgggcgccaagagcgtgggccccctgcagtacgccagccacatggagccccaggtgtgcctgcacgccagcgaggcccaggagggcctgcagaagttcaaggtggtgagagccggcgtgcacgcccccgaggaggtgggccccagagaggccggcctgagaagaagaaagggccccaccaagacccccgagcccgagagcagcgaggccccccaggaccccctgaactggttcggcatcctggtgccccacagcctgagacaggcccaggccagcttcagagacggcgtgctggaggccaagaagagaaagtgcttcctggagagagtgatccagtgcgtggtgagccccgccgccgagcaggaggccgaggacgagagctgccccgaggactgggccgccgccgtgcccgccgagaccagcgccaaggccatctag

SEQ ID NO: 77189 - DNA, 855 bp, Artificial Sequence
  Description of Artificial Sequence: Synthetic coding sequence
atgagcgacaacaaggagagaaagagccagggcttccccaaggaggacaaccaggacaccagcagcctggccgacgccgtggagaaggtggccaagcagcagcagagccaggccagcgagatcgagaagaacaagaaggtgctgttcaacctgaagaacgagctgcacgagctggagaaggagatcgccgccatcagcgccgagaccaaggagaccgagagacagatctaccagcaggacagcgccatcgagaacaccaagctgcactgcgacagcctggagacccagatcaagagcctgcacagcgagaacgtgaagctgaagttcgacatcgagaccgcccaggaggacttcgaggagcacatgatcaagtacaacgcctactacgccaagatcaaggcccacaagaacagcctgggcgaggtggagagcaagtggagcttcatgaccgagctgcacgagaagagagacttcgtgaagaagctgaagaccatgaaggaggagctgatgcaggacctgcagaaccccggcggcaacagaatcacccaggtgcaggaggacatcaccaacctgaaggacaagatcatcaccgtgaaggagagcatcatcgagaagacctgcttcctggaggaggagaagaagacccacgagaagctgagaaaggagatcgagagcctggcccccagccccagactggagtgcagcagcgccatcagcgcccactgcaagctgtgcctgcccggcagcagacacagccccgccagcgccagcggcgtggccggcaccaccggcgcctgccaccacacccagctgatcttctgcatcttcagcagagacggcgtgagcccctgctag

SEQ ID NO: 77190 - DNA, 822 bp, Artificial Sequence
  Description of Artificial Sequence: Synthetic coding sequence
atgagcgacaacaaggagagaaagagccagggcttccccaaggaggacaaccaggacaccagcagcctggccgacgccgtggagaaggtggccaagcagcagcagagccaggccagcgagatcgagaagaacaagaaggtgctgttcaacctgaagaacgagctgcacgagctggagaaggagatcgccgccatcagcgccgagaccaaggagaccgagagacagatctaccagcaggacagcgccatcgagaacaccaagctgcactgcgacagcctggagacccagatcaagagcctgcacagcgagaacgtgaagctgaagttcgacatcgagaccgcccaggaggacttcgaggagcacatgatcaagtacaacgcctactacgccaagatcaaggcccacaagaacagcctgggcgaggtggagagcaagtggagcttcatgaccgagctgcacgagaagagagacttcgtgaagaagctgaagaccatgaaggaggagctgatgcaggacctgcagaaccccggcggcaacagaatcacccaggtgcaggaggacatcaccaacctgaaggacaagatcatcaccgtgaaggagagcatcatcgagaagacctgcttcctggaggaggagaagaagacccacgagaagctgagaaaggagatcgaggtgcagcacaagagatacgacgccatcctgaagagactgcactgccaggtgaacaagctgcagagcaacagaagacagtggcagtggaacatccagcagctggagaagaccgccgccgagctgagaaagtgcatcggcatgcaggagtag

SEQ ID NO: 77191 - DNA, 1536 bp, Artificial Sequence
  Description of Artificial Sequence: Synthetic coding sequence
atgagcaaggtggccagaagcagcagcgagagcgacgtgcagctgtgggagaccgaggaggacgacatgaccgagggcgacctgggctacggcctgggcagaaagcccggcggcatctacgagatcgagttcagccacagaagcagaaagagaagcgacggcaagaacttcagccccccccccttccccagaaagggcgaggagagaaacgaggccagcttccagtacagcaagcacaagagccagcaggacaccttcccccaggtgagcagaatcagcaactacagaagacagagcagcaccgtggacagcaacagcgagctgagcaacgaggagctgagacagtgcctgaacgagaccctggaggaggtggagatgctgaagaccgagctggaggccagccagagacagctgagaggcaaggaggaggccctgaagatcctgcagagcatggccatcctgggcaaggccaccagccacacccaggccgtgctgcagaagaccatggagcagaacagaagcctggagaaggagatcaacgccctgcagtgggagatcgagttcgaccacaacagattcaagaacatcgaggagagctggatccagaagtacgacagactgaactgcgagaacgccgtgctgaaggagaacctgaaggtgaagaccgaggagatcaagatgctgaagagcgacaacgccgtgctgaaccagagatacctggaggccctggccatgctggacatcaagcagcagaagatggcccaggagaacatgtgctgcgacaagagcggcttcgccgaggccagcggcctggagctggccgtgctgggcgcctgcctgtgccacggccccggcggcaacccctgcagctgcgccagaatggccgccagcaccagaaagctgctgctgcagctgaagcaggagctggagatcctgcagaagagcaaggaggaggcctacgtgatggccgacgccttcagaatcgccttcgagcagcagctgatgagaaagaacgaccaggccctgcagctgacccagatggacaagatgcacaagaaggccaccaagtggatgaactggaagcacctgaaggaggacggcttccccagccccagaagcaagaagaccttcggccagagactgctgggcatgctgcccagcgagaacagcagcaagagaatggaggaccaggacagcccccaggaggtgctgaagatgctgatcgacctgctgaacgacaaggaggaggccctggcccaccagagaaaggtgagctacatgctggccagagccctggaggacaaggacaccgccagcaacgagaacaaggagaagaaccccatcaaggagaacttccccttcaacaacccctggagaaagaccagcgagttcagcgtgctgggcgaccccatccacagcagcgtgtgcatcctgaacagcgtgggctgcatctgcagcatccagcacagccagatcgaccccaactacagaaccctgaagagaagccacagcctgcccagcagcatcatcttctag

SEQ ID NO: 77192 - DNA, 1536 bp, Artificial Sequence; identical to SEQ ID NO: 77191
  Description of Artificial Sequence: Synthetic coding sequence

SEQ ID NO: 77193 - DNA, 1161 bp, Artificial Sequence
  Description of Artificial Sequence: Synthetic coding sequence
atgctgaagaccgagctggaggccagccagagacagctgagaggcaaggaggaggccctgaagatcctgcagagcatggccatcctgggcaaggccaccagccacacccaggccgtgctgcagaagaccatggagcagaacagaagcctggagaaggagatcaacgccctgcagtgggagatcgagttcgaccacaacagattcaagaacatcgaggagagctggatccagaagtacgacagactgaactgcgagaacgccgtgctgaaggagaacctgaaggtgaagaccgaggagatcaagatgctgaagagcgacaacgccgtgctgaaccagagatacctggaggccctggccatgctggacatcaagcagcagaagatggcccaggagaacatgtgctgcgacaagagcggcttcgccgaggccagcggcctggagctggccgtgctgggcgcctgcctgtgccacggccccggcggcaacccctgcagctgcgccagaatggccgccagcaccagaaagctgctgctgcagctgaagcaggagctggagatcctgcagaagagcaaggaggaggcctacgtgatggccgacgccttcagaatcgccttcgagcagcagctgatgagaaagaacgaccaggccctgcagctgacccagatggacaagatgcacaagaaggccaccaagtggatgaactggaagcacctgaaggaggacggcttccccagccccagaagcaagaagaccttcggccagagactgctgggcatgctgcccagcgagaacagcagcaagagaatggaggaccaggacagcccccaggaggtgctgaagatgctgatcgacctgctgaacgacaaggaggaggccctggcccaccagagaaaggtgagctacatgctggccagagccctggaggacaaggacaccgccagcaacgagaacaaggagaagaaccccatcaaggagaacttccccttcaacaacccctggagaaagaccagcgagttcagcgtgctgggcgaccccatccacagcagcgtgtgcatcctgaacagcgtgggctgcatctgcagcatccagcacagccagatcgaccccaactacagaaccctgaagagaagccacagcctgcccagcagcatcatcttctag

SEQ ID NO: 77194 - DNA, 3465 bp, Artificial Sequence
  Description of Artificial Sequence: Synthetic coding sequence
atgcaggccatggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcccaggtgctgcagctggtggccgagctggaggagaccagagagctggccggccagcacgaggacgacagcctggagctgcagggcctgctggaggacgagagactggccagcgcccagcaggccgaggtgttcaccaagcagatccagcagctgcagggcgagctgagaagcctgagagaggagatcagcctgctggagcacgagaaggagagcgagctgaaggagatcgagcaggagctgcacctggcccaggccgagatccagagcctgagacaggccgccgaggacagcgccaccgagcacgagagcgacatcgccagcctgcaggaggacctgtgcagaatgcagaacgagctggaggacatggagagaatcagaggcgactacgagatggagatcgccagcctgagagccgagatggagatgaagagcagcgagcccagcggcagcctgggcctgagcgactacagcggcctgcaggaggagctgcaggagctgagagagagataccacttcctgaacgaggagtacagagccctgcaggagagcaacagcagcctgaccggccagctggccgacctggagagcgagagaacccagagagccaccgagagatggctgcagagccagaccctgagcatgaccagcgccgagagccagaccagcgagatggacttcctggagcccgaccccgagatgcagctgctgagacagcagctgagagacgccgaggagcagatgcacggcatgaagaacaagtgccaggagctgtgctgcgagctggaggagctgcagcaccacagacaggtgagcgaggaggagcagagaagactgcagagagagctgaagtgcgcccagaacgaggtgctgagattccagaccagccacagcgtgacccagaacgaggagctgaagagcagactgtgcaccctgcagaagaagtacgacaccagccaggacgagcagaacgagctgctgaagatgcagctgcagctgcagaccgagctgagacagctgaaggtgatgaagagcaccctggtggagaaccagagcgagaaggagctgctgtgcagactgcagaagctgcacctgcagcaccagaacgtgacctgcgagaaggagaagctgctggagagacagcagcagctgcaggaggagctgcagtgccacgaggccgagctgcagcacctgagagacaccgtggccagcttcaaggagagcaacgagaaggacaccgagacccacgcccagctgcaggagatgaagcagctgtaccaggccagcaaggacgagctggagagacagaagcacatgtacgaccagctggagcaggacctgctgctgtgccagctggagctgaaggagctgaaggccagccaccccatccccgaggacaagggcaagtgcgccaacaagtgcgacaccctgctgagcagactgaccgagctgcaggagaagtacaaggccagccagaaggagatgggccagctgcagatggagcagtgcgagctgctggaggaccagagaagaatgcaggaggagcagggccagctgcaggaggagctgcacagactgaccctgcccctgcccaagagcggcctgctgctgaagagccaggagctgctgaccaagctggaggacctgtgcgagctgcagctgctgtaccagggcatgcaggaggagcagaagaagctgatccagaaccaggactgcgtgctgaaggagcagctggagatccacgaggagctgagaagattcaaggagagccacttccaggaggtgctggagaaccccgacgacagcaagctggccaagagcagcaagtgcaacagaaacaagcagagcaagctgctgatggagcagatgcaggccctgcaggtgatgtacgacgccggccaggccaagcaggagctgctgcagcaggagcagggcagactgctggaggagagaaagagactgcaggccgacctgcagctgtgcctggaggagatgcagctgctgcaggtgcagagccccagcatcaagatgagcctggagagctacggcaagagctacggcagcatggtgcccagcaacgagaactgcagaaagacctacgacaccaccgtggacgacaacgagagctactacaagagctacaccagcacccagaccagcagcaagagcttcctgaagagctacgacagcagcaccagcgccagcgaggcctacggcaagagctactgcaccaccagcaacagcagcatcacctacaagaagagctacggcagcaccagcagcagcgacacctgccagaagagcttcgtgagcagctgcaccgacgaggagcccgccgagcccgaggacatggagagattcgaggagatggtggtgaaggtgctgatcaagctgcaggccgtgcaggccatgtaccagatcagccaggaggagcacagccagctgcaggagcagatggagaagctgctggccaagcagaaggacctgaaggaggagctggacgcctgcgagagagagttcaaggagtgcatggagtgcctggagaagcccatggccccccagaacgacaagaacgagatcaaggagctgcagaccaagctgagagagctgcagctgcagtaccaggccagcatggacgagcagggcagactgctggtggtgcaggagcagctggagggccagctgcagtgctgccaggaggagctgagacagctgagagagaagagacccagcgtggtgaaggaggccagaggcaagaacgccaacaagaacatgaacaagaacgccaacggcgtgaagatgaagaaggtgaccaagccctgcagcgacaccagcgagagcgacctggagaccagaaagagcctggaggtggtgctgtactacaaggccagccagagaaagctggacggcctggccaaggaggaggagaagaaggaggagatggaggaggagaagaagcaggtgaaggaggaggccaaggagcagtgcggcgacgagctggtggccgagcccgccgaccccgaggaggccaagagcaccgaggaccaggaggagaacgaggaggacaaggaggaggaggagaaggaggaggacagcgaggaggaggaggacgacgccgacagcagcctggagagccccgaggagaacaaccccctgagactgagcgagagcaagaagagcagccccacccccaacccccccatcttcagcctgcccctggtgggcctggtggtgatcagcgccctgctgtggtgctggtgggccgagaccagcagctag

SEQ ID NO: 77195 - DNA, 2874 bp, Artificial Sequence
  Description of Artificial Sequence: Synthetic coding sequence
ctgagagccctggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcccaggtgctgcagctggtggccgagctggaggagaccagagagctggccggccagcacgaggacgacagcctggagctgcagggcctgctggaggacgagagactggccagcgcccagcaggccgaggtgttcaccaagcagatccagcagctgcagggcgagctgagaagcctgagagaggagatcagcctgctggagcacgagaaggagagcgagctgaaggagatcgagcaggagctgcacctggcccaggccgagatccagagcctgagacaggccgccgaggacagcgccaccgagcacgagagcgacatcgccagcctgcaggaggacctgtgcagaatgcagaacgagctggaggacatggagagaatcagaggcgactacgagatggagatcgccagcctgagagccgagatggagatgaagagcagcgagcccagcggcagcctgggcctgagcgactacagcggcctgcaggaggagctgcaggagctgagagagagataccacttcctgaacgaggagtacagagccctgcaggagagcaacagcagcctgaccggccagctggccgacctggagagcgagagaacccagagagccaccgagagatggctgcagagccagaccctgagcatgaccagcgccgagagccagaccagcgagatggacttcctggagcccgaccccgagatgcagctgctgagacagcagctgagagacgccgaggagcagatgcacggcatgaagaacaagtgccaggagctgtgctgcgagctggaggagctgcagcaccacagacaggtgagcgaggaggagcagagaagactgcagagagagctgaagtgcgcccagaacgaggtgctgagattccagaccagccacagcgtgacccagaacgaggagctgaagagcagactgtgcaccctgcagaagaagtacgacaccagccaggacgagcagaacgagctgctgaagatgcagctgcagctgcagaccgagctgagacagctgaaggtgatgaagagcaccctggtggagaaccagagcgagaaggagctgctgtgcagactgcagaagctgcacctgcagcaccagaacgtgacctgcgagaaggagaagctgctggagagacagcagcagctgcaggaggagctgcagtgccacgaggccgagctgcagcacctgagagacaccgtggccagcttcaaggagagcaacgagaaggacaccgagacccacgcccagctgcaggagatgaagcagctgtaccaggccagcaaggacgagctggagagacagaagcacatgtacgaccagctggagcaggacctgctgctgtgccagctggagctgaaggagctgaaggccagccaccccatccccgaggacaagggcaagtgcgccaacaagtgcgacaccctgctgagcagactgaccgagctgcaggagaagtacaaggccagccagaaggagatgggccagctgcagatggagcagtgcgagctgctggaggaccagagaagaatgcaggaggagcagggccagctgcaggaggagctgcacagactgaccctgcccctgcccaagagcggcctgctgctgaagagccaggagctgctgaccaagctggaggacctgtgcgagctgcagctgctgtaccagggcatgcaggaggagcagaagaagctgatccagaaccaggactgcgtgctgaaggagcagctggagatccacgaggagctgagaagattcaaggagagccacttccaggaggtgctggagaaccccgacgacagcaagctggccaagagcagcaagtgcaacagaaacaagcagagcaagctgctgatggagcagatgcaggccctgcaggtgatgtacgacgccggccaggccaagcaggagctgctgcagcaggagcagggcagactgctggaggagagaaagagactgcaggccgacctgcagctgtgcctggaggagatgcagctgctgcaggtgcagagccccagcatcaagatgagcctggagagctacggcaagagctacggcagcatggtgcccagcaacgagaactgcagaaagacctacgacaccaccgtggacgacaacgagagctactacaagagctacaccagcacccagaccagcagcaagagcttcctgaagagctacgacagcagcaccagcgccagcgaggcctacggcaagagctactgcaccaccagcaacagcagcatcacctacaagaagagctacggcagcaccagcagcagcgacacctgccagaagagcttcgtgagcagctgcaccgacgaggagcccgccgagcccgaggacatggagagattcgaggagatggtggtgaaggtgctgatcaagctgcaggccgtgcaggccatgtaccagatcagccaggaggagcacagccagctgcaggagcagatggagaagctgctggccaagcagaaggacctgaaggaggagctggacgcctgcgagagagagttcaaggagtgcatggagtgcctggagaagcccatggccccccagaacgacaagaacgagaacatgttcggcctgtggaagcccatggtgttcctggccatcgccgccgtggccctgtacgtgctgcccaacatgagacagcaggagagcgagttctgcctgatggagtag

SEQ ID NO: 77196 - DNA, 1305 bp, Artificial Sequence
  Description of Artificial Sequence: Synthetic coding sequence
atggaggccggcgccggcgccggcgccggcgccgccggctggagctgccccggccccggccccaccgtgaccaccctgggcagctacgaggccagcgagggctgcgagagaaagaagggccagagatggggcagcctggagagaagaggcatgcaggccatggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcccaggtgctgcagctggtggccgagctggaggagaccagagagctggccggccagcacgaggacgacagcctggagctgcagggcctgctggaggacgagagactggccagcgcccagcaggccgaggtgttcaccaagcagatccagcagctgcagggcgagctgagaagcctgagagaggagatcagcctgctggagcacgagaaggagagcgagctgaaggagatcgagcaggagctgcacctggcccaggccgagatccagagcctgagacaggccgccgaggacagcgccaccgagcacgagagcgacatcgccagcctgcaggaggacctgtgcagaatgcagaacgagctggaggacatggagagaatcagaggcgactacgagatggagatcgccagcctgagagccgagatggagatgaagagcagcgagcccagcgaggagctgcaggagctgagagagagataccacttcctgaacgaggagtacagagccctgcaggagagcaacagcagcctgaccggccagctggccgacctggagagcgagagaacccagagagccaccgagagatggctgcagagccagaccctgagcatgaccagcgccgagagccagaccagcgagatggacttcctggagcccgaccccgagatgcagctgctgagacagcagctgagagacgccgaggagcagatgcacggcatgaagaacaagtgccaggagctgtgctgcgagctggaggagctgcagcaccacagacaggtgagcgaggaggagcagagaagactgcagagagagctgaagtgcgcccagaacgaggtgctgagattccagaccagccacagcgtgacccagagcagccccacccccaacccccccatcttcagcctgcccctggtgggcctggtggtgatcagcgccctgctgtggtgctggtgggccgagaccagcagctag

SEQ ID NO: 77197 - DNA, 3474 bp, Artificial Sequence
  Description of Artificial Sequence: Synthetic coding sequence
ctgagagccctggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcccaggtgctgcagctggtggccgagctggaggagaccagagagctggccggccagcacgaggacgacagcctggagctgcagggcctgctggaggacgagagactggccagcgcccagcaggccgaggtgttcaccaagcagatccagcagctgcagggcgagctgagaagcctgagagaggagatcagcctgctggagcacgagaaggagagcgagctgaaggagatcgagcaggagctgcacctggcccaggccgagatccagagcctgagacaggccgccgaggacagcgccaccgagcacgagagcgacatcgccagcctgcaggaggacctgtgcagaatgcagaacgagctggaggacatggagagaatcagaggcgactacgagatggagatcgccagcctgagagccgagatggagatgaagagcagcgagcccagcggcagcctgggcctgagcgactacagcggcctgcaggaggagctgcaggagctgagagagagataccacttcctgaacgaggagtacagagccctgcaggagagcaacagcagcctgaccggccagctggccgacctggagagcgagagaacccagagagccaccgagagatggctgcagagccagaccctgagcatgaccagcgccgagagccagaccagcgagatggacttcctggagcccgaccccgagatgcagctgctgagacagcagctgagagacgccgaggagcagatgcacggcatgaagaacaagtgccaggagctgtgctgcgagctggaggagctgcagcaccacagacaggtgagcgaggaggagcagagaagactgcagagagagctgaagtgcgcccagaacgaggtgctgagattccagaccagccacagcgtgacccagaacgaggagctgaagagcagactgtgcaccctgcagaagaagtacgacaccagccaggacgagcagaacgagctgctgaagatgcagctgcagctgcagaccgagctgagacagctgaaggtgatgaagagcaccctggtggagaaccagagcgagaaggagctgctgtgcagactgcagaagctgcacctgcagcaccagaacgtgacctgcgagaaggagaagctgctggagagacagcagcagctgcaggaggagctgcagtgccacgaggccgagctgcagcacctgagagacaccgtggccagcttcaaggagagcaacgagaaggacaccgagacccacgcccagctgcaggagatgaagcagctgtaccaggccagcaaggacgagctggagagacagaagcacatgtacgaccagctggagcaggacctgctgctgtgccagctggagctgaaggagctgaaggccagccaccccatccccgaggacaagggcaagtgcgccaacaagtgcgacaccctgctgagcagactgaccgagctgcaggagaagtacaaggccagccagaaggagatgggccagctgcagatggagcagtgcgagctgctggaggaccagagaagaatgcaggaggagcagggccagctgcaggaggagctgcacagactgaccctgcccctgcccaagagcggcctgctgctgaagagccaggagctgctgaccaagctggaggacctgtgcgagctgcagctgctgtaccagggcatgcaggaggagcagaagaagctgatccagaaccaggactgcgtgctgaaggagcagctggagatccacgaggagctgagaagattcaaggagagccacttccaggaggtgctggagaaccccgacgacagcaagctggccaagagcagcaagtgcaacagaaacaagcagagcaagctgctgatggagcagatgcaggccctgcaggtgatgtacgacgccggccaggccaagcaggagctgctgcagcaggagcagggcagactgctggaggagagaaagagactgcaggccgacctgcagctgtgcctggaggagatgcagctgctgcaggtgcagagccccagcatcaagatgagcctggagagctacggcaagagctacggcagcatggtgcccagcaacgagaactgcagaaagacctacgacaccaccgtggacgacaacgagagctactacaagagctacaccagcacccagaccagcagcaagagcttcctgaagagctacgacagcagcaccagcgccagcgaggcctacggcaagagctactgcaccaccagcaacagcagcatcacctacaagaagagctacggcagcaccagcagcagcgacacctgccagaagagcttcgtgagcagctgcaccgacgaggagcccgccgagcccgaggacatggagagattcgaggagatggtggtgaaggtgctgatcaagctgcaggccgtgcaggccatgtaccagatcagccaggaggagcacagccagctgcaggagcagatggagaagctgctggccaagcagaaggacctgaaggaggagctggacgcctgcgagagagagttcaaggagtgcatggagtgcctggagaagcccatggccccccagaacgacaagaacgagatcaaggagctgcagaccaagctgagagagctgcagctgcagtaccaggccagcatggacgagcagggcagactgctggtggtgcaggagcagctggagggccagctgcagtgctgccaggaggagctgagacagctgagagagaagagacccagcgtggtgaaggaggccagaggcaagaacgccaacaagaacatgaacaagaacgccaacggcgtgaagatgaagaaggtgaccaagccctgcagcgacaccagcgagagcgacctggagaccagaaagagcctggaggtggtgctgtactacaaggccagccagagaaagctggacggcctggccaaggaggaggagaagaaggaggagatggaggaggagaagaagcaggtgaaggaggaggccaaggagcagtgcggcgacgagctggtggccgagcccgccgaccccgaggaggccaagagcaccgaggaccaggaggagaacgaggaggacaaggaggaggaggagaaggaggaggacagcgaggaggaggaggacgacgccgacagcagcctggagagccccgaggagaacaaccccctgagactgagcgagagcaagaagaacatgttcggcctgtggaagcccatggtgttcctggccatcgccgccgtggccctgtacgtgctgcccaacatgagacagcaggagagcgagttctgcctgatggagtag

SEQ ID NO: 77198 - DNA, 309 bp, Artificial Sequence
  Description of Artificial Sequence: Synthetic coding sequence
atgcaggccatggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcccaggtgctgcagctggtggccgagctggaggagaccagagagctggccggccagcacgaggacgacagcctggagctgcagggcctgctggaggacgagagactggccagcgcccagtag

SEQ ID NO: 77199 - DNA, 1341 bp, Artificial Sequence
  Description of Artificial Sequence: Synthetic coding sequence
atggaggccggcgccggcgccggcgccggcgccgccggctggagctgccccggccccggccccaccgtgaccaccctgggcagctacgaggccagcgagggctgcgagagaaagaagggccagagatggggcagcctggagagaagaggcatgcaggccatggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcccaggtgctgcagctggtggccgagctggaggagaccagagagctggccggccagcacgaggacgacagcctggagctgcagggcctgctggaggacgagagactggccagcgcccagcaggccgaggtgttcaccaagcagatccagcagctgcagggcgagctgagaagcctgagagaggagatcagcctgctggagcacgagaaggagagcgagctgaaggagatcgagcaggagctgcacctggcccaggccgagatccagagcctgagacaggccgccgaggacagcgccaccgagcacgagagcgacatcgccagcctgcaggaggacctgtgcagaatgcagaacgagctggaggacatggagagaatcagaggcgactacgagatggagatcgccagcctgagagccgagatggagatgaagagcagcgagcccagcggcagcctgggcctgagcgactacagcggcctgcaggaggagctgcaggagctgagagagagataccacttcctgaacgaggagtacagagccctgcaggagagcaacagcagcctgaccggccagctggccgacctggagagcgagagaacccagagagccaccgagagatggctgcagagccagaccctgagcatgaccagcgccgagagccagaccagcgagatggacttcctggagcccgaccccgagatgcagctgctgagacagcagctgagagacgccgaggagcagatgcacggcatgaagaacaagtgccaggagctgtgctgcgagctggaggagctgcagcaccacagacaggtgagcgaggaggagcagagaagactgcagagagagctgaagtgcgcccagaacgaggtgctgagattccagaccagccacagcgtgacccagagcagccccacccccaacccccccatcttcagcctgcccctggtgggcctggtggtgatcagcgccctgctgtggtgctggtgggccgagaccagcagctag

SEQ ID NO: 77200 - DNA, 21 bp, Artificial Sequence
  Description of Artificial Sequence: Synthetic coding sequence
atgcaggccatggagggctag

SEQ ID NO: 77201 - DNA, 414 bp, Artificial Sequence
  Description of Artificial Sequence: Synthetic coding sequence
atgcaggccatggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcccaggtgctgcagctggtggccgagctggaggagaccagagagctggccggccagcacgaggacgacagcctggagctgcagggcctgctggaggacgagagactggccagcgcccagcaggccgaggtgttcaccaagcagatccagcagctgcagggcgagctgagaagcctgagagaggagatcagcctgctggagcacgagaaggagagcgagctgaagtag

SEQ ID NO: 77202 - DNA, 192 bp, Artificial Sequence
  Description of Artificial Sequence: Synthetic coding sequence
atgcaggccatggagggcgaggtgctgctgcccgccctgtacgaggaggaggaggaggaggaggaggaggaggaggaggtggaggaggaggaggagcaggtgcagaagggcggcagcgtgggcagcctgagcgtgaacaagcacagaggcctgagcctgaccgagaccgagctggaggagctgagagcctag

SEQ ID NO: 77203 - DNA, 870 bp, Artificial Sequence
  Description of Artificial Sequence: Synthetic coding sequence
atggccggcgccggcagaggcgccgccgtgagcagagtgcaggccggccccggcagccccagaagagccagaggcagacagcaggtgcagcccctgggcaagcagagacccgccccctggcccggcctgagaagcaaggagaagaagaaggtgaactgcaagcccaagaaccaggacgagcaggagatccccttcagactgagagagatcatgagaagcagacaggagatgaagaaccccatcagcaacaagaagagaaagaaggccgcccaggtgaccttcagaaagaccctggagaaggaggccaagggcgaggagcccgacatcgccgtgcccaagttcaagcagagaaagggcgagagcgacggcgcctacatccacagaatgcagcaggaggcccagcacgtgctgttcctgagcaagaaccaggccatcagacagcccgaggtgcaggccgcccccaaggagaagagcgagcagaagaaggccaagaaggccttccagaagagaagactggacaaggtgagaagaaagaaggaggagaaggccgccgacagactggagcaggagctgctgagagacaccgtgaagttcggcgaggtggtgctgcagccccccgagctgaccgccagaccccagagaagcgtgagcaaggaccagcccggcagaagaagccagatgctgagaatgctgctgagccccggcggcgtgagccagcccctgaccgccagcctggccagacagagaatcgtggaggaggagagagagagagccgtgcaggcctacagagccctgaagcagagacagcagcagctgcacggcgagagaccccacctgaccagcagaaagaagcccgagccccagctgtag

SEQ ID NO: 77204 - DNA, 1656 bp, Artificial Sequence
  Description of Artificial Sequence: Synthetic coding sequence
atgcccctgagcaccgccggcatcctgagcagcagcagcgccgccagcaacagaagcagaaacaaggccagatacagaaccaaggccgtgagcagcgaggtggacgagagcctgttcggcgacatcaagagccccgcccagggccagagcgacagccccatcgtgctgctgagagacaagcacaccctgcagaagaccctgaccgccctgggcctggacagaaagcccgagaccatccagctgatcaccagagacatggtgagagagctgatcgtgcccaccgaggaccccagcggcgagagcctgatcatcagccccgaggagttcgagagaatcaagtgggccagccacgtgctgaccagagaggagctggaggccagagaccaggccttcaagaaggagaaggaggccaccatggacgccgtgatgaccagaaagaagatcatgaagcagaaggagatggtgtggaacaacaacaagaagctgagcgacctggaggaggtggccaaggagagagcccagaacctgctgcagagagccaacaagctgagaatggagcaggaggaggagctgaaggacatgagcaagatcatcctgaacgccaagtgccacgccatcagagacgcccagatcctggagaagcagcagatccagaaggagctggacaccgaggagaagagactggaccagatgatggaggtggagagacagaagagcatccagagacaggaggagctggagagaaagagaagagaggagagaatcagaggcagaagacagatcgtggagcagatggagaagaaccaggaggagagaagcctgctggccgagcagagagagcaggagaaggagcagatgctggagtacatggagcagctgcaggaggaggacctgaaggacatggagagaagacagcagcagaagctgaagatgcaggccgagatcaagagaatcaacgacgagaaccagaagcagaaggccgagctgctggcccaggagaagctggccgaccagatggtgatggagttcaccaagaagaagatggccagagaggccgagttcgaggccgagcaggagagaatcagaagagagaaggagaaggagatcgccagactgagagccatgcaggagaaggcccaggactaccaggccgagcaggacgccctgagagccaagagaaaccaggaggtggccgacagagagtggagaagaaaggagaaggagaacgccagaaagaagatggagaccgaggccgagctgagaaagagcagactggagcaggtggccttcaaggagcacgccctggccgtgcaggtgcagagagacagagacgagttcgagagaatcctgagagcccagagagagcagatcgagaaggagagactggaggaggagaagaaggccaccggcagactgcagcacgccaacgagctgagaagacaggtgagagagaaccagcagaaggaggtgcagaacagaatcgccaccttcgaggagggcagaagactgaaggaggaggcccagaagagaagagagagaatcgacgagatcaagagaaagaagctggaggagctgagagccaccggcctgcccgagaagtactgcatcgaggccgagagaaaggccaacatcctgcccgccaccagcgtgaactag

SEQ ID NO: 77205 - DNA, 1401 bp, Artificial Sequence
  Description of Artificial Sequence: Synthetic coding sequence
atggtgagagagctgatcgtgcccaccgaggaccccagcggcgagagcctgatcatcagccccgaggagttcgagagaatcaagtgggccagccacgtgctgaccagagaggagctggaggccagagaccaggccttcaagaaggagaaggaggccaccatggacgccgtgatgaccagaaagaagatcatgaagcagaaggagatggtgtggaacaacaacaagaagctgagcgacctggaggaggtggccaaggagagagcccagaacctgctgcagagagccaacaagctgagaatggagcaggaggaggagctgaaggacatgagcaagatcatcctgaacgccaagtgccacgccatcagagacgcccagatcctggagaagcagcagatccagaaggagctggacaccgaggagaagagactggaccagatgatggaggtggagagacagaagagcatccagagacaggaggagctggagagaaagagaagagaggagagaatcagaggcagaagacagatcgtggagcagatggagaagaaccaggaggagagaagcctgctggccgagcagagagagcaggagaaggagcagatgctggagtacatggagcagctgcaggaggaggacctgaaggacatggagagaagacagcagcagaagctgaagatgcaggccgagatcaagagaatcaacgacgagaaccagaagcagaaggccgagctgctggcccaggagaagctggccgaccagatggtgatggagttcaccaagaagaagatggccagagaggccgagttcgaggccgagcaggagagaatcagaagagagaaggagaaggagatcgccagactgagagccatgcaggagaaggcccaggactaccaggccgagcaggacgccctgagagccaagagaaaccaggaggtggccgacagagagtggagaagaaaggagaaggagaacgccagaaagaagatggagaccgaggccgagctgagaaagagcagactggagcaggtggccttcaaggagcacgccctggccgtgcaggtgcagagagacagagacgagttcgagagaatcctgagagcccagagagagcagatcgagaaggagagactggaggaggagaagaaggccaccggcagactgcagcacgccaacgagctgagaagacaggtgagagagaaccagcagaaggaggtgcagaacagaatcgccaccttcgaggagggcagaagactgaaggaggaggcccagaagagaagagagagaatcgacgagatcaagagaaagaagctggaggagctgagagccaccggcctgcccgagaagtactgcatcgaggccgagagaaaggccaacatcctgcccgccaccagcgtgaactag

SEQ ID NO: 77206 - DNA, 1884 bp, Artificial Sequence
  Description of Artificial Sequence: Synthetic coding sequence
atggaggaggccgacagaatcctgatccacagcctgagacaggccggcaccgccgtgccccccgacgtgcagaccctgagagccttcaccaccgagctggtggtggaggccgtggtgagatgcctgagagtgatcaaccccgccgtgggcagcggcctgagccccctgctgcccctggccatgagcgccagattcagactggccatgagcctggcccaggcctgcatggacctgggctaccccctggagctgggctaccagaacttcctgtaccccagcgagcccgacctgagagacctgctgctgttcctggccgagagactgcccaccgacgccagcgaggacgccgaccagcccgccggcgacagcgccatcctgctgagagccatcggcagccagatcagagaccagctggccctgccctgggtgcccccccacctgagaacccccaagctgcagcacctgcagggcagcgccctgcagaagcccttccacgccagcagactggtggtgcccgagctgagcagcagaggcgagcccagagagttccaggccagccccctgctgctgcccgtgcccacccaggtgccccagcccgtgggcagagtggccagcctgctggagcaccacgccctgcagctgtgccagcagaccggcagagacagacccggcgacgaggactgggtgcacagaaccagcagactgcccccccaggaggacaccagagcccagagacagagactgcagaagcagctgaccgagcacctgagacagagctggggcctgctgggcgcccccatccaggccagagacctgggcgagctgctgcaggcctggggcgccggcgccaagaccggcgcccccaagggcagcagattcacccacagcgagaagttcaccttccacctggagccccaggcccaggccacccaggtgagcgacgtgcccgccaccagcagaagacccgagcaggtgacctgggccgcccaggagcaggagctggagagcctgagagagcagctggagggcgtgaacagaagcatcgaggaggtggaggccgacatgaagaccctgggcgtgagcttcgtgcaggccgagagcgagtgcagacacagcaagctgagcaccgccgagagagagcaggccctgagactgaagagcagagccgtggagctgctgcccgacggcaccgccaacctggccaagctgcagctggtggtggagaacagcgcccagagagtgatccacctggccggccagtgggagaagcacagagtgcccctgctggccgagtacagacacctgagaaagctgcaggactgcagagagctggagagcagcagaagactggccgagatccaggagctgcaccagagcgtgagagccgccgccgaggaggccagaagaaaggaggaggtgtacaagcagctgatgagcgagctggagaccctgcccagagacgtgagcagactggcctacacccagagaatcctggagatcgtgggcaacatcagaaagcagaaggaggagatcaccaagatcctgagcgacaccaaggagctgcagaaggagatcaacagcctgagcggcaagctggacagaaccttcgccgtgaccgacgagctggtgttcaaggacgccaagaaggacgacgccgtgagaaaggcctacaagtacctggccgccctgcacgagaactgcagccagctgatccagaccatcgaggacaccggcaccatcatgagagaggtgagagacctggaggagcagatcgagaccgagctgggcaagaagaccctgagcaacctggagaagatcagagaggactacagagccctgagacaggagaacgccggcctgctgggcagagtgagagaggcctag

SEQ ID NO: 77207 - DNA, 1743 bp, Artificial Sequence
  Description of Artificial Sequence: Synthetic coding sequence
atggaggaggccgacagaatcctgatccacagcctgagacaggccggcaccgccgtgccccccgacgtgcagaccctgagagccttcaccaccgagctggtggtggaggccgtggtgagatgcctgagagtgatcaaccccgccgtgggcagcggcctgagccccctgctgcccctggccatgagcgccagattcagactggccatgagcctggcccaggcctgcatggacctgggctaccccctggagctgggctaccagaacttcctgtaccccagcgagcccgacctgagagacctgctgctgttcctggccgagagactgcccaccgacgccagcgaggacgccgaccagcccgccggcgacagcgccatcctgctgagagccatcggcagccagatcagagaccagctggccctgccctgggtgcccccccacctgagaacccccaagctgcagcacctgcagggcagcgccctgcagaagcccttccacgccagcagactggtggtgcccgagctgagcagcagaggcgagcccagagagttccaggccagccccctgctgctgcccgtgcccacccaggtgccccagcccgtgggcagagtggccagcctgctggagcaccacgccctgcagctgtgccagcagaccggcagagacagacccggcgacgaggactgggtgcacagaaccagcagactgcccccccaggaggacaccagagcccagagacagagactgcagaagcagctgaccgagcacctgagacagagctggggcctgctgggcgcccccatccaggccagagacctgggcgagctgctgcaggcctggggcgccggcgccaagaccggcgcccccaagggcagcagattcacccacagcgagaagttcaccttccacctggagccccaggcccaggccacccaggtgagcgacgtgcccgccaccagcagaagacccgagcaggtgacctgggccgcccaggagcaggagctggagagcctgagagagcagctggagggcgtgaacagaagcatcgaggaggtggaggccgacatgaagaccctgggcgtgagcttcgtgcaggccgagagcgagtgcagacacagcaagctgagcaccgccgagagagagcaggccctgagactgaagagcagagccgtggagctgctgcccgacggcaccgccaacctggccaagctgcagctggtggtggagaacagcgcccagagagtgatccacctggccggccagtgggagaagcacagagtgcccctgctggccgagtacagacacctgagaaagctgcaggactgcagagagctggagagcagcagaagactggccgagatccaggagctgcaccagagcgtgagagccgccgccgaggaggccagaagaaaggaggaggtgtacaagcagctgatgagcgagctggagaccctgcccagagacgtgagcagactggcctacacccagagaatcctggagatcgtgggcaacatcagaaagcagaaggaggagatcaccaagatcctgagcgacaccaaggagctgcagaaggagatcaacagcctgagcggcaagctggacagaaccttcgccgtgaccgacgagctggtgttcaaggacgccaagaaggacgacgccgtgagaaaggcctacaagtacctggccgccctgcacttcatcggcgacggcaccgtgggctggggcccctggatccccaacaagtag

SEQ ID NO: 77208 - DNA, 603 bp, Artificial Sequence
  Description of Artificial Sequence: Synthetic coding sequence
atggacgacaagaagaagaagagaagccccaagccctgcctggcccagcccgcccaggcccccggcaccctgagaagagtgcccgtgcccaccagccacagcggcagcctggccctgggcctgccccacctgcccagccccaagcagagagccaagttcaagagagtgggcaaggagaagtgcagacccgtgctggccggcggcggcagcggcagcgccggcacccccctgcagcacagcttcctgaccgaggtgaccgacgtgtacgagatggagggcggcctgctgaacctgctgaacgacttccacagcggcagactgcaggccttcggcaaggagtgcagcttcgagcagctggagcacgtgagagagatgcaggagaagctggccagactgcacttcagcctggacgtgtgcggcgaggaggaggacgacgaggaggaggaggacggcgtgaccgagggcctgcccgaggagcagaagaagaccatggccgacagaaacctggaccagctgctgagcaacctggaggacctgagcaacagcatccagaagctgcacctggccgagaacgccgagcccgaggagcagagcgccgcctag

SEQ ID NO: 77209 - DNA, 690 bp, Artificial Sequence
  Description of Artificial Sequence: Synthetic coding sequence
atgtgggccgccggcagatggggccccaccttccccagcagctacgccggcttcagcgccgactgcagacccagaagcagacccagcagcgacagctgcagcgtgcccatgaccggcgccagaggccagggcctggaggtggtgagaagccccagcccccccctgcccctgagctgcagcaacagcaccagaagcctgctgagccccctgggccaccagagcttccagttcgacgaggacgacggcgacggcgaggacgaggaggacgtggacgacgaggaggacgtggacgaggacgcccacgacagcgaggccaaggtggccagcctgagaggcatggagctgcagggctgcgccagcacccaggtggagagcgagaacaaccaggaggagcagaagcaggtgagactgcccgagagcagactgaccccctgggaggtgtggttcatcggcaaggagaaggaggagagagacagactgcagctgaaggccctggaggagctgaaccagcagctggagaagagaaaggagatggaggagagagagaagagaaagatcatcgccgaggagaagcacaaggagtgggtgcagaagaagaacgagcaggtgagaagaggcaagtggatccacaccctgaccagcctgctgcagaacatcagcagctactacaccagcctgcccagattctag

SEQ ID NO: 77210 - DNA, 1122 bp, Artificial Sequence
  Description of Artificial Sequence: Synthetic coding sequence
atgtgggccgccggcagatggggccccaccttccccagcagctacgccggcttcagcgccgactgcagacccagaagcagacccagcagcgacagctgcagcgtgcccatgaccggcgccagaggccagggcctggaggtggtgagaagccccagcccccccctgcccctgagctgcagcaacagcaccagaagcctgctgagccccctgggccaccagagcttccagttcgacgaggacgacggcgacggcgaggacgaggaggacgtggacgacgaggaggacgtggacgaggacgcccacgacagcgaggccaaggtggccagcctgagaggcatggagctgcagggctgcgccagcacccaggtggagagcgagaacaaccaggaggagcagaagcaggtgagactgcccgagagcagactgaccccctgggaggtgtggttcatcggcaaggagaaggaggagagagacagactgcagctgaaggccctggaggagctgaaccagcagctggagaagagaaaggagatggaggagagagagaagagaaagatcatcgccgaggagaagcacaaggagtgggtgcagaagaagaacgagcagaagagaaaggagagagagcagaagatcaacaaggagatggaggagaaggccgccaaggagctggagaaggagtacctgcaggagaaggccaaggagaagtaccaggagtggctgaagaagaagaacgccgaggagtgcgagagaaagaagaaggagaaggagaaggagaagcagcagcaggccgagatccaggagaagaaggagatcgccgagaagaagttccaggagtggctggagaacgccaagcacaagcccagacccgccgccaagagctacggctacgccaacggcaagctgaccggcttctacagcggcaacagctaccccgagcccgccttctacaaccccatcccctggaagcccatccacatgcccccccccaaggaggccaaggacctgagcggcagaaagagcaagagacccgtgatcagccagccccacaagagcagcagcctggtgatccacaaggccagaagcaacctgtgcctgggcaccctgtgcagaatccagagatag

SEQ ID NO: 77211 - DNA, 2268 bp, Artificial Sequence
  Description of Artificial Sequence: Synthetic coding sequence
atggagtacatcttccccaacaccggcgtgctgtggagctggctgatcaacatcctgtgcaacagaagaatcgtgtggttcaccagcagccagctgcccagaggcccccccgccagcagcggcggccacagcttccacaccctgagagagagaagcgagagcagactgttcgtggagagctacgccgccgcctggcagccccccggcaccagcggcggcgccagctgctgcagcagcctgagcgcccaggtgatgagcagcgagttcctggccgagctgcactgggaggacggcttcgccatccccgtggccaacgaggagaacaagctgctggaggaccagctgagcaagctgaaggacgagagagccagcctgcaggacgagctgagagagtacgaggagagaatcaacagcatgaccagccacttcaagaacgtgaagcaggagctgagcatcacccagagcctgtgcaaggccagagagagagagaccgagagcgaggagcacttcaaggccatcgcccagagagagctgggcagagtgaaggacgagatccagagactggagaacgagatggccagcatcctggagaagaagagcgacaaggagaacggcatcttcaaggccacccagaagctggacggcctgaagtgccagatgaactgggaccagcaggccctggaggcctggctggaggagagcgcccacaaggacagcgacgccctgaccctgcagaagtacgcccagcaggacgacaacaagatcagagccctgaccctgcagctggagagactgaccctggagtgcaaccagaagagaaagatcctggacaacgagctgaccgagaccatcagcgcccagctggagctggacaaggccgcccaggacttcagaaagatccacaacgagagacaggagctgatcaagcagtgggagaacaccatcgagcagatgcagaagagagacggcgacatcgacaactgcgccctggagctggccagaatcaagcaggagaccagagagaaggagaacctggtgaaggagaagatcaagttcctggagagcgagatcggcaacaacaccgagttcgagaagagaatcagcgtggccgacagaaagctgctgaagtgcagaaccgcctaccaggaccacgagaccagcagaatccagctgaagggcgagctggacagcctgaaggccaccgtgaacagaaccagcagcgacctggaggccctgagaaagaacatcagcaagatcaagaaggacatccacgaggagaccgccagactgcagaagaccaagaaccacaacgagatcatccagaccaagctgaaggagatcaccgagaagaccatgagcgtggaggagaaggccaccaacctggaggacatgctgaaggaggaggagaaggacgtgaaggaggtggacgtgcagctgaacctgatcaagggcgtgctgttcaagaaggcccaggagctgcagaccgagaccatgaaggagaaggccgtgctgagcgagatcgagggcaccagaagcagcctgaagcacctgaaccaccagctgcagaagctggacttcgagaccctgaagcagcaggagatcatgtacagccaggacttccacatccagcaggtggagagaagaatgagcagactgaagggcgagatcaacagcgaggagaagcaggccctggaggccaagatcgtggagctgagaaagagcctggaggagaagaagagcacctgcggcctgctggagacccagatcaagaagctgcacaacgacctgtacttcatcaagaaggcccacagcaagaacagcgacgagaagcagagcctgatgaccaagatcaacgagctgaacctgttcatcgacagaagcgagaaggagctggacaaggccaagggcttcaagcaggacctgatgatcgaggacaacctgctgaagctggaggtgaagagaaccagagagatgctgcacagcaaggccgaggaggtgctgagcctggagaagagaaagcagcagctgtacaccgccatggaggagagaaccgaggagatcaaggtgcacaagaccatgctggccagccagatcagatacgtggaccaggagagagagaacatcagcaccgagttcagagagagactgagcaagatcgagaagctgaagaacagatacgagatcctgaccgtggtgatgctgccccccgagggcgaggaggagaagacccaggcctactacgtgatcaaggtgatgagcatgagctag

SEQ ID NO: 77212 - DNA, 2826 bp, Artificial Sequence
  Description of Artificial Sequence: Synthetic coding sequence
atgagcagcgagttcctggccgagctgcactgggaggacggcttcgccatccccgtggccaacgaggagaacaagctgctggaggaccagctgagcaagctgaaggacgagagagccagcctgcaggacgagctgagagagtacgaggagagaatcaacagcatgaccagccacttcaagaacgtgaagcaggagctgagcatcacccagagcctgtgcaaggccagagagagagagaccgagagcgaggagcacttcaaggccatcgcccagagagagctgggcagagtgaaggacgagatccagagactggagaacgagatggccagcatcctggagaagaagagcgacaaggagaacggcatcttcaaggccacccagaagctggacggcctgaagtgccagatgaactgggaccagcaggccctggaggcctggctggaggagagcgcccacaaggacagcgacgccctgaccctgcagaagtacgcccagcaggacgacaacaagatcagagccctgaccctgcagctggagagactgaccctggagtgcaaccagaagagaaagatcctggacaacgagctgaccgagaccatcagcgcccagctggagctggacaaggccgcccaggacttcagaaagatccacaacgagagacaggagctgatcaagcagtgggagaacaccatcgagcagatgcagaagagagacggcgacatcgacaactgcgccctggagctggccagaatcaagcaggagaccagagagaaggagaacctggtgaaggagaagatcaagttcctggagagcgagatcggcaacaacaccgagttcgagaagagaatcagcgtggccgacagaaagctgctgaagtgcagaaccgcctaccaggaccacgagaccagcagaatccagctgaagggcgagctggacagcctgaaggccaccgtgaacagaaccagcagcgacctggaggccctgagaaagaacatcagcaagatcaagaaggacatccacgaggagaccgccagactgcagaagaccaagaaccacaacgagatcatccagaccaagctgaaggagatcaccgagaagaccatgagcgtggaggagaaggccaccaacctggaggacatgctgaaggaggaggagaaggacgtgaaggaggtggacgtgcagctgaacctgatcaagggcgtgctgttcaagaaggcccaggagctgcagaccgagaccatgaaggagaaggccgtgctgagcgagatcgagggcaccagaagcagcctgaagcacctgaaccaccagctgcagaagctggacttcgagaccctgaagcagcaggagatcatgtacagccaggacttccacatccagcaggtggagagaagaatgagcagactgaagggcgagatcaacagcgaggagaagcaggccctggaggccaagatcgtggagctgagaaagagcctggaggagaagaagagcacctgcggcctgctggagacccagatcaagaagctgcacaacgacctgtacttcatcaagaaggcccacagcaagaacagcgacgagaagcagagcctgatgaccaagatcaacgagctgaacctgttcatcgacagaagcgagaaggagctggacaaggccaagggcttcaagcaggacctgatgatcgaggacaacctgctgaagctggaggtgaagagaaccagagagatgctgcacagcaaggccgaggaggtgctgagcctggagaagagaaagcagcagctgtacaccgccatggaggagagaaccgaggagatcaaggtgcacaagaccatgctggccagccagatcagatacgtggaccaggagagagagaacatcagcaccgagttcagagagagactgagcaagatcgagaagctgaagaacagatacgagatcctgaccgtggtgatgctgccccccgagggcgaggaggagaagacccaggcctactacgtgatcaaggccgcccaggagaaggaggagctgcagagagagggcgactgcctggacgccaagatcaacaaggccgagaaggagatctacgccctggagaacaccctgcaggtgctgaacagctgcaacaacaactacaagcagagcttcaagaaggtgacccccagcagcgacgagtacgagctgaagatccagctggaggagcagaagagagccgtggacgagaagtacagatacaagcagagacagatcagagagctgcaggaggacatccagagcatggagaacaccctggacgtgatcgagcacctggccaacaacgtgaaggagaagctgagcgagaagcaggcctacagcttccagctgagcaaggagaccgaggagcagaagcccaagctggagagagtgaccaagcagtgcgccaagctgaccaaggagatcagactgctgaaggacaccaaggacgagaccatggaggagcaggacatcaagctgagagagatgaagcagttccacaaggtgatcgacgagatgctggtggacatcatcgaggagaacaccgagatcagaatcatcctgcagacctacttccagcagagcggcctggagctgcccaccgccagcaccaagggcagcagacagagcagcagaagccccagccacaccagcctgagcgccagaagcagcagaagcaccagcaccagcaccagccagagcagcatcaaggtgctggagctgaagttccccgccagcagcagcctggtgggcagccccagcagacccagcagcgccagcagcagcagcagcaacgtgaagagcaagaagagcagcaagtag

SEQ ID NO: 77213 - DNA, 1740 bp, Artificial Sequence
  Description of Artificial Sequence: Synthetic coding sequence
atggccgagcccggcggcgccgccggcagaagccaccccgaggacggcagcgccagcgagggcgagaaggagggcaacaacgagagccacatggtgagcccccccgagaaggacgacggccagaagggcgaggaggccgtgggcagcaccgagcaccccgaggaggtgaccacccaggccgaggccgccatcgaggagggcgaggtggagaccgagggcgaggccgccgtggagggcgaggaggaggccgtgagctacggcgacgccgagagcgaggaggagtactactacaccgagaccagcagccccgagggccagatcagcgccgccgacaccacctacccctacttcagccccccccaggagctgcccggcgaggaggcctacgacagcgtgagcggcgaggccggcctgcagggcttccagcaggaggccaccggcccccccgagagcagagagagaagagtgaccagccccgagcccagccacggcgtgctgggccccagcgagcagatgggccaggtgaccagcggccccgccgtgggcagactgaccggcagcaccgaggagccccagggccaggtgctgcccatgggcgtgcagcacagattcagactgagccacggcagcgacatcgagagcagcgacctggaggagttcgtgagccaggagcccgtgatcccccccggcgtgcccgacgcccaccccagagagggcgacctgcccgtgttccaggaccagatccagcagcccagcaccgaggagggcgccatggccgagagagtggagagcgagggcagcgacgaggaggccgaggacgagggcagccagctggtggtgctggaccccgaccaccccctgatggtgagattccaggccgccctgaagaactacctgaacagacagatcgagaagctgaagctggacctgcaggagctggtggtggccaccaagcagagcagagcccagagacaggagctgggcgtgaacctgtacgaggtgcagcagcacctggtgcacctgcagaagctgctggagaagagccacgacagacacgccatggccagcagcgagagaagacagaaggaggaggagctgcaggccgccagagccctgtacaccaagacctgcgccgccgccaacgaggagagaaagaagctggccgccctgcagaccgagatggagaacctggccctgcacctgttctacatgcagaacatcgaccaggacatgagagacgacatcagagtgatgacccaggtggtgaagaaggccgagaccgagagaatcagagccgagatcgagaagaagaagcaggacctgtacgtggaccagctgaccaccagagcccagcagctggaggaggacatcgccctgttcgaggcccagtacctggcccaggccgaggacaccagaatcctgagaaaggccgtgagcgaggcctgcaccgagatcgacgccatcagcgtggagaagagaagaatcatgcagcagtgggccagcagcctggtgggcatgaagcacagagacgaggcccacagagccgtgctggaggccctgagcgtgagcctggagagattccccagccagaacatcaacaccgccagaagcagactgagcaccacctggcacagcgccggcatcctgctgagaggcagcttcctgcccggcgccagcagagccttcgccagcgtgtgctacggcggcgccgccgtggacaacagaatcagagagtgctag

SEQ ID NO: 77214 - DNA, 1437 bp, Artificial Sequence
  Description of Artificial Sequence: Synthetic coding sequence
atggccgagcccggcggcgccgccggcagaagccaccccgaggacggcagcgccagcgagggcgagaaggagggcaacaacgagagccacatggtgagcccccccgagaaggacgacggccagaagggcgaggaggccgtgggcagcaccgagcaccccgaggaggtgaccacccaggccgaggccgccatcgaggagggcgaggtggagaccgagggcgaggccgccgtggagggcgaggaggaggccgtgagctacggcgacgccgagagcgaggaggagtactactacaccgagaccagcagccccgagggccagatcagcgccgccgacaccacctacccctacttcagccccccccaggagctgcccggcgaggaggcctacgacagcgtgagcggcgaggccggcctgcagggcttccagcaggaggccaccggcccccccgagagcagagagagaagagtgaccagccccgagcccagccacggcgtgctgggccccagcgagcagatgggccaggtgaccagcggccccgccgtgggcagactgaccggcagcaccgaggagccccagggccaggtgctgcccatgggcgtgcagcacagattcagactgagccacggcagcgacatcgagagcagcgacctggaggagttcgtgagccaggagcccgtgatcccccccggcgtgcccgacgcccaccccagagagggcgacctgcccgtgttccaggaccagatccagcagcccagcaccgaggagggcgccatggccgagagagtggagagcgagggcagcgacgaggaggccgaggacgagggcagccagctggtggtgctggaccccgaccaccccctgatggtgagattccaggccgccctgaagaactacctgaacagacagatcgagaagctgaagctggacctgcaggagctggtggtggccaccaagcagagcagagcccagagacaggagctgggcgtgaacctgtacgaggtgcagcagcacctggtgcacctgcagaagctgctggagaagagccacgacagacacgccatggccagcagcgagagaagacagaaggaggaggagctgcaggccgccagagccctgtacaccaagacctgcgccgccgccaacgaggagagaaagaagctggccgccctgcagaccgagatggagaacctggccctgcacctgttctacatgcagaacatcgaccaggacatgagagacgacatcagagtgatgacccaggtggtgaagaaggccgagaccgagagaatcagagccgagatcgagaagaagaagcagggcgtgggcgacaccggcgccgccttcatccccaagaccacccagggcgaccaggtgagcggcagaggcaagaagaagcccggcaccgtggtggccagagtgagccccgccgagctgtag

SEQ ID NO: 77215 - DNA, 3093 bp, Artificial Sequence
  Description of Artificial Sequence: Synthetic coding sequence
atggccgagcccggcggcgccgccggcagaagccaccccgaggacggcagcgccagcgagggcgagaaggagggcaacaacgagagccacatggtgagcccccccgagaaggacgacggccagaagggcgaggaggccgtgggcagcaccgagcaccccgaggaggtgaccacccaggccgaggccgccatcgaggagggcgaggtggagaccgagggcgaggccgccgtggagggcgaggaggaggccgtgagctacggcgacgccgagagcgaggaggagtactactacaccgagaccagcagccccgagggccagatcagcgccgccgacaccacctacccctacttcagccccccccaggagctgcccggcgaggaggcctacgacagcgtgagcggcgaggccggcctgcagggcttccagcaggaggccaccggcccccccgagagcagagagagaagagtgaccagccccgagcccagccacggcgtgctgggccccagcgagcagatgggccaggtgaccagcggccccgccgtgggcagactgaccggcagcaccgaggagccccagggccaggtgctgcccatgggcgtgcagcacagattcagactgagccacggcagcgacatcgagagcagcgacctggaggagttcgtgagccaggagcccgtgatcccccccggcgtgcccgacgcccaccccagagagggcgacctgcccgtgttccaggaccagatccagcagcccagcaccgaggagggcgccatggccgagagagtggagagcgagggcagcgacgaggaggccgaggacgagggcagccagctggtggtgctggaccccgaccaccccctgatggtgagattccaggccgccctgaagaactacctgaacagacagatcgagaagctgaagctggacctgcaggagctggtggtggccaccaagcagagcagagcccagagacaggagctgggcgtgaacctgtacgaggtgcagcagcacctggtgcacctgcagaagctgctggagaagagccacgacagacacgccatggccagcagcgagagaagacagaaggaggaggagctgcaggccgccagagccctgtacaccaagacctgcgccgccgccaacgaggagagaaagaagctggccgccctgcagaccgagatggagaacctggccctgcacctgttctacatgcagaacatcgaccaggacatgagagacgacatcagagtgatgacccaggtggtgaagaaggccgagaccgagagaatcagagccgagatcgagaagaagaagcaggacctgtacgtggaccagctgaccaccagagcccagcagctggaggaggacatcgccctgttcgaggcccagtacctggcccaggccgaggacaccagaatcctgagaaaggccgtgagcgaggcctgcaccgagatcgacgccatcagcgtggagaagagaagaatcatgcagcagtgggccagcagcctggtgggcatgaagcacagagacgaggcccacagagccgtgctggaggccctgagaggctgccagcaccaggccaagagcaccgacggcgagatcgaggcctacaagaagagcatcatgaaggaggaggagaagaacgagaagctggccagcatcctgaacagaaccgagaccgaggccaccctgctgcagaagctgaccacccagtgcctgaccaagcaggtggccctgcagagccagttcaacacctacagactgaccctgcaggacaccgaggacgccctgagccaggaccagctggagcagatgatcctgaccgaggagctgcaggccatcagacaggccatccagggcgagctggagctgagaagaaagaccgacgccgccatcagagagaagctgcaggagcacatgaccagcaacaagaccaccaagtacttcaaccagctgatcctgagactgcagaaggagaagaccaacatgatgacccacctgagcaagatcaacggcgacatcgcccagaccaccctggacatcacccacaccagcagcagactggacgcccaccagaagaccctggtggagctggaccaggacgtgaagaaggtgaacgagctgatcaccaacagccagagcgagatcagcagaagaaccatcctgatcgagagaaagcagggcctgatcaacttcctgaacaagcagctggagagaatggtgagcgagctgggcggcgaggaggtgggccccctggagctggagatcaagagactgagcaagctgatcgacgagcacgacggcaaggccgtgcaggcccaggtgacctggctgagactgcagcaggagatggtgaaggtgacccaggagcaggaggagcagctggccagcctggacgccagcaagaaggagctgcacatcatggagcagaagaagctgagagtggagagcaagatcgagcaggagaagaaggagcagaaggagatcgagcaccacatgaaggacctggacaacgacctgaagaagctgaacatgctgatgaacaagaacagatgcagcagcgaggagctggagcagaacaacagagtgaccgagaacgagttcgtgagaagcctgaaggccagcgagagagagaccatcaagatgcaggacaagctgaaccagctgagcgaggagaaggccaccctgctgaaccagctggtggaggccgagcaccagatcatgctgtgggagaagaagatccagctggccaaggagatgagaagcagcgtggacagcgagatcggccagaccgagatcagagccatgaagggcgagatccacagaatgaagaagtactgcagaaccacccaggacgcccacagacacgtgcacgagcagcacggcacccacgccggcacctgcaccaagaacaccggcagagcccaggccagagccagaaccaccagagacgccagaggccacgtgcacgagcagcacggcaccagagccggcacctgcaccaacaacaccggcagagcccaggccagagccagaaccagagacgccagaagacacgtgcacgagcacagaacccacaccgccagagcctag

SEQ ID NO: 77216 - DNA, 3429 bp, Artificial Sequence
  Description of Artificial Sequence: Synthetic coding sequence
atggccgagcccggcggcgccgccggcagaagccaccccgaggacggcagcgccagcgagggcgagaaggagggcaacaacgagagccacatggtgagcccccccgagaaggacgacggccagaagggcgaggaggccgtgggcagcaccgagcaccccgaggaggtgaccacccaggccgaggccgccatcgaggagggcgaggtggagaccgagggcgaggccgccgtggagggcgaggaggaggccgtgagctacggcgacgccgagagcgaggaggagtactactacaccgagaccagcagccccgagggccagatcagcgccgccgacaccacctacccctacttcagccccccccaggagctgcccggcgaggaggcctacgacagcgtgagcggcgaggccggcctgcagggcttccagcaggaggccaccggcccccccgagagcagagagagaagagtgaccagccccgagcccagccacggcgtgctgggccccagcgagcagatgggccaggtgaccagcggccccgccgtgggcagactgaccggcagcaccgaggagccccagggccaggtgctgcccatgggcgtgcagcacagattcagactgagccacggcagcgacatcgagagcagcgacctggaggagttcgtgagccaggagcccgtgatcccccccggcgtgcccgacgcccaccccagagagggcgacctgcccgtgttccaggaccagatccagcagcccagcaccgaggagggcgccatggccgagagagtggagagcgagggcagcgacgaggaggccgaggacgagggcagccagctggtggtgctggaccccgaccaccccctgatggtgagattccaggccgccctgaagaactacctgaacagacagatcgagaagctgaagctggacctgcaggagctggtggtggccaccaagcagagcagagcccagagacaggagctgggcgtgaacctgtacgaggtgcagcagcacctggtgcacctgcagaagctgctggagaagagccacgacagacacgccatggccagcagcgagagaagacagaaggaggaggagctgcaggccgccagagccctgtacaccaagacctgcgccgccgccaacgaggagagaaagaagctggccgccctgcagaccgagatggagaacctggccctgcacctgttctacatgcagaacatcgaccaggacatgagagacgacatcagagtgatgacccaggtggtgaagaaggccgagaccgagagaatcagagccgagatcgagaagaagaagcaggacctgtacgtggaccagctgaccaccagagcccagcagctggaggaggacatcgccctgttcgaggcccagtacctggcccaggccgaggacaccagaatcctgagaaaggccgtgagcgaggcctgcaccgagatcgacgccatcagcgtggagaagagaagaatcatgcagcagtgggccagcagcctggtgggcatgaagcacagagacgaggcccacagagccgtgctggaggccctgagaggctgccagcaccaggccaagagcaccgacggcgagatcgaggcctacaagaagagcatcatgaaggaggaggagaagaacgagaagctggccagcatcctgaacagaaccgagaccgaggccaccctgctgcagaagctgaccacccagtgcctgaccaagcaggtggccctgcagagccagttcaacacctacagactgaccctgcaggacaccgaggacgccctgagccaggaccagctggagcagatgatcctgaccgaggagctgcaggccatcagacaggccatccagggcgagctggagctgagaagaaagaccgacgccgccatcagagagaagctgcaggagcacatgaccagcaacaagaccaccaagtacttcaaccagctgatcctgagactgcagaaggagaagaccaacatgatgacccacctgagcaagatcaacggcgacatcgcccagaccaccctggacatcacccacaccagcagcagactggacgcccaccagaagaccctggtggagctggaccaggacgtgaagaaggtgaacgagctgatcaccaacagccagagcgagatcagcagaagaaccatcctgatcgagagaaagcagggcctgatcaacttcctgaacaagcagctggagagaatggtgagcgagctgggcggcgaggaggtgggccccctggagctggagatcaagagactgagcaagctgatcgacgagcacgacggcaaggccgtgcaggcccaggtgacctggctgagactgcagcaggagatggtgaaggtgacccaggagcaggaggagcagctggccagcctggacgccagcaagaaggagctgcacatcatggagcagaagaagctgagagtggagagcaagatcgagcaggagaagaaggagcagaaggagatcgagcaccacatgaaggacctggacaacgacctgaagaagctgaacatgctgatgaacaagaacagatgcagcagcgaggagctggagcagaacaacagagtgaccgagaacgagttcgtgagaagcctgaaggccagcgagagagagaccatcaagatgcaggacaagctgaaccagctgagcgaggagaaggccaccctgctgaaccagctggtggaggccgagcaccagatcatgctgtgggagaagaagatccagctggccaaggagatgagaagcagcgtggacagcgagatcggccagaccgagatcagagccatgaagggcgagatccacagaatgaaggtgagactgggccagctgctgaagcagcaggagaagatgatcagagccatggagctggccgtggccagaagagagaccgtgaccacccaggccgagggccagagaaagatggacagaaaggccctgaccagaaccgacttccaccacaagcagctggagctgagaagaaagatcagagacgtgagaaaggccaccgacgagtgcaccaagaccgtgctggagctggaggagacccagagaaacgtgagcagcagcctgctggagaagcaggagaagctgagcgtgatccaggccgacttcgacaccctggaggccgacctgaccagactgggcgccctgaagagacagaacctgagcgagatcgtggccctgcagaccagactgaagcacctgcaggccgtgaaggagggcagatacgtgttcctgttcagaagcaagcagagcctggtgctggagagacagagactggacaagagactggccctgatcgccaccatcctggacagagtgagagacgagtacccccagttccaggaggccctgcacaaggtgagccagatgatcgccaacaagctggagagccccggccccagctag

SEQ ID NO: 77217 - DNA, 921 bp, Artificial Sequence
  Description of Artificial Sequence: Synthetic coding sequence
atggccgaggtgagcatcgaccagagcaagctgcccggcgtgaaggaggtgtgcagagacttcgccgtgctggaggaccacaccctggcccacagcctgcaggagcaggagatcgagcaccacctggccagcaacgtgcagagaaacagactggtgcagcacgacctgcaggtggccaagcagctgcaggaggaggacctgaaggcccaggcccagctgcagaagagatacaaggacctggagcagcaggactgcgagatcgcccaggagatccaggagaagctggccatcgaggccgagagaagaagaatccaggagaagaaggacgaggacatcgccagactgctgcaggagaaggagctgcaggaggagaagaagagaaagaagcacttccccgagttccccgccaccagagcctacgccgacagctactactacgaggacggcggcatgaagcccagagtgatgaaggaggccgtgagcacccccagcagaatggcccacagagaccaggagtggtacgacgccgagatcgccagaaagctgcaggaggaggagctgctggccacccaggtggacatgagagccgcccaggtggcccaggacgaggagatcgccagactgctgatggccgaggagaagaaggcctacaagaaggccaaggagagagagaagagcagcctggacaagagaaagcaggaccccgagtggaagcccaagaccgccaaggccgccaacagcaagagcaaggagagcgacgagccccaccacagcaagaacgagagacccgccagaccccccccccccatcatgaccgacggcgaggacgccgactacacccacttcaccaaccagcagagcagcaccagacacttcagcaagagcgagagcagccacaagggcttccactacaagcactag

SEQ ID NO: 77218 - DNA, 1449 bp, Artificial Sequence
  Description of Artificial Sequence: Synthetic coding sequence
atggccgaggtgagcatcgaccagagcaagctgcccggcgtgaaggaggtgtgcagagacttcgccgtgctggaggaccacaccctggcccacagcctgcaggagcaggagatcgagcaccacctggccagcaacgtgcagagaaacagactggtgcagcacgacctgcaggtggccaagcagctgcaggaggaggacctgaaggcccaggcccagctgcagaagagatacaaggacctggagcagcaggactgcgagatcgcccaggagatccaggagaagctggccatcgaggccgagagaagaagaatccaggagaagaaggacgaggacatcgccagactgctgcaggagaaggagctgcaggaggagaagaagagaaagaagcacttccccgagttccccgccaccagagcctacgccgacagctactactacgaggacggcgaccagcccggcagcagaagagccagagagctgggcagcggcttcagcagaccctgcagactgcagagagacggcaagaccgtgaagcacaagaaggagaagcccgagcaccccctggagaacctggaggagcccgagcagcactgcagcagcaagagaagcctgagcagcagcagcagcggcaagggcagagacaacccccacatcaacaacgagcagcacgagagaaagagaagcacccaggagagacccagaagacccctgctgcccaccatcagcggcgaggtgttcctgagcaccgagtgcgacgactgggagaccaagatcaaccaccagaccagaaactgggagaagcagagcagacaccaggacagactgagccccaagagcagccagaaggccggcctgcactgcaaggaggtggtgtacggcagagaccacggccagggcgagcacagaaagagaagacacagacccagaaccccccccttcagcgagagcgaggagcagctgcacctgcacgacgccggcatgaagcccagagtgatgaaggaggccgtgagcacccccagcagaatggcccacagagaccaggagtggtacgacgccgagatcgccagaaagctgcaggaggaggagctgctggccacccaggtggacatgagagccgcccaggtggcccaggacgaggagatcgccagactgctgatggccgaggagaagaaggcctacaagaaggccaaggagagagagaagagcagcctggacaagagaaagcaggaccccgagtggaagcccaagaccgccaaggccgccaacagcaagagcaaggagagcgacgagccccaccacagcaagaacgagagacccgccagaccccccccccccatcatgaccgacggcgaggacgccgactacacccacttcaccaaccagcagagcagcaccagacacttcagcaagagcgagagcagccacaagggcttccactacaagcactag

SEQ ID NO: 77219 - DNA, 1425 bp, Artificial Sequence
  Description of Artificial Sequence: Synthetic coding sequence
atggccgacagcgccagcgagagcgacaccgacggcgccggcggcaacagcagcagcagcgccgccatgcagagcagctgcagcagcaccagcggcggcggcggcggcggcggcggcggcggcggcggcggcaagagcggcggcatcgtgatcagccccttcagactggaggagctgaccaacagactggccagcctgcagcaggagaacaaggtgctgaagatcgagctggagacctacaagctgaagtgcaaggccctgcaggaggagaacagagacctgagaaaggccagcgtgaccatccaggccagagccgagcaggaggaggagttcatcagcaacaccctgttcaagaagatccaggccctgcagaaggagaaggagaccctggccgtgaactacgagaaggaggaggagttcctgaccaacgagctgagcagaaagctgatgcagctgcagcacgagaaggccgagctggagcagcacctggagcaggagcaggagttccaggtgaacaagctgatgaagaagatcaagaagctggagaacgacaccatcagcaagcagctgaccctggagcagctgagaagagagaagatcgacctggagaacaccctggagcaggagcaggaggccctggtgaacagactgtggaagagaatggacaagctggaggccgagaagagaatcctgcaggagaagctggaccagcccgtgagcgccccccccagccccagagacatcagcatggagatcgacagccccgagaacatgatgagacacatcagattcctgaagaacgaggtggagagactgaagaagcagctgagagccgcccagctgcagcacagcgagaagatggcccagtacctggaggaggagagacacatgagagaggagaacctgagactgcagagaaagctgcagagagagatggagagaagagaggccctgtgcagacagctgagcgagagcgagagcagcctggagatggacgacgagagatacttcaacgagatgagcgcccagggcctgagacccagaaccgtgagcagccccatcccctacacccccagccccagcagcagcagacccatcagccccggcctgagctacgccagccacaccgtgggcttcaccccccccaccagcctgaccagagccggcatgagctactacaacagccccggcctgcacgtgcagcacatgggcaccagccacggcatcaccagacccagccccagaagaagcaacagccccgacaagttcaagagacccacccccccccccagccccaacacccagacccccgtgcagcccccccccccccccccccccccccccatgcagcccaccgtgcccagcgccgccaccagccagcccacccccagccagcacagcgcccaccccagcagccagccctag

SEQ ID NO: 77220 - DNA, 2055 bp, Artificial Sequence
  Description of Artificial Sequence: Synthetic coding sequence
atgaacccccccgccgccttcctggccggcagacagaacatcggcagcgaggtggagatcagcaccatcgagaagcagagaaaggagctgcagctgctgatcggcgagctgaaggacagagacaaggagctgaacgacatggtggccgtgcaccagcagcagctgctgagctgggaggaggacagacagaaggtgctgaccctggaggagagatgcagcaagctggagggcgagctgcacaagagaaccgagatcatcagaagcctgaccaagaaggtgaaggccctggagagcaaccagatggagtgccagaccgccctgcagaagacccagctgcagctgcaggagatggcccagaaggccacccacagcagcctgctgagcgaggacctggaggccagaaacgagaccctgagcaacaccctggtggagctgagcgcccaggtgggccagctgcaggccagagagcaggccctgaccaccatgatcaagctgaaggacaaggacatcatcgaggccgtgaaccacatcgccgactgcagcggcaagttcaagatgctggagcacgccctgagagacgccaagatggccgagacctgcatcgtgaaggagaagcaggactacaagcagaagctgaaggccctgaagatcgaggtgaacaagctgaaggaggacctgaacgagaagaccaccgagaacaacgagcagagagaggagatcatcagactgaagcaggagaagagctgcctgcacgacgagctgctgttcaccgtggagagagagaagagaaaggacgagctgctgaacatcgccaagagcaagcaggagagaaccaacagcgagctgcacaacctgagacagatctacgtgaagcagcagagcgacctgcagttcctgaacttcaacgtggagaacagccaggagctgatccagatgtacgacagcaagatggaggagagcaaggccctggacagcagcagagacatgtgcctgagcgacctggagaacaaccaccccaaggtggacatcaagagagagaagaaccagaagagcctgttcaaggaccagaagttcgaggccatgctggtgcagcagaacagaagcgacaagagcagctgcgacgagtgcaaggagaagaagcagcagatcgacaccgtgttcggcgagaagagcgtgatcaccctgagcagcatcttcaccaaggacctggtggagaagcacaacctgccctggagcctgggcggcaagacccagatcgagcccgagaacaagatcaccctgtgcaagatccacaccaagagccccaagtgccacggcaccggcgtgcagaacgagggcaagcagcccagcgagacccccaccctgagcgacgagaagcagtggcacgacgtgagcgtgtacctgggcctgaccaactgccccagcagcaagcaccccgagaagctggacgtggagtgccaggaccagatggagagaagcgagatcagctgctgccagaagaacgaggcctgcctgggcgagagcggcatgtgcgacagcaagtgctgccaccccagcaacttcatcatcgaggcccccggccacatgagcgacgtggagtggatgagcatcttcaagcccagcaagatgcagagaatcgtgagactgaagagcggctgcacctgcagcgagagcatctgcggcacccagcacgacagccccgccagcgagctgatcgccatccaggacagccacagcctgggcagcagcaagagcgccctgagagaggacgagaccgagagcagcagcaacaagaagaacagccccaccagcctgctgatctacaaggacgcccccgccttcaacgagaaggccagcatcgtgctgcccagccaggacgacttcagccccaccagcaagctgcagagactgctggccgagagcagacagatggtgaccgacctggagctgagcaccctgctgcccatcagccacgagaacctgaccggcagcgccaccaacaagagcgaggtgcccgaggagagcgcccagaagaacaccttcgtgagctactag

SEQ ID NO: 77221 - DNA, 1338 bp, Artificial Sequence
  Description of Artificial Sequence: Synthetic coding sequence
atgcccaacagcagccccaaggaccccaccaccgccagcggcaacggcagcaaggtggagagagagaagagaaaggacgagctgctgaacatcgccaagagcaagcaggagagaaccaacagcgagctgcacaacctgagacagatctacgtgaagcagcagagcgacctgcagttcctgaacttcaacgtggagaacagccaggagctgatccagatgtacgacagcaagatggaggagagcaaggccctggacagcagcagagacatgtgcctgagcgacctggagaacaaccaccccaaggtggacatcaagagagagaagaaccagaagagcctgttcaaggaccagaagttcgaggccatgctggtgcagcagaacagaagcgacaagagcagctgcgacgagtgcaaggagaagaagcagcagatcgacaccgtgttcggcgagaagagcgtgatcaccctgagcagcatcttcaccaaggacctggtggagaagcacaacctgccctggagcctgggcggcaagacccagatcgagcccgagaacaagatcaccctgtgcaagatccacaccaagagccccaagtgccacggcaccggcgtgcagaacgagggcaagcagcccagcgagacccccaccctgagcgacgagaagcagtggcacgacgtgagcgtgtacctgggcctgaccaactgccccagcagcaagcaccccgagaagctggacgtggagtgccaggaccagatggagagaagcgagatcagctgctgccagaagaacgaggcctgcctgggcgagagcggcatgtgcgacagcaagtgctgccaccccagcaacttcatcatcgaggcccccggccacatgagcgacgtggagtggatgagcatcttcaagcccagcaagatgcagagaatcgtgagactgaagagcggctgcacctgcagcgagagcatctgcggcacccagcacgacagccccgccagcgagctgatcgccatccaggacagccacagcctgggcagcagcaagagcgccctgagagaggacgagaccgagagcagcagcaacaagaagaacagccccaccagcctgctgatctacaaggacgcccccgccttcaacgagaaggccagcatcgtgctgcccagccaggacgacttcagccccaccagcaagctgcagagactgctggccgagagcagacagatggtgaccgacctggagctgagcaccctgctgcccatcagccacgagaacctgaccggcagcgccaccaacaagagcgaggtgcccgaggagagcgcccagaagaacaccttcgtgagctactag

SEQ ID NO: 77222 - DNA, 2049 bp, Artificial Sequence
  Description of Artificial Sequence: Synthetic coding sequence
atgaacccccccgccgccttcctggccggcagacagaacatcggcagcgaggtggagatcagcaccatcgagaagcagagaaaggagctgcagctgctgatcggcgagctgaaggacagagacaaggagctgaacgacatggtggccgtgcaccagcagcagctgctgagctgggaggaggacagacagaaggtgctgaccctggaggagagatgcagcaagctggagggcgagctgcacaagagaaccgagatcatcagaagcctgaccaagaaggtgaaggccctggagagcaaccagatggagtgccagaccgccctgcagaagacccagctgcagctgcaggagatggcccagaaggccacccacagcagcctgctgagcgaggacctggaggccagaaacgagaccctgagcaacaccctggtggagctgagcgcccaggtgggccagctgcaggccagagagcaggccctgaccaccatgatcaagctgaaggacaaggacatcatcgaggccgtgaaccacatcgccgactgcagcggcaagttcaagatgctggagcacgccctgagagacgccaagatggccgagacctgcatcgtgaaggagaagcaggactacaagcagaagctgaaggccctgaagatcgaggtgaacaagctgaaggaggacctgaacgagaagaccaccgagaacaacgagcagagagaggagatcatcagactgaagcaggagaagagctgcctgcacgacgagctgctgttcaccgtggagagagagaagagaaaggacgagctgctgaacatcgccaagagcaagcaggagagaaccaacagcgagctgcacaacctgagacagatctacgtgaagcagcagagcgacctgcagttcctgaacttcaacgtggagaacagccaggagctgatccagatgtacgacagcaagatggaggagagcaaggccctggacagcagcagagacatgtgcctgagcgacctggagaacaaccaccccaaggtggacatcaagagagagaagaaccagaagagcctgttcaaggaccagaagttcgaggccatgctggtgcagcagaacagaagcgacaagagcagctgcgacgagtgcaaggagaagaagcagcagatcgacaccgtgttcggcgagaagagcgtgatcaccctgagcagcatcttcaccaaggacctggtggagaagcacaacctgccctggagcctgggcggcaagacccagatcgagcccgagaacaagatcaccctgtgcaagatccacaccaagagccccaagtgccacggcaccggcgtgcagaacgagggcaagcagcccagcgagacccccaccctgagcgacgagaagcagtggcacgacgtgagcgtgtacctgggcctgaccaactgccccagcagcaagcaccccgagaagctggacgtggagtgccaggaccagatggagagaagcgagatcagctgctgccagaagaacgaggcctgcctgggcgagagcggcatgtgcgacagcaagtgctgccaccccagcaacttcatcatcgaggcccccggccacatgagcgacgtggagtggatgagcatcttcaagcccagcaagatgcagagaatcgtgagactgaagagcggctgcacctgcagcgagagcatctgcggcacccagcacgacagccccgccagcgagctgatcgccatccaggacagccacagcctgggcagcagcaagagcgccctgagagaggacgagaccgagagcagcagcaacaagaagaacagccccaccagcctgctgatctacaaggacgcccccgccttcaacgagaaggccagcatcgtgctgcccagccaggacgacttcagccccaccagcaagctgcagagactgctggccgagagcagacagatggtgaccgacctggagctgagcaccctgctgcccatcagccacgagaacctgaccggcagcgccaccaacatcagccacctgtgcggcagacagaaggccgacaccaacaccgagtag

SEQ ID NO: 77223 - DNA, 1494 bp, Artificial Sequence
  Description of Artificial Sequence: Synthetic coding sequence
atgcccaagaaggagaagatggccaagacccccctgagcgacgagaagcagctgctgctgttccagcagaagctgctggccgaggaggagatggccaagaagaaggagagactgctgagccagttcctgaaggacaagctggccaaggaggagcacaacagcgccctgaacctgaacaagatcaacacccagtggagaaccgtgctgagagaggtgaagaccagagagctgcacaaggacatcgagatcctgagccagaccttcgagagagtggtggactgcaaggacaacgtgatcaagagcctggccaaggacctgagcgaggccgaggagcagtacgcccacgccctgagaagccacctgcacaacgtggaccagctgctggccctgcagagacacagactgagcctgctggaggagagctacaacatggagctggaggccctgaccaaggagttcgagaccgagagaaagaccatcatcgaccagcacgagaaggagatccactacctgcaggacatcttcatggccatggagcagaactacatcgacagcgagtacgagagcaagctggagttccagagcatgtggaacgacctgaagaacatgaacctggaggagaagcacttcctgagactgcacctggagaacagagtggaggacctgtggagaaagttccaggacgtgctgaagaactacaccgacgccaccgaggacagaaaggccgccttcgagaccctgcaggtgaaggacgagaagagcagcaaggagatcgaggtgcagatgaagaagatccagaagctgcaggacgccatcaccatcagcaagggcaagatcatgatccacagcagagagagcgaggacgagaacagatacatcagaaacgacaaggagctggtgctggtgcagctgagaaagctgaaggcccagagaacccaggccagagccgccagccagaagaacctggtgagactgaccctggagagcaacgccaccctgaaggccctgagaaagatcgtggacaagggcgagaagatcctgaagctggccgagatctgcagaaagttcgagaccgaggaggagaaggtgctgcccttctacagcagcgtgctgacccccaaggagcaggagggcatccagaagaacaacctggaggagctgaccgaggagctgaccaaggtgatggtggactacatcggcatggagaacttctggaagagatacaacaaggtgaagctggagcagctgagcctgcagcacagaagagcccagctgctggacatcaacggcaagctgagagagatgctgaagcagtacctggacggcatcagcgtgagcgacgaggtgctgagccagctgaaccccctgttcatcgtgaactaccagagcaacctgctgcagcccctgagcatcagaatcgcccaccccggcagcaccagccccagcgccccctggagagaccagagaagaagcttcttcctgggcagcagctag

SEQ ID NO: 77224 - DNA, 1455 bp, Artificial Sequence
  Description of Artificial Sequence: Synthetic coding sequence
atgcccaagaaggagaagatggccaagacccccctgagcgacgagaagcagctgctgctgttccagcagaagctgctggccgaggaggagatggccaagaagaaggagagactgctgagccagttcctgaaggacaagctggccaaggaggagcacaacagcgccctgaacctgaacaagatcaacacccagtggagaaccgtgctgagagaggtgaagaccagagagctgcacaaggacatcgagatcctgagccagaccttcgagagagtggtggactgcaaggacaacgtgatcaagagcctggccaaggacctgagcgaggccgaggagcagtacgcccacgccctgagaagccacctgcacaacgtggaccagctgctggccctgcagagacacagactgagcctgctggaggagagctacaacatggagctggaggccctgaccaaggagttcgagaccgagagaaagaccatcatcgaccagcacgagaaggagatccactacctgcaggacatcttcatggccatggagcagaactacatcgacagcgagtacgagagcaagctggagttccagagcatgtggaacgacctgaagaacatgaacctggaggagaagcacttcctgagactgcacctggagaacagagtggaggacctgtggagaaagttccaggacgtgctgaagaactacaccgacgccaccgaggacagaaaggccgccttcgagaccctgcaggtgaaggacgagaagagcagcaaggagatcgaggtgcagatgaagaagatccagaagctgcaggacgccatcaccatcagcaagggcaagatcatgatccacagcagagagagcgaggacgagaacagatacatcagaaacgacaaggagctggtgctggtgcagctgagaaagctgaaggcccagagaacccaggccagagccgccagccagaagaacctggtgagactgaccctggagagcaacgccaccctgaaggccctgagaaagatcgtggacaagggcgagaagatcctgaagctggccgagatctgcagaaagttcgagaccgaggaggagaaggtgctgcccttctacagcagcgtgctgacccccaaggagcaggagggcatccagaagaacaacctggaggagctgaccgaggagctgaccaaggtgatggtggactacatcggcatggagaacttctggaagagatacaacaaggtgaagctggagcagctgagcctgcagcacagaagagcccagctgctggacatcaacggcaagctgagagagatgctgaagcagtacctggacggcatcagcgtgagcgacgaggtgctgagccagctgaaccccctgttcatcgtgaactaccagagcaacctgctgcagcccctgagcatcagaatcgcccaccccggcgacaagcagcaccccaccacctag

SEQ ID NO: 77225 - DNA, 3240 bp, Artificial Sequence
  Description of Artificial Sequence: Synthetic coding sequence
atggagagcaacttcaacaccgagagcagcagcaccttcaccctgcagagcagcagcgagaccctgttcagcatccagctgctggacttcaagaccagcctgctggaggccctggaggagctgagaatgagaagagaggccgagatccactacgaggagcagatcggcaagatcatcgtggagacccaggagctgaagtggcagaaggagaccctgcagaaccagaaggagaccctggccgagcagcacaaggaggccatggccgtgttcaagaagcagctgcagatgaagatgtgcgccctggaggaggagaagggcaagtaccagctggccaccgagatcaaggagaaggagatcgagggcctgaaggagaccctgaaggccctgcaggtgagcaagtacagcctgcagaagaaggtgagcgagatggagcagaaggtgcagctgcacctgctggccaaggaggactaccacaagcagctgagcgagatcgagaagtactacgccaccatcaccggccagttcggcctggtgaaggagaaccacgagaagctggagcagaacgtgagagaggccatccagagcaacaagagactgagcgccctgaacaagaagcaggaggccgagatctgcagcctgaagaaggagctgaagaaggccgccagcgacctgatcaagagcaaggtgacctgccagtacaagatgggcgaggagaacatcaacctgaccatcaaggagcagaagttccaggagctgcaggagagactgaacatggagctggagctgaacgagaagatcaacgaggagatcacccacatccaggaggagaagcaggacatcatcatcagcttccagcacatgcagcagctgctgagacagcagatccaggccaacaccgagatggaggccgagctgaaggtgctgaaggagaacaaccagaccctggagagagacaacgagctgcagagagagaaggtgaaggagaacgaggagaagttcctgaacctgcagaacgagcacgagaaggccctgggcacctggaagagacacgccgaggagctgaacggcgagatcaacaagatcaagaacgagctgagcagcctgaaggagacccacatcaagctgcaggagcactacaacaagctgtgcaaccagaagaccttcgaggaggacaagaagttccagaacgtgcccgaggtgaacaacgagaacagcgagatgagcaccgagaagagcgagaacaccatcatccagaagtacaacaccgagcaggagatcagagaggagaacatggagaacttctgcagcgacaccgagtacagagagaaggaggagaagaaggagggcagcttcatcgaggagatcatcatcgacgacctgcagctgttcgagaagagcttcaagaacgagatcgacaccgtggtgagccaggacgagaaccagagcgagatcagcctgagcaagaccctgagcctggacaaggaggtgatcagccagggccagaccagcaacgtgaccgacaacagaaagagcgtgaccaccgagatcaaggacaagatctgcctggagaaggacaacggctgcaccgagttcaagagccccaacaaccacttcgtggtgctggacaccgccatcgagaccgagaagatccacctggagagaaccagaggcctggacgtgcaccacaccgacgtgaacctggaggtggagaacaacaagaccagcttcaacagcatcctgaacgagaccgcccacaacacctaccacaacaacaacaaggacgtgagcgagaacgagcccttcaagcagttcagactgctgcccggcaccagagagcacgccctggagaaggagatcaccaacagcgaccagaccaaggccgacctggacagcagcctggacatcaagaagaaccccgtgccctgccagaagtacagcctgagaaacagcagcaacgtgatgctggacgacaagcagtgcaagatcaagcagatccagctgctgaccaagaagagcgagtgcagcatcctgctgagcaagcagaccagcgacttcctgcaggtgtgcaacgacaccctggagaagagcgagctgaccgtgccctgcgacatcgtgatcgaccaccacgtgagctacgccgccttcagcgccaacagcaagctgctgctgaagaacagcgacaagaacgtgcacagcatgagcatgctggtgaagcccaacagcagccccggcggcaagaccatgtgcaagaacatgagcgacatgcagaacagccagttcaacaactgcctgggctacctggagaacaccaacgtgaacatcagccacctgcacctgaacaacgagaacagccacgccagccaggccaaggacgtgaagaccgccgtgcacatgaagacctgcaccgagaccgagttcagcaacaagaagaaccagatcgacgagaaccaggtgaccgaggccaccaagaacgacctgttcctgttcgtgagcatcaacgagagacagcacaccctgctgaacaacaccgagaagaccgagagcctgaacgacatcgtgagcggcaagatgttcagcgagggccagctggaggagagccacagcttccacatcgagcccagcggcgacctggtgaacagaagcggcagaagcaccttcgacctgagcaccagcgacaagaagaccgagaagacccccgtgtacatgaacttcagcgaccccggcccctggagcaaggtgaaccacatcgagagccagaccgccagcagcagcaccccctgcatcagcctgctgctgaaggagagacccctggaccccagcgagaacaagaagatcatcagcatggccctgtgcaagaacatcggcgtggacgacgtgggcaaggacatcggccccgacaccaccagcatcaacagagtggccgacaccctgaacaactggagcatccaccccgaccccaagggcgagcccagcgaggagaagaacgccatggccaagaccttctacgacagcagcttccccaccgagcacgtgaagaccaagcccctgatcagcacccccctgcagagccacctgcaggccatcaagaccaccaagaacaccagcggcgacgacgactggcagagcctgatcaccaaccagctgaacaagagcgagaacctgctgagcctggagaacgacaaccagcccaagaagagaaaggccgaggagaccctggagaagaacaacagactgaagtag

SEQ ID NO: 77226 - DNA, 1617 bp, Artificial Sequence
  Description of Artificial Sequence: Synthetic coding sequence
atgctgcagatcggcgaggacgtggactacctgctgatccccagagaggtgagactggccggcggcgtgtggagagtgatcagcaagcccgccaccaaggaggccgagttcagagagagactgacccagttcctggaggaggagggcagaaccctggaggacgtggccagaatcatggagaagagcaccccccaccccccccagccccccaagaagcccaaggagcccagagtgagaagaagagtgcagcagatggtgacccccccccccagactggtggtgggcacctacgacagcagcaacgccagcgacagcgagttcagcgacttcgagaccagcagagacaagagcagacagggccccagaagaggcaagaaggtgagaaagatgcccgtgagctacctgggcagcaagttcctgggcagcgacctggagagcgaggacgacgaggagctggtggaggccttcctgagaagacaggagaagcagcccagcgccccccccgccagaagaagagtgaacctgcccgtgcccatgttcgaggacaacctgggcccccagctgagcaaggccgacagatggagagagtacgtgagccaggtgagctggggcaagctgaagagaagagtgaagggctgggcccccagagccggccccggcgtgggcgaggccagactggccagcaccgccgtggagagcgccggcgtgagcagcgcccccgagggcaccagccccggcgacagactgggcaacgccggcgacgtgtgcgtgccccaggccagccccagaagatggagacccaagatcaactgggccagcttcagaagaagaagaaaggagcagaccgcccccaccggccagggcgccgacatcgaggccgaccagggcggcgaggccgccgacagccagagagaggaggccatcgccgaccagagagagggcgccgccggcaaccagagagccggcgcccccgccgaccagggcgccgaggccgccgacaaccagagagaggaggccgccgacaaccagagagccggcgcccccgccgaggagggcgccgaggccgccgacaaccagagagaggaggccgccgacaaccagagagccgaggcccccgccgaccagagaagccagggcaccgacaaccacagagaggaggccgccgacaaccagagagccgaggcccccgccgaccagggcagcgaggtgaccgacaaccagagagaggaggccgtgcacgaccagagagagagagcccccgccgtgcagggcgccgacaaccagagagcccaggccagagccggccagagagccgaggccgcccacaaccagagagccggcgcccccggcatccaggaggccgaggtgagcgccgcccagggcaccaccggcaccgcccccggcgccagagccagaaagcaggtgaagaccgtgagattccagacccccggcagattcagctggttctgcaagagaagaagagccttctggcacacccccagactgcccaccctgcccaagagagtgcccagagccggcgaggccagaaacctgagagtgctgagagccgaggccagagccgaggccgagcagggcgagcaggaggaccagctgtag

SEQ ID NO: 77227 - DNA, 975 bp, Artificial Sequence
  Description of Artificial Sequence: Synthetic coding sequence
atgctgcagatcggcgaggacgtggactacctgctgatccccagagaggtgagactggccggcggcgtgtggagagtgatcagcaagcccgccaccaaggaggccgagttcagagagagactgacccagttcctggaggaggagggcagaaccctggaggacgtggccagaatcatggagaagagcaccccccaccccccccagccccccaagaagcccaaggagcccagagtgagaagaagagtgcagcagatggtgacccccccccccagactggtggtgggcacctacgacagcagcaacgccagcgacagcgagttcagcgacttcgagaccagcagagacaagagcagacagggccccagaagaggcaagaaggtgagaaagatgcccgtgagctacctgggcagcaagttcctgggcagcgacctggagagcgaggacgacgaggagctggtggaggccttcctgagaagacagggcctgcaggtgatcagaggccagggcccccagctgaccagaggccagagactgcagatcatcagaggcaagagactgcagatcatcagaggccagggcccccagctgagaagaggccagagactgcagatcaccagaggcaagagactgcagatcatcagaggccagagaccccagctgaccagaggccacagagcccagatcaccaccggcaagagactgcagatcatcagaggcagaagaccccagctgaccagaggccagagactgcagatcatcaagggcaagagaccctacatgaccagaggcaagggcccccagctgagcagagtgcagatcatcagaggccacagacccggcctggccagaggccagagactgcacatcatcagaggccagggcccccaggtgagcagaaagctgaagagccagctgcccaagggcccccaggagcagctgcaggagcccggccccggcaacagaagcagacagtag

SEQ ID NO: 77228 - DNA, 5532 bp, Artificial Sequence
  Description of Artificial Sequence: Synthetic coding sequence
atggagaacgagatcttcacccccctgctggagcagttcatgaccagccccctggtgacctgggtgaagaccttcggccccctggccgccggcaacggcaccaacctggacgagtacgtggccctggtggacggcgtgttcctgaaccaggtgatgctgcagatcaaccccaagctggagagccagagagtgaacaagaaggtgaacaacgacgccagcctgagaatgcacaacctgagcatcctggtgagacagatcaagttctactaccaggagaccctgcagcagctgatcatgatgagcctgcccaacgtgctgatcatcggcaagaaccccttcagcgagcagggcaccgaggaggtgaagaagctgctgctgctgctgctgggctgcgccgtgcagtgccagaagaaggaggagttcatcgagagaatccagggcctggacttcgacaccaaggccgccgtggccgcccacatccaggaggtgacccacaaccaggagaacgtgttcgacctgcagtggatggaggtgaccgacatgagccaggaggacatcgagcccctgctgaagaacatggccctgcacctgaagagactgatcgacgagagagacgagcacagcgagaccatcatcgagctgagcgaggagagagacggcctgcacttcctgccccacgccagcagcagcgcccagagcccctgcggcagccccggcatgaagagaaccgagagcagacagcacctgagcgtggagctggccgacgccaaggccaagatcagaagactgagacaggagctggaggagaagaccgagcagctgctggactgcaagcaggagctggagcagatggagatcgagctgaagagactgcagcaggagaacatgaacctgctgagcgacgccagaagcgccagaatgtacagagacgagctggacgccctgagagagaaggccgtgagagtggacaagctggagagcgaggtgagcagatacaaggagagactgcacgacatcgagttctacaaggccagagtggaggagctgaaggaggacaaccaggtgctgctggagaccaagaccatgctggaggaccagctggagggcaccagagccagaagcgacaagctgcacgagctggagaaggagaacctgcagctgaaggccaagctgcacgacatggagatggagagagacatggacagaaagaagatcgaggagctgatggaggagaacatgaccctggagatggcccagaagcagagcatggacgagagcctgcacctgggctgggagctggagcagatcagcagaaccagcgagctgagcgaggccccccagaagagcctgggccacgaggtgaacgagctgaccagcagcagactgctgaagctggagatggagaaccagagcctgaccaagaccgtggaggagctgagaaccaccgtggacagcgtggagggcaacgccagcaagatcctgaagatggagaaggagaaccagagactgagcaagaaggtggagatcctggagaacgagatcgtgcaggagaagcagagcctgcagaactgccagaacctgagcaaggacctgatgaaggagaaggcccagctggagaagaccatcgagaccctgagagagaacagcgagagacagatcaagatcctggagcaggagaacgagcacctgaaccagaccgtgagcagcctgagacagagaagccagatcagcgccgaggccagagtgaaggacatcgagaaggagaacaagatcctgcacgagagcatcaaggagaccagcagcaagctgagcaagatcgagttcgagaagagacagatcaagaaggagctggagcactacaaggagaagggcgagagagccgaggagctggagaacgagctgcaccacctggagaaggagaacgagctgctgcagaagaagatcaccaacctgaagatcacctgcgagaagatcgaggccctggagcaggagaacagcgagctggagagagagaacagaaagctgaagaagaccctggacagcttcaagaacctgaccttccagctggagagcctggagaaggagaacagccagctggacgaggagaacctggagctgagaagaaacgtggagagcctgaagtgcgccagcatgaagatggcccagctgcagctggagaacaaggagctggagagcgagaaggagcagctgaagaagggcctggagctgctgaaggccagcttcaagaagaccgagagactggaggtgagctaccagggcctggacatcgagaaccagagactgcagaagaccctggagaacagcaacaagaagatccagcagctggagagcgagctgcaggacctggagatggagaaccagaccctgcagaagaacctggaggagctgaagatcagcagcaagagactggagcagctggagaaggagaacaagagcctggagcaggagaccagccagctggagaaggacaagaagcagctggagaaggagaacaagagactgagacagcaggccgagatcaaggacaccaccctggaggagaacaacgtgaagatcggcaacctggagaaggagaacaagaccctgagcaaggagatcggcatctacaaggagagctgcgtgagactgaaggagctggagaaggagaacaaggagctggtgaagagagccaccatcgacatcaagaccctggtgaccctgagagaggacctggtgagcgagaagctgaagacccagcagatgaacaacgacctggagaagctgacccacgagctggagaagatcggcctgaacaaggagagactgctgcacgacgagcagagcaccgacgacagcagatacaagctgctggagagcaagctggagagcaccctgaagaagagcctggagatcaaggaggagaagatcgccgccctggaggccagactggaggagagcaccaactacaaccagcagctgagacaggagctgaagaccgtgaagaagaactacgaggccctgaagcagagacaggacgaggagagaatggtgcagagcagcccccccatcagcggcgaggacaacaagtgggagagagagagccaggagaccaccagagagctgctgaaggtgaaggacagactgatcgaggtggagagaaacaacgccaccctgcaggccgagaagcaggccctgaagacccagctgaagcagctggagacccagaacaacaacctgcaggcccagatcctggccctgcagagacagaccgtgagcctgcaggagcagaacaccaccctgcagacccagaacgccaagctgcaggtggagaacagcaccctgaacagccagagcaccagcctgatgaaccagaacgcccagctgctgatccagcagagcagcctggagaacgagaacgagagcgtgatcaaggagagagaggacctgaagagcctgtacgacagcctgatcaaggaccacgagaagctggagctgctgcacgagagacaggccagcgagtacgagagcctgatcagcaagcacggcaccctgaagagcgcccacaagaacctggaggtggagcacagagacctggaggacagatacaaccagctgctgaagcagaagggccagctggaggacctggagaagatgctgaaggtggagcaggagaagatgctgctggagaacaagaaccacgagaccgtggccgccgagtacaagaagctgtgcggcgagaacgacagactgaaccacacctacagccagctgctgaaggagaccgaggtgctgcagaccgaccacaagaacctgaagagcctgctgaacaacagcaagctggagcagaccagactggaggccgagttcagcaagctgaaggagcagtaccagcagctggacatcaccagcaccaagctgaacaaccagtgcgagctgctgagccagctgaagggcaacctggaggaggagaacagacacctgctggaccagatccagaccctgatgctgcagaacagaaccctgctggagcagaacatggagagcaaggacctgttccacgtggagcagagacagtacatcgacaagctgaacgagctgagaagacagaaggagaagctggaggagaagatcatggaccagtacaagttctacgaccccagcccccccagaagaagaggcaactggatcaccctgaagatgagaaagctgatcaagagcaagaaggacatcaacagagagagacagaagagcctgaccctgacccccaccagaagcgacagcagcgagggcttcctgcagctgccccaccaggacagccaggacagcagcagcgtgggcagcaacagcctggaggacggccagaccctgggcaccaagaagagcagcaccatgaacgacctggtgcagagcatggtgctggccggccagtggaccggcagcaccgagaacctggaggtgcccgacgacatcagcaccggcaagagaagaaaggagctgggcgccatggccttcagcaccaccgccatcaacttcagcaccgtgaacagcagcgccggcttcagaagcaagcagctggtgaacaacaaggacaccaccagcttcgaggacatcagcccccagggcgtgagcgacgacagcagcaccggcagcagagtgcacgccagcagacccgccagcctggacagcggcagaaccagcaccagcaacagcaacaacaacgccagcctgcacgaggtgaaggccggcgccgtgaacaaccagagcagaccccagagccacagcagcggcgagttcagcctgctgcacgaccacgaggcctggagcagcagcggcagcagccccatccagtacctgaagagacagaccagaagcagccccgtgctgcagcacaagatcagcgagaccctggagagcagacaccacaagatcaagaccggcagccccggcagcgaggtggtgaccctgcagcagttcctggaggagagcaacaagctgaccagcgtgcagatcaagagcagcagccaggagaacctgctggacgaggtgatgaagagcctgagcgtgagcagcgacttcctgggcaaggacaagcccgtgagctgcggcctggccagaagcgtgagcggcaagacccccggcgacttctacgacagaagaaccaccaagcccgagttcctgagacccggccccagaaagaccgaggacacctacttcatcagcagcgccggcaagcccacccccggcacccagggcaagatcaagctggtgaaggagagcagcctgagcagacagagcaaggacagcaacccctacgccaccctgcccagagccagcagcgtgatcagcaccgccgagggcaccaccagaagaaccagcatccacgacttcctgaccaaggacagcagactgcccatcagcgtggacagcccccccgccgccgccgacagcaacaccaccgccgccagcaacgtggacaaggtgcaggagagcagaaacagcaagagcagaagcagagagcagcagagcagctag

SEQ ID NO: 77229 - DNA, 5613 bp, Artificial Sequence
  Description of Artificial Sequence: Synthetic coding sequence
atggagaacgagatcttcacccccctgctggagcagttcatgaccagccccctggtgacctgggtgaagaccttcggccccctggccgccggcaacggcaccaacctggacgagtacgtggccctggtggacggcgtgttcctgaaccaggtgatgctgcagatcaaccccaagctggagagccagagagtgaacaagaaggtgaacaacgacgccagcctgagaatgcacaacctgagcatcctggtgagacagatcaagttctactaccaggagaccctgcagcagctgatcatgatgagcctgcccaacgtgctgatcatcggcaagaaccccttcagcgagcagggcaccgaggaggtgaagaagctgctgctgctgctgctgggctgcgccgtgcagtgccagaagaaggaggagttcatcgagagaatccagggcctggacttcgacaccaaggccgccgtggccgcccacatccaggaggtgacccacaaccaggagaacgtgttcgacctgcagtggatggaggtgaccgacatgagccaggaggacatcgagcccctgctgaagaacatggccctgcacctgaagagactgatcgacgagagagacgagcacagcgagaccatcatcgagctgagcgaggagagagacggcctgcacttcctgccccacgccagcagcagcgcccagagcccctgcggcagccccggcatgaagagaaccgagagcagacagcacctgagcgtggagctggccgacgccaaggccaagatcagaagactgagacaggagctggaggagaagaccgagcagctgctggactgcaagcaggagctggagcagatggagatcgagctgaagagactgcagcaggagaacatgaacctgctgagcgacgccagaagcgccagaatgtacagagacgagctggacgccctgagagagaaggccgtgagagtggacaagctggagagcgaggtgagcagatacaaggagagactgcacgacatcgagttctacaaggccagagtggaggagctgaaggaggacaaccaggtgctgctggagaccaagaccatgctggaggaccagctggagggcaccagagccagaagcgacaagctgcacgagctggagaaggagaacctgcagctgaaggccaagctgcacgacatggagatggagagagacatggacagaaagaagatcgaggagctgatggaggagaacatgaccctggagatggcccagaagcagagcatggacgagagcctgcacctgggctgggagctggagcagatcagcagaaccagcgagctgagcgaggccccccagaagagcctgggccacgaggtgaacgagctgaccagcagcagactgctgaagctggagatggagaaccagagcctgaccaagaccgtggaggagctgagaaccaccgtggacagcgtggagggcaacgccagcaagatcctgaagatggagaaggagaaccagagactgagcaagaaggtggagatcctggagaacgagatcgtgcaggagaagcagagcctgcagaactgccagaacctgagcaaggacctgatgaaggagaaggcccagctggagaagaccatcgagaccctgagagagaacagcgagagacagatcaagatcctggagcaggagaacgagcacctgaaccagaccgtgagcagcctgagacagagaagccagatcagcgccgaggccagagtgaaggacatcgagaaggagaacaagatcctgcacgagagcatcaaggagaccagcagcaagctgagcaagatcgagttcgagaagagacagatcaagaaggagctggagcactacaaggagaagggcgagagagccgaggagctggagaacgagctgcaccacctggagaaggagaacgagctgctgcagaagaagatcaccaacctgaagatcacctgcgagaagatcgaggccctggagcaggagaacagcgagctggagagagagaacagaaagctgaagaagaccctggacagcttcaagaacctgaccttccagctggagagcctggagaaggagaacagccagctggacgaggagaacctggagctgagaagaaacgtggagagcctgaagtgcgccagcatgaagatggcccagctgcagctggagaacaaggagctggagagcgagaaggagcagctgaagaagggcctggagctgctgaaggccagcttcaagaagaccgagagactggaggtgagctaccagggcctggacatcgagaaccagagactgcagaagaccctggagaacagcaacaagaagatccagcagctggagagcgagctgcaggacctggagatggagaaccagaccctgcagaagaacctggaggagctgaagatcagcagcaagagactggagcagctggagaaggagaacaagagcctggagcaggagaccagccagctggagaaggacaagaagcagctggagaaggagaacaagagactgagacagcaggccgagatcaaggacaccaccctggaggagaacaacgtgaagatcggcaacctggagaaggagaacaagaccctgagcaaggagatcggcatctacaaggagagctgcgtgagactgaaggagctggagaaggagaacaaggagctggtgaagagagccaccatcgacatcaagaccctggtgaccctgagagaggacctggtgagcgagaagctgaagacccagcagatgaacaacgacctggagaagctgacccacgagctggagaagatcggcctgaacaaggagagactgctgcacgacgagcagagcaccgacgacagatacaagctgctggagagcaagctggagagcaccctgaagaagagcctggagatcaaggaggagaagatcgccgccctggaggccagactggaggagagcaccaactacaaccagcagctgagacaggagctgaagaccgtgaagaagaactacgaggccctgaagcagagacaggacgaggagagaatggtgcagagcagcccccccatcagcggcgaggacaacaagtgggagagagagagccaggagaccaccagagagctgctgaaggtgaaggacagactgatcgaggtggagagaaacaacgccaccctgcaggccgagaagcaggccctgaagacccagctgaagcagctggagacccagaacaacaacctgcaggcccagatcctggccctgcagagacagaccgtgagcctgcaggagcagaacaccaccctgcagacccagaacgccaagctgcaggtggagaacagcaccctgaacagccagagcaccagcctgatgaaccagaacgcccagctgctgatccagcagagcagcctggagaacgagaacgagagcgtgatcaaggagagagaggacctgaagagcctgtacgacagcctgatcaaggaccacgagaagctggagctgctgcacgagagacaggccagcgagtacgagagcctgatcagcaagcacggcaccctgaagagcgcccacaagaacctggaggtggagcacagagacctggaggacagatacaaccagctgctgaagcagaagggccagctggaggacctggagaagatgctgaaggtggagcaggagaagatgctgctggagaacaagaaccacgagaccgtggccgccgagtacaagaagctgtgcggcgagaacgacagactgaaccacacctacagccagctgctgaaggagaccgaggtgctgcagaccgaccacaagaacctgaagagcctgctgaacaacagcaagctggagcagaccagactggaggccgagttcagcaagctgaaggagcagtaccagcagctggacatcaccagcaccaagctgaacaaccagtgcgagctgctgagccagctgaagggcaacctggaggaggagaacagacacctgctggaccagatccagaccctgatgctgcagaacagaaccctgctggagcagaacatggagagcaaggacctgttccacgtggagcagagacagtacatcgacaagctgaacgagctgagaagacagaaggagaagctggaggagaagatcatggaccagtacaagttctacgaccccagcccccccagaagaagaggcaactggatcaccctgaagatgagaaagctgatcaagagcaagaaggacatcaacagagagagacagaagagcctgaccctgacccccaccagaagcgacagcagcgagggcttcctgcagctgccccaccaggacagccaggacagcagcagcgtgggcagcaacagcctggaggacggccagaccctgggcaccaagaagagcagcatggtggccctgaagagactgcccttcctgagaaacagacccaaggacaaggacaagatgaaggcctgctacagaagaagcatgagcatgaacgacctggtgcagagcatggtgctggccggccagtggaccggcagcaccgagaacctggaggtgcccgacgacatcagcaccggcaagagaagaaaggagctgggcgccatggccttcagcaccaccgccatcaacttcagcaccgtgaacagcagcgccggcttcagaagcaagcagctggtgaacaacaaggacaccaccagcttcgaggacatcagcccccagggcgtgagcgacgacagcagcaccggcagcagagtgcacgccagcagacccgccagcctggacagcggcagaaccagcaccagcaacagcaacaacaacgccagcctgcacgaggtgaaggccggcgccgtgaacaaccagagcagaccccagagccacagcagcggcgagttcagcctgctgcacgaccacgaggcctggagcagcagcggcagcagccccatccagtacctgaagagacagaccagaagcagccccgtgctgcagcacaagatcagcgagaccctggagagcagacaccacaagatcaagaccggcagccccggcagcgaggtggtgaccctgcagcagttcctggaggagagcaacaagctgaccagcgtgcagatcaagagcagcagccaggagaacctgctggacgaggtgatgaagagcctgagcgtgagcagcgacttcctgggcaaggacaagcccgtgagctgcggcctggccagaagcgtgagcggcaagacccccggcgacttctacgacagaagaaccaccaagcccgagttcctgagacccggccccagaaagaccgaggacacctacttcatcagcagcgccggcaagcccacccccggcacccagggcaagatcaagctggtgaaggagagcagcctgagcagacagagcaaggacagcaacccctacgccaccctgcccagagccagcagcgtgatcagcaccgccgagggcaccaccagaagaaccagcatccacgacttcctgaccaaggacagcagactgcccatcagcgtggacagcccccccgccgccgccgacagcaacaccaccgccgccagcaacgtggacaaggtgcaggagagcagaaacagcaagagcagaagcagagagcagcagagcagctag

SEQ ID NO: 77230 - DNA, 2667 bp, Artificial Sequence
  Description of Artificial Sequence: Synthetic coding sequence
ctgctggagagcaagctggagagcaccctgaagaagagcctggagatcaaggaggagaagatcgccgccctggaggccagactggaggagagcaccaactacaaccagcagctgagacaggagctgaagaccgtgaagaagaactacgaggccctgaagcagagacaggacgaggagagaatggtgcagagcagcccccccatcagcggcgaggacaacaagtgggagagagagagccaggagaccaccagagagctgctgaaggtgaaggacagactgatcgaggtggagagaaacaacgccaccctgcaggccgagaagcaggccctgaagacccagctgaagcagctggagacccagaacaacaacctgcaggcccagatcctggccctgcagagacagaccgtgagcctgcaggagcagaacaccaccctgcagacccagaacgccaagctgcaggtggagaacagcaccctgaacagccagagcaccagcctgatgaaccagaacgcccagctgctgatccagcagagcagcctggagaacgagaacgagagcgtgatcaaggagagagaggacctgaagagcctgtacgacagcctgatcaaggaccacgagaagctggagctgctgcacgagagacaggccagcgagtacgagagcctgatcagcaagcacggcaccctgaagagcgcccacaagaacctggaggtggagcacagagacctggaggacagatacaaccagctgctgaagcagaagggccagctggaggacctggagaagatgctgaaggtggagcaggagaagatgctgctggagaacaagaaccacgagaccgtggccgccgagtacaagaagctgtgcggcgagaacgacagactgaaccacacctacagccagctgctgaaggagaccgaggtgctgcagaccgaccacaagaacctgaagagcctgctgaacaacagcaagctggagcagaccagactggaggccgagttcagcaagctgaaggagcagtaccagcagctggacatcaccagcaccaagctgaacaaccagtgcgagctgctgagccagctgaagggcaacctggaggaggagaacagacacctgctggaccagatccagaccctgatgctgcagaacagaaccctgctggagcagaacatggagagcaaggacctgttccacgtggagcagagacagtacatcgacaagctgaacgagctgagaagacagaaggagaagctggaggagaagatcatggaccagtacaagttctacgaccccagcccccccagaagaagaggcaactggatcaccctgaagatgagaaagctgatcaagagcaagaaggacatcaacagagagagacagaagagcctgaccctgacccccaccagaagcgacagcagcgagggcttcctgcagctgccccaccaggacagccaggacagcagcagcgtgggcagcaacagcctggaggacggccagaccctgggcaccaagaagagcagcaccatgaacgacctggtgcagagcatggtgctggccggccagtggaccggcagcaccgagaacctggaggtgcccgacgacatcagcaccggcaagagaagaaaggagctgggcgccatggccttcagcaccaccgccatcaacttcagcaccgtgaacagcagcgccggcttcagaagcaagcagctggtgaacaacaaggacaccaccagcttcgaggacatcagcccccagggcgtgagcgacgacagcagcaccggcagcagagtgcacgccagcagacccgccagcctggacagcggcagaaccagcaccagcaacagcaacaacaacgccagcctgcacgaggtgaaggccggcgccgtgaacaaccagagcagaccccagagccacagcagcggcgagttcagcctgctgcacgaccacgaggcctggagcagcagcggcagcagccccatccagtacctgaagagacagaccagaagcagccccgtgctgcagcacaagatcagcgagaccctggagagcagacaccacaagatcaagaccggcagccccggcagcgaggtggtgaccctgcagcagttcctggaggagagcaacaagctgaccagcgtgcagatcaagagcagcagccaggagaacctgctggacgaggtgatgaagagcctgagcgtgagcagcgacttcctgggcaaggacaagcccgtgagctgcggcctggccagaagcgtgagcggcaagacccccggcgacttctacgacagaagaaccaccaagcccgagttcctgagacccggccccagaaagaccgaggacacctacttcatcagcagcgccggcaagcccacccccggcacccagggcaagatcaagctggtgaaggagagcagcctgagcagacagagcaaggacagcaacccctacgccaccctgcccagagccagcagcgtgatcagcaccgccgagggcaccaccagaagaaccagcatccacgacttcctgaccaaggacagcagactgcccatcagcgtggacagcccccccgccgccgccgacagcaacaccaccgccgccagcaacgtggacaaggtgcaggagagcagaaacagcaagagcagaagcagagagcagcagagcagctag

SEQ ID NO: 77231 - DNA, 5391 bp, Artificial Sequence
  Description of Artificial Sequence: Synthetic coding sequence
atggagaacgagatcttcacccccctgctggagcagttcatgaccagccccctggtgacctgggtgaagaccttcggccccctggccgccggcaacggcaccaacctggacgagtacgtggccctggtggacggcgtgttcctgaaccaggtgatgctgcagatcaaccccaagctggagagccagagagtgaacaagaaggtgaacaacgacgccagcctgagaatgcacaacctgagcatcctggtgagacagatcaagttctactaccaggagaccctgcagcagctgatcatgatgagcctgcccaacgtgctgatcatcggcaagaaccccttcagcgagcagggcaccgaggaggtgaagaagctgctgctgctgctgctgggctgcgccgtgcagtgccagaagaaggaggagttcatcgagagaatccagggcctggacttcgacaccaaggccgccgtggccgcccacatccaggaggtgacccacaaccaggagaacgtgttcgacctgcagtggatggaggtgaccgacatgagccaggaggacatcgagcccctgctgaagaacatggccctgcacctgaagagactgatcgacgagagagacgagcacagcgagaccatcatcgagctgagcgaggagagagacggcctgcacttcctgccccacgccagcagcagcgcccagagcccctgcggcagccccggcatgaagagaaccgagagcagacagcacctgagcgtggagctggccgacgccaaggccaagatcagaagactgagacaggagctggaggagaagaccgagcagctgctggactgcaagcaggagctggagcagatggagatcgagctgaagagactgcagcaggagaacatgaacctgctgagcgacgccagaagcgccagaatgtacagagacgagctggacgccctgagagagaaggccgtgagagtggacaagctggagagcgaggtgagcagatacaaggagagactgcacgacatcgagttctacaaggccagagtggaggagctgaaggaggacaaccaggtgctgctggagaccaagaccatgctggaggaccagctggagggcaccagagccagaagcgacaagctgcacgagctggagaaggagaacctgcagctgaaggccaagctgcacgacatggagatggagagagacatggacagaaagaagatcgaggagctgatggaggagaacatgaccctggagatggcccagaagcagagcatggacgagagcctgcacctgggctgggagctggagcagatcagcagaaccagcgagctgagcgaggccccccagaagagcctgggccacgaggtgaacgagctgaccagcagcagactgctgaagctggagatggagaaccagagcctgaccaagaccgtggaggagctgagaaccaccgtggacagcgtggagggcaacgccagcaagatcctgaagatggagaaggagaaccagagactgagcaagaaggtggagatcctggagaacgagatcgtgcaggagaagcagagcctgcagaactgccagaacctgagcaaggacctgatgaaggagaaggcccagctggagaagaccatcgagaccctgagagagaacagcgagagacagatcaagatcctggagcaggagaacgagcacctgaaccagaccgtgagcagcctgagacagagaagccagatcagcgccgaggccagagtgaaggacatcgagaaggagaacaagatcctgcacgagagcatcaaggagaccagcagcaagctgagcaagatcgagttcgagaagagacagatcaagaaggagctggagcactacaaggagaagggcgagagagccgaggagctggagaacgagctgcaccacctggagaaggagaacgagctgctgcagaagaagatcaccaacctgaagatcacctgcgagaagatcgaggccctggagcaggagaacagcgagctggagagagagaacagaaagctgaagaagaccctggacagcttcaagaacctgaccttccagctggagagcctggagaaggagaacagccagctggacgaggagaacctggagctgagaagaaacgtggagagcctgaagtgcgccagcatgaagatggcccagctgcagctggagaacaaggagctggagagcgagaaggagcagctgaagaagggcctggagctgctgaaggccagcttcaagaagaccgagagactggaggtgagctaccagggcctggacatcgagaaccagagactgcagaagaccctggagaacagcaacaagaagatccagcagctggagagcgagctgcaggacctggagatggagaaccagaccctgcagaagaacctggaggagctgaagatcagcagcaagagactggagcagctggagaaggagaacaagagcctggagcaggagaccagccagctggagaaggacaagaagcagctggagaaggagaacaagagactgagacagcaggccgagatcaaggacaccaccctggaggagaacaacgtgaagatcggcaacctggagaaggagaacaagaccctgagcaaggagatcggcatctacaaggagagctgcgtgagactgaaggagctggagaaggagaacaaggagctggtgaagagagccaccatcgacatcaagaccctggtgaccctgagagaggacctggtgagcgagaagctgaagacccagcagatgaacaacgacctggagaagctgacccacgagctggagaagatcggcctgaacaaggagagactgctgcacgacgagcagagcaccgacgacagatacaagctgctggagagcaagctggagagcaccctgaagaagagcctggagatcaaggaggagaagatcgccgccctggaggccagactggaggagagcaccaactacaaccagcagctgagacaggagctgaagaccgtgaagaagaactacgaggccctgaagcagagacaggacgaggagagaatggtgcagagcagcccccccatcagcggcgaggacaacaagtgggagagagagagccaggagaccaccagagagctgctgaaggtgaaggacagactgatcgaggtggagagaaacaacgccaccctgcaggccgagaagcaggccctgaagacccagctgaagcagctggagacccagaacaacaacctgcaggcccagatcctggccctgcagagacagaccgtgagcctgcaggagcagaacaccaccctgcagacccagaacgccaagctgcaggtggagaacagcaccctgaacagccagagcaccagcctgatgaaccagaacgcccagctgctgatccagcagagcagcctggagaacgagaacgagagcgtgatcaaggagagagaggacctgaagagcctgtacgacagcctgatcaaggaccacgagaagctggagctgctgcacgagagacaggccagcgagtacgagagcctgatcagcaagcacggcaccctgaagagcgcccacaagaacctggaggtggagcacagagacctggaggacagatacaaccagctgctgaagcagaagggccagctggaggacctggagaagatgctgaaggtggagcaggagaagatgctgctggagaacaagaaccacgagaccgtggccgccgagtacaagaagctgtgcggcgagaacgacagactgaaccacacctacagccagctgctgaaggagaccgaggtgctgcagaccgaccacaagaacctgaagagcctgctgaacaacagcaagctggagcagaccagactggaggccgagttcagcaagctgaaggagcagtaccagcagctggacatcaccagcaccaagctgaacaaccagtgcgagctgctgagccagctgaagggcaacctggaggaggagaacagacacctgctggaccagatccagaccctgatgctgcagaacagaaccctgctggagcagaacatggagagcaaggacctgttccacgtggagcagagacagtacatcgacaagctgaacgagctgagaagacagaaggagaagctggaggagaagatcatggaccagtacaagttctacgaccccagcccccccagaagaagaggcaactggatcaccctgaagatgagaaagctgatcaagagcaagaaggacatcaacagagagagacagaagagcctgaccctgacccccaccagaagcgacagcagcgagggcttcctgcagctgccccaccaggacagccaggacagcagcagcgtgggcagcaacagcctggaggacggccagaccctgggcaccaagaagagcagcatggtggccctgaagagactgcccttcctgagaaacagacccaaggacaaggacaagatgaaggcctgctacagaagaagcatgagcatgaacgacctggtgcagagcatggtgctggccggccagtggaccggcagcaccgagaacctggaggtgcccgacgacatcagcaccggcaagagaagaaaggagctgggcgccatggccttcagcaccaccgccatcaacttcagcaccgtgaacagcagcgccggcttcagaagcaagcagctggtgaacaacaaggacaccaccagcttcgaggacatcagcccccagggcgtgagcgacgacagcagcaccggcagcagagtgcacgccagcagacccgccagcctggacagcggcagaaccagcaccagcaacagcaacaacaacgccagcctgcacgaggtgaaggccggcgccgtgaacaaccagagcagaccccagagccacagcagcggcgagttcagcctgctgcacgaccacgaggcctggagcagcagcggcagcagccccatccagtacctgaagagacagaccagaagcagccccgtgctgcagcacaagatcagcgagaccctggagagcagacaccacaagatcaagaccggcagccccggcagcgaggtggtgaccctgcagcagttcctggaggagagcaacaagctgaccagcgtgcagatcaagagcagcagccaggagaacctgctggacgaggtgatgaagagcctgagcgtgagcagcgacttcctgggcaaggacaagcccgtgagctgcggcctggccagcgtgatcagcaccgccgagggcaccaccagaagaaccagcatccacgacttcctgaccaaggacagcagactgcccatcagcgtggacagcccccccgccgccgccgacagcaacaccaccgccgccagcaacgtggacaaggtgcaggagagcagaaacagcaagagcagaagcagagagcagcagagcagctag

SEQ ID NO: 77232 - DNA, 1119 bp, Artificial Sequence
  Description of Artificial Sequence: Synthetic coding sequence
atggaccagtacaagttctacgaccccagcccccccagaagaagaggcaactggatcaccctgaagatgagaaagctgatcaagagcaagaaggacatcaacagagagagacagaagagcctgaccctgacccccaccagaagcgacagcagcgagggcttcctgcagctgccccaccaggacagccaggacagcagcagcgtgggcagcaacagcctggaggacggccagaccctgggcaccaagaagagcagcaacaccaccagcttcgaggacatcagcccccagggcgtgagcgacgacagcagcaccggcagcagagtgcacgccggcgccgtgaacaaccagagcagaccccagagccacagcagcggcgagttcagcctgctgcacgaccacgaggcctggagcagcagcggcagcagccccatccagtacctgaagagacagaccagaagcagccccgtgctgcagcacaagatcagcgagaccctggagagcagacaccacaagatcaagaccggcagccccggcagcgaggtggtgaccctgcagcagttcctggaggagagcaacaagctgaccagcgtgcagatcaagagcagcagccaggagaacctgctggacgaggtgatgaagagcctgagcgtgagcagcgacttcctgggcaaggacaagcccgtgagctgcggcctggccagaagcgtgagcggcaagacccccggcgacttctacgacagaagaaccaccaagcccgagttcctgagacccggccccagaaagaccgaggacacctacttcatcagcagcgccggcaagcccacccccggcacccagggcaagatcaagctggtgaaggagagcagcctgagcagacagagcaaggacagcaacccctacgccaccctgcccagagccagcagcgtgatcagcaccgccgagggcaccaccagaagaaccagcatccacgacttcctgaccaaggacagcagactgcccatcagcgtggacagcccccccgccgccgccgacagcaacaccaccgccgccagcaacgtggacaaggtgcaggagagcagaaacagcaagagcagaagcagagagcagcagagcagctag

SEQ ID NO: 77233 - DNA, 5616 bp, Artificial Sequence
  Description of Artificial Sequence: Synthetic coding sequence
atggagaacgagatcttcacccccctgctggagcagttcatgaccagccccctggtgacctgggtgaagaccttcggccccctggccgccggcaacggcaccaacctggacgagtacgtggccctggtggacggcgtgttcctgaaccaggtgatgctgcagatcaaccccaagctggagagccagagagtgaacaagaaggtgaacaacgacgccagcctgagaatgcacaacctgagcatcctggtgagacagatcaagttctactaccaggagaccctgcagcagctgatcatgatgagcctgcccaacgtgctgatcatcggcaagaaccccttcagcgagcagggcaccgaggaggtgaagaagctgctgctgctgctgctgggctgcgccgtgcagtgccagaagaaggaggagttcatcgagagaatccagggcctggacttcgacaccaaggccgccgtggccgcccacatccaggaggtgacccacaaccaggagaacgtgttcgacctgcagtggatggaggtgaccgacatgagccaggaggacatcgagcccctgctgaagaacatggccctgcacctgaagagactgatcgacgagagagacgagcacagcgagaccatcatcgagctgagcgaggagagagacggcctgcacttcctgccccacgccagcagcagcgcccagagcccctgcggcagccccggcatgaagagaaccgagagcagacagcacctgagcgtggagctggccgacgccaaggccaagatcagaagactgagacaggagctggaggagaagaccgagcagctgctggactgcaagcaggagctggagcagatggagatcgagctgaagagactgcagcaggagaacatgaacctgctgagcgacgccagaagcgccagaatgtacagagacgagctggacgccctgagagagaaggccgtgagagtggacaagctggagagcgaggtgagcagatacaaggagagactgcacgacatcgagttctacaaggccagagtggaggagctgaaggaggacaaccaggtgctgctggagaccaagaccatgctggaggaccagctggagggcaccagagccagaagcgacaagctgcacgagctggagaaggagaacctgcagctgaaggccaagctgcacgacatggagatggagagagacatggacagaaagaagatcgaggagctgatggaggagaacatgaccctggagatggcccagaagcagagcatggacgagagcctgcacctgggctgggagctggagcagatcagcagaaccagcgagctgagcgaggccccccagaagagcctgggccacgaggtgaacgagctgaccagcagcagactgctgaagctggagatggagaaccagagcctgaccaagaccgtggaggagctgagaaccaccgtggacagcgtggagggcaacgccagcaagatcctgaagatggagaaggagaaccagagactgagcaagaaggtggagatcctggagaacgagatcgtgcaggagaagcagagcctgcagaactgccagaacctgagcaaggacctgatgaaggagaaggcccagctggagaagaccatcgagaccctgagagagaacagcgagagacagatcaagatcctggagcaggagaacgagcacctgaaccagaccgtgagcagcctgagacagagaagccagatcagcgccgaggccagagtgaaggacatcgagaaggagaacaagatcctgcacgagagcatcaaggagaccagcagcaagctgagcaagatcgagttcgagaagagacagatcaagaaggagctggagcactacaaggagaagggcgagagagccgaggagctggagaacgagctgcaccacctggagaaggagaacgagctgctgcagaagaagatcaccaacctgaagatcacctgcgagaagatcgaggccctggagcaggagaacagcgagctggagagagagaacagaaagctgaagaagaccctggacagcttcaagaacctgaccttccagctggagagcctggagaaggagaacagccagctggacgaggagaacctggagctgagaagaaacgtggagagcctgaagtgcgccagcatgaagatggcccagctgcagctggagaacaaggagctggagagcgagaaggagcagctgaagaagggcctggagctgctgaaggccagcttcaagaagaccgagagactggaggtgagctaccagggcctggacatcgagaaccagagactgcagaagaccctggagaacagcaacaagaagatccagcagctggagagcgagctgcaggacctggagatggagaaccagaccctgcagaagaacctggaggagctgaagatcagcagcaagagactggagcagctggagaaggagaacaagagcctggagcaggagaccagccagctggagaaggacaagaagcagctggagaaggagaacaagagactgagacagcaggccgagatcaaggacaccaccctggaggagaacaacgtgaagatcggcaacctggagaaggagaacaagaccctgagcaaggagatcggcatctacaaggagagctgcgtgagactgaaggagctggagaaggagaacaaggagctggtgaagagagccaccatcgacatcaagaccctggtgaccctgagagaggacctggtgagcgagaagctgaagacccagcagatgaacaacgacctggagaagctgacccacgagctggagaagatcggcctgaacaaggagagactgctgcacgacgagcagagcaccgacgacagcagatacaagctgctggagagcaagctggagagcaccctgaagaagagcctggagatcaaggaggagaagatcgccgccctggaggccagactggaggagagcaccaactacaaccagcagctgagacaggagctgaagaccgtgaagaagaactacgaggccctgaagcagagacaggacgaggagagaatggtgcagagcagcccccccatcagcggcgaggacaacaagtgggagagagagagccaggagaccaccagagagctgctgaaggtgaaggacagactgatcgaggtggagagaaacaacgccaccctgcaggccgagaagcaggccctgaagacccagctgaagcagctggagacccagaacaacaacctgcaggcccagatcctggccctgcagagacagaccgtgagcctgcaggagcagaacaccaccctgcagacccagaacgccaagctgcaggtggagaacagcaccctgaacagccagagcaccagcctgatgaaccagaacgcccagctgctgatccagcagagcagcctggagaacgagaacgagagcgtgatcaaggagagagaggacctgaagagcctgtacgacagcctgatcaaggaccacgagaagctggagctgctgcacgagagacaggccagcgagtacgagagcctgatcagcaagcacggcaccctgaagagcgcccacaagaacctggaggtggagcacagagacctggaggacagatacaaccagctgctgaagcagaagggccagctggaggacctggagaagatgctgaaggtggagcaggagaagatgctgctggagaacaagaaccacgagaccgtggccgccgagtacaagaagctgtgcggcgagaacgacagactgaaccacacctacagccagctgctgaaggagaccgaggtgctgcagaccgaccacaagaacctgaagagcctgctgaacaacagcaagctggagcagaccagactggaggccgagttcagcaagctgaaggagcagtaccagcagctggacatcaccagcaccaagctgaacaaccagtgcgagctgctgagccagctgaagggcaacctggaggaggagaacagacacctgctggaccagatccagaccctgatgctgcagaacagaaccctgctggagcagaacatggagagcaaggacctgttccacgtggagcagagacagtacatcgacaagctgaacgagctgagaagacagaaggagaagctggaggagaagatcatggaccagtacaagttctacgaccccagcccccccagaagaagaggcaactggatcaccctgaagatgagaaagctgatcaagagcaagaaggacatcaacagagagagacagaagagcctgaccctgacccccaccagaagcgacagcagcgagggcttcctgcagctgccccaccaggacagccaggacagcagcagcgtgggcagcaacagcctggaggacggccagaccctgggcaccaagaagagcagcatggtggccctgaagagactgcccttcctgagaaacagacccaaggacaaggacaagatgaaggcctgctacagaagaagcatgagcatgaacgacctggtgcagagcatggtgctggccggccagtggaccggcagcaccgagaacctggaggtgcccgacgacatcagcaccggcaagagaagaaaggagctgggcgccatggccttcagcaccaccgccatcaacttcagcaccgtgaacagcagcgccggcttcagaagcaagcagctggtgaacaacaaggacaccaccagcttcgaggacatcagcccccagggcgtgagcgacgacagcagcaccggcagcagagtgcacgccagcagacccgccagcctggacagcggcagaaccagcaccagcaacagcaacaacaacgccagcctgcacgaggtgaaggccggcgccgtgaacaaccagagcagaccccagagccacagcagcggcgagttcagcctgctgcacgaccacgaggcctggagcagcagcggcagcagccccatccagtacctgaagagacagaccagaagcagccccgtgctgcagcacaagatcagcgagaccctggagagcagacaccacaagatcaagaccggcagccccggcagcgaggtggtgaccctgcagcagttcctggaggagagcaacaagctgaccagcgtgcagatcaagagcagcagccaggagaacctgctggacgaggtgatgaagagcctgagcgtgagcagcgacttcctgggcaaggacaagcccgtgagctgcggcctggccagaagcgtgagcggcaagacccccggcgacttctacgacagaagaaccaccaagcccgagttcctgagacccggccccagaaagaccgaggacacctacttcatcagcagcgccggcaagcccacccccggcacccagggcaagatcaagctggtgaaggagagcagcctgagcagacagagcaaggacagcaacccctacgccaccctgcccagagccagcagcgtgatcagcaccgccgagggcaccaccagaagaaccagcatccacgacttcctgaccaaggacagcagactgcccatcagcgtggacagcccccccgccgccgccgacagcaacaccaccgccgccagcaacgtggacaaggtgcaggagagcagaaacagcaagagcagaagcagagagcagcagagcagctag

SEQ ID NO: 77234 - DNA, 420 bp, Artificial Sequence
  Description of Artificial Sequence: Synthetic coding sequence
atgccctgcgccgccagaagcagaagcagctggagaagaagctggaccaacaccgcctgctggagcctgtgcccctgccccggccccagaagccccagccccgcccccatgagaagagcccagagcagcctgtgcctgagagacgagaccctggccggcggccagagaagaaagctgagcagcagattccccgtgggcagaagcagcgagagcttcagccccggcgacacccccagacagagattcagacagagacaccccggccccctgggcgcccccgtgagccacagcaagggccccggcgtgggctgggagaacagcgccgagaccctgcaggagcacgagaccgacgccaacagagagggccccgaggtgcaggagcccgagaagagacccctgacccccagcctgagccagtag

SEQ ID NO: 77235 - DNA, 4431 bp, Artificial Sequence
  Description of Artificial Sequence: Synthetic coding sequence
atggagggcggcaagggccccagactgagagacttcctgagcggcagcctggccacctgggccctgggcctggccggcctggtgggcgaggccgaggacagcgagggcgaggaggaggaggaggaggaggagccccccctgtggctggagaagagattcctgagactgagcgacggcgccctgctgctgagagtgctgggcatcatcgcccccagcagcagaggcggccccagaatgctgagaggcctggacggccccgccgcctggagagtgtggaacctgaaccacctgtggggcagactgagagacttctaccaggaggagctgcagctgctgatcctgagccccccccccgacctgcagaccctgggcttcgaccccctgagcgaggaggccgtggagcagctggagggcgtgctgagactgctgctgggcgccagcgtgcagtgcgagcacagagagctgttcatcagacacatccagggcctgagcctggaggtgcagagcgagctggccgccgccatccaggaggtgacccagcccggcgccggcgtggtgctggccctgagcggccccgaccccggcgagctggcccccgccgagctggagatgctgagcagaagcctgatgggcaccctgagcaagctggccagagagagagacctgggcgcccagagactggccgagctgctgctggagagagagcccctgtgcctgagacccgaggcccccagcagagcccccgccgagggccccagccaccacctggccctgcagctggccaacgccaaggcccagctgagaagactgagacaggagctggaggagaaggccgagctgctgctggacagccaggccgaggtgcagggcctggaggccgagatcagaagactgagacaggaggcccaggccctgagcggccaggccaagagagccgagctgtacagagaggaggccgaggccctgagagagagagccggcagactgcccagactgcaggaggagctgagaagatgcagagagagactgcaggccgccgaggcctacaagagccagctggaggaggagagagtgctgagcggcgtgctggaggccagcaaggccctgctggaggagcagctggaggccgccagagagagatgcgccagactgcacgagacccagagagagaacctgctgctgagaaccagactgggcgaggcccacgccgagctggacagcctgagacaccaggtggaccagctggccgaggagaacgtggagctggagctggagctgcagagaagcctggagcccccccccggcagccccggcgaggcccccctggccggcgccgcccccagcctgcaggacgaggtgagagaggccgaggccggcagactgagaaccctggagagagagaacagagagctgagaggcctgctgcaggtgctgcagggccagcccggcggccagcaccccctgctggaggcccccagagaggaccccgtgctgcccgtgctggaggaggccccccagacccccgtggccttcgaccacagcccccagggcctggtgcagaaggccagagacggcggcccccaggccctggacctggccccccccgccctggacagcgtgctggaggccagcgccgagtgcccccaggcccccgacagcgacccccaggaggccgagagccccctgcaggccgccgccatggacccccaggccagcgactggagcccccaggagagcggcagccccgtggagacccaggagagccccgagaaggccggcagaagaagcagcctgcagagccccgccagcgtggcccccccccagggccccggcaccaagatccaggccccccagctgctgggcggcgagaccgagggcagagaggccccccagggcgagctggtgcccgaggcctggggcctgagacaggagggccccgagcacaagcccggccccagcgagcccagcagcgtgcagctggaggagcaggagggccccaaccagggcctggacctggccaccggccaggccgaggccagagagcacgaccagagactggagggcaccgtgagagaccccgcctggcagaagccccagcagaagagcgagggcgccctggaggtgcaggtgtgggagggccccatccccggcgagagcctggccagcggcgtggccgagcaggaggccctgagagaggaggtggcccagctgagaagaaaggccgaggccctgggcgacgagctggaggcccaggccagaaagctggaggcccagaacaccgaggccgccagactgagcaaggagctggcccaggccagaagagccgaggccgaggcccacagagaggccgaggcccaggcctgggagcaggccagactgagagaggccgtggaggccgccggccaggagctggagagcgccagccaggagagagaggccctggtggaggccctggccgccgccggcagagagagaagacagtgggagagagagggcagcagactgagagcccagagcgaggccgccgaggagagaatgcaggtgctggagagcgagggcagacagcacctggaggaggccgagagagagagaagagagaaggaggccctgcaggccgagctggagaaggccgtggtgagaggcaaggagctgggcgacagactggagcacctgcagagagagctggagcaggccgccctggagagacaggagttcctgagagagaaggagagccagcaccagagataccagggcctggagcagagactggaggccgagctgcaggccgccgccaccagcaaggaggaggccctgatggagctgaagaccagagccctgcagctggaggaggagctgttccagctgagacagggccccgccggcctgggccccaagaagagagccgagccccagctggtggagacccagaacgtgagactgatcgaggtggagagaagcaacgccatgctggtggccgagaaggccgccctgcagggccagctgcagcacctggagggccagctgggcagcctgcagggcagagcccaggagctgctgctgcagagccagagagcccaggagcacagcagcagactgcaggccgagaagagcgtgctggagatccagggccaggagctgcacagaaagctggaggtgctggaggaggaggtgagagccgccagacagagccaggaggagaccagaggccagcagcaggccctgctgagagaccacaaggccctggcccagctgcagagaagacaggaggccgagctggagggcctgctggtgagacacagagacctgaaggccaacatgagagccctggagctggcccacagagagctgcagggcagacacgagcagctgcaggcccagagagccagcgtggaggcccaggaggtggccctgctggccgagagagagagactgatgcaggacggccacagacagagaggcctggaggaggagctgagaagactgcagagcgagcacgacagagcccagatgctgctggccgagctgagcagagagagaggcgagctgcagggcgagagaggcgagctgagaggcagactggccagactggagctggagagagcccagctggagatgcagagccagcagctgagagagagcaaccagcagctggacctgagcgcctgcagactgaccacccagtgcgagctgctgacccagctgagaagcgcccaggaggaggagaacagacagctgctggccgaggtgcaggccctgagcagagagaacagagagctgctggagagaagcctggagagcagagaccacctgcacagagagcagagagagtacctggaccagctgaacgccctgagaagagagaagcagaagctggtggagaagatcatggaccagtacagagtgctggagcccgtgcccctgcccagaaccaagaagggcagctggctggccgacaaggtgaagagactgatgagacccagaagagagggcggcccccccggcggcctgagactgggcgccgacggcgccggcagcaccgagagcctgggcggcccccccgagaccgagctgcccgagggcagagaggccgacggcaccggcagccccagccccgcccccatgagaagagcccagagcagcctgtgcctgagagacgagaccctggccggcggccagagaagaaagctgagcagcagattccccgtgggcagaagcagcgagagcttcagccccggcgacacccccagacagagattcagacagagacaccccggccccctgggcgcccccgtgagccacagcaagggccccggcgtgggctgggagaacagcgccgagaccctgcaggagcacgagaccgacgccaacagagagggccccgaggtgcaggagcccgagaagagacccctgacccccagcctgagccagtag

SEQ ID NO: 77236 - DNA, 2139 bp, Artificial Sequence
  Description of Artificial Sequence: Synthetic coding sequence
atggccggcgtggccgcccacagagcccacccccccttcaccgcccacatgaagaacagaggcctgagagaggagctggagaaggccgtggtgagaggcaaggagctgggcgacagactggagcacctgcagagagagctggagcaggccgccctggagagacaggagttcctgagagagaaggagagccagcaccagagataccagggcctggagcagagactggaggccgagctgcaggccgccgccaccagcaaggaggaggccctgatggagctgaagaccagagccctgcagctggaggaggagctgttccagctgagacagggccccgccggcctgggccccaagaagagagccgagccccagctggtggagacccagaacgtgagactgatcgaggtggagagaagcaacgccatgctggtggccgagaaggccgccctgcagggccagctgcagcacctggagggccagctgggcagcctgcagggcagagcccaggagctgctgctgcagagccagagagcccaggagcacagcagcagactgcaggccgagaagagcgtgctggagatccagggccaggagctgcacagaaagctggaggtgctggaggaggaggtgagagccgccagacagagccaggaggagaccagaggccagcagcaggccctgctgagagaccacaaggccctggcccagctgcagagaagacaggaggccgagctggagggcctgctggtgagacacagagacctgaaggccaacatgagagccctggagctggcccacagagagctgcagggcagacacgagcagctgcaggcccagagagccagcgtggaggcccaggaggtggccctgctggccgagagagagagactgatgcaggacggccacagacagagaggcctggaggaggagctgagaagactgcagagcgagcacgacagagcccagatgctgctggccgagctgagcagagagagaggcgagctgcagggcgagagaggcgagctgagaggcagactggccagactggagctggagagagcccagctggagatgcagagccagcagctgagagagagcaaccagcagctggacctgagcgcctgcagactgaccacccagtgcgagctgctgacccagctgagaagcgcccaggaggaggagaacagacagctgctggccgaggtgcaggccctgagcagagagaacagagagctgctggagagaagcctggagagcagagaccacctgcacagagagcagagagagtacctggaccagctgaacgccctgagaagagagaagcagaagctggtggagaagatcatggaccagtacagagtgctggagcccgtgcccctgcccagaaccaagaagggcagctggctggccgacaagggccccctgcccagacacccctgcgccggccccagagcccccagcgcctgcggcatgagaccctggcaggccggcagcggcggcaacagcgcccagggcagcagatggggcgaggccctgagccacagcgccctgggcacccccctgggcaacgacagcgacagcgccatccaggccccctggggcagacccagccccaccgccaaggacctggtgtgggacggcagaacccccctgagaccctgcagaaacaccaagcagatgcccaccgagagagccctgagatacagaaacagaagaaacgtgcccagcccccaccccagcgccagcgacaccgtgggcaccgccggcctgggcgtgcagcccagcagacactggagcgtgagcggcggccccagacagcccaagagcagcggcagccagggcccccagggcgagagcctggacaaggaggcctgggccctgagaagcagcaccgtgagcgccggcgccagaagatggagctgggacgagtgcgtggacagaggcgacggctggccccccagagccgcccccggctggagcagcggcagcagcagatggctgcccctgagacagagaagcctgggcgacccccccgccgagggcggctggcaggagctggccagagagccccccgccctgagcagatgggaggccgagagccagtgctggggcaccgtggcctgggccgacctggagccctag

SEQ ID NO: 77237 - DNA, 4077 bp, Artificial Sequence
  Description of Artificial Sequence: Synthetic coding sequence
atggagggcggcaagggccccagactgagagacttcctgagcggcagcctggccacctgggccctgggcctggccggcctggtgggcgaggccgaggacagcgagggcgaggaggaggaggaggaggaggagccccccctgtggctggagaagagattcctgagactgagcgacggcgccctgctgctgagagtgctgggcatcatcgcccccagcagcagaggcggccccagaatgctgagaggcctggacggccccgccgcctggagagtgtggaacctgaaccacctgtggggcagactgagagacttctaccaggaggagctgcagctgctgatcctgagccccccccccgacctgcagaccctgggcttcgaccccctgagcgaggaggccgtggagcagctggagggcgtgctgagactgctgctgggcgccagcgtgcagtgcgagcacagagagctgttcatcagacacatccagggcctgagcctggaggtgcagagcgagctggccgccgccatccaggaggtgacccagcccggcgccggcgtggtgctggccctgagcggccccgaccccggcgagctggcccccgccgagctggagatgctgagcagaagcctgatgggcaccctgagcaagctggccagagagagagacctgggcgcccagagactggccgagctgctgctggagagagagcccctgtgcctgagacccgaggcccccagcagagcccccgccgagggccccagccaccacctggccctgcagctggccaacgccaaggcccagctgagaagactgagacaggagctggaggagaaggccgagctgctgctggacagccaggccgaggtgcagggcctggaggccgagatcagaagactgagacaggaggcccaggccctgagcggccaggccaagagagccgagctgtacagagaggaggccgaggccctgagagagagagccggcagactgcccagactgcaggaggagctgagaagatgcagagagagactgcaggccgccgaggcctacaagagccagctggaggaggagagagtgctgagcggcgtgctggaggccagcaaggccctgctggaggagcagctggaggccgccagagagagatgcgccagactgcacgagacccagagagagaacctgctgctgagaaccagactgggcgaggcccacgccgagctggacagcctgagacaccaggtggaccagctggccgaggagaacgtggagctggagctggagctgcagagaagcctggagcccccccccggcagccccggcgaggcccccctggccggcgccgcccccagcctgcaggacgaggtgagagaggccgaggccggcagactgagaaccctggagagagagaacagagagctgagaggcctgctgcaggtgctgcagggccagcccggcggccagcaccccctgctggaggcccccagagaggaccccgtgctgcccgtgctggaggaggccccccagacccccgtggccttcgaccacagcccccagggcctggtgcagaaggccagagacggcggcccccaggccctggacctggccccccccgccctggacagcgtgctggaggccagcgccgagtgcccccaggcccccgacagcgacccccaggaggccgagagccccctgcaggccgccgccatggacccccaggccagcgactggagcccccaggagagcggcagccccgtggagacccaggagagccccgagaaggccggcagaagaagcagcctgcagagccccgccagcgtggcccccccccagggccccggcaccaagatccaggccccccagctgctgggcggcgagaccgagggcagagaggccccccagggcgagctggtgcccgaggcctggggcctgagacaggagggccccgagcacaagcccggccccagcgagcccagcagcgtgcagctggaggagcaggagggccccaaccagggcctggacctggccaccggccaggccgaggccagagagcacgaccagagactggagggcaccgtgagagaccccgcctggcagaagccccagcagaagagcgagggcgccctggaggtgcaggtgtgggagggccccatccccggcgagagcctggccagcggcgtggccgagcaggaggccctgagagaggaggtggcccagctgagaagaaaggccgaggccctgggcgacgagctggaggcccaggccagaaagctggaggcccagaacaccgaggccgccagactgagcaaggagctggcccaggccagaagagccgaggccgaggcccacagagaggccgaggcccaggcctgggagcaggccagactgagagaggccgtggaggccgccggccaggagctggagagcgccagccaggagagagaggccctggtggaggccctggccgccgccggcagagagagaagacagtgggagagagagggcagcagactgagagcccagagcgaggccgccgaggagagaatgcaggtgctggagagcgagggcagacagcacctggaggaggccgagagagagagaagagagaaggaggccctgcaggccgagctggagaaggccgtggtgagaggcaaggagctgggcgacagactggagcacctgcagagagagctggagcaggccgccctggagagacaggagttcctgagagagaaggagagccagcaccagagataccagggcctggagcagagactggaggccgagctgcaggccgccgccaccagcaaggaggaggccctgatggagctgaagaccagagccctgcagctggaggaggagctgttccagctgagacagggccccgccggcctgggccccaagaagagagccgagccccagctggtggagacccagaacgtgagactgatcgaggtggagagaagcaacgccatgctggtggccgagaaggccgccctgcagggccagctgcagcacctggagggccagctgggcagcctgcagggcagagcccaggagctgctgctggccgagagagagagactgatgcaggacggccacagacagagaggcctggaggaggagctgagaagactgcagagcgagcacgacagagcccagatgctgctggccgagctgagcagagagagaggcgagctgcagggcgagagaggcgagctgagaggcagactggccagactggagctggagagagcccagctggagatgcagagccagcagctgagagagagcaaccagcagctggacctgagcgcctgcagactgaccacccagtgcgagctgctgacccagctgagaagcgcccaggaggaggagaacagacagctgctggccgaggtgcaggccctgagcagagagaacagagagctgctggagagaagcctggagagcagagaccacctgcacagagagcagagagagtacctggaccagctgaacgccctgagaagagagaagcagaagctggtggagaagatcatggaccagtacagagtgctggagcccgtgcccctgcccagaaccaagaagggcagctggctggccgacaaggtgaagagactgatgagacccagaagagagggcggcccccccggcggcctgagactgggcgccgacggcgccggcagcaccgagagcctgggcggcccccccgagaccgagctgcccgagggcagagaggccgacggcaccggcagccccagccccgcccccatgagaagagcccagagcagcctgtgcctgagagacgagaccctggccggcggccagagaagaaagctgagcagcagattccccgtgggcagaagcagcgagagcttcagccccggcgacacccccagacagagattcagacagagacaccccggccccctgggcgcccccgtgagccacagcaagggccccggcgtgggctgggagaacagcgccgagaccctgcaggagcacgagaccgacgccaacagagagggccccgaggtgcaggagcccgagaagagacccctgacccccagcctgagccagtag

SEQ ID NO: 77238 - DNA, 684 bp, Artificial Sequence
  Description of Artificial Sequence: Synthetic coding sequence
atgggcggcaccaccagcaccagaagagtgaccttcgaggccgacgagaacgagaacatcaccgtggtgaagggcatcagactgagcgagaacgtgatcgacagaatgaaggagagcagccccagcggcagcaagagccagagatacagcggcgcctacggcgccagcgtgagcgacgaggagctgaagagaagagtggccgaggagctggccctggagcaggccaagaaggagagcgaggaccagaagagactgaagcaggccaaggagctggacagagagagagccgccgccaacgagcagctgaccagagccatcctgagagagagaatctgcagcgaggaggagagagccaaggccaagcacctggccagacagctggaggagaaggacagagtgctgaagaagcaggacgccttctacaaggagcagctggccagactggaggagagaagcagcgagttctacagagtgaccaccgagcagtaccagaaggccgccgaggaggtggaggccaagttcaagagatacgagagccaccccgtgtgcgccgacctgcaggccaagatcctgcagtgctacagagagaacacccaccagaccctgaagtgcagcgccctggccacccagtacatgcactgcgtgaaccacgccaagcagagcatgctggagaagggcggctag

SEQ ID NO: 77239 - DNA, 417 bp, Artificial Sequence
  Description of Artificial Sequence: Synthetic coding sequence
atgggcggcaccaccagcaccagaagagtgaccttcgaggccgacgagaacgagaacatcaccgtggtgaagggcatcagactgagcgagaacgtgatcgacagaatgaaggagagcagccccagcggcagcaagagccagagatacagcggcgcctacggcgccagcgtgagcgacgaggagctgaagagaagagtggccgaggagctggccctggagcaggccaagaaggagagcgaggaccagaagagactgaagcaggccaaggagctggacagagagagagccgccgccaacgagcagctgaccagagccatcctgagagagagaatctgcagcgaggaggagagagccaaggccaagcacctgatcaaggtggagctgctgtgggtgaagcccggcgtgctgaccgcctag

SEQ ID NO: 77240 - DNA, 333 bp, Artificial Sequence
  Description of Artificial Sequence: Synthetic coding sequence
atgaagtgcgaggagacccacgcccccaacagcaactgggtgtacgtgatgctgcccagcaagaagaccgtgagaatgcccagcgtgacccagagactgagagaccccgacatcaacccctgcctgagcgagagcgacgccagcaccagatgcctggacgagaacaactacgacagagagagatgcagcacctacttcctgagatacaagaactgcagaagattctggaacagcatcgtgatgcagagaagaaagaacggcgtgaagcccttcatgcccaccgccgccgagagagacgagatcctgagagccgtgggcaacatgccctactag

SEQ ID NO: 77241 - DNA, 258 bp, Artificial Sequence
  Description of Artificial Sequence: Synthetic coding sequence
atgcccagcgtgacccagagactgagagaccccgacatcaacccctgcctgagcgagagcgacgccagcaccagatgcctggacgagaacaactacgacagagagagatgcagcacctacttcctgagatacaagaactgcagaagattctggaacagcatcgtgatgcagagaagaaagaacggcgtgaagcccttcatgcccaccgccgccgagagagacgagatcctgagagccgtgggcaacatgccctactag

SEQ ID NO: 77242 - DNA, 285 bp, Artificial Sequence
  Description of Artificial Sequence: Synthetic coding sequence
atgctgcccagcaagaagaccgtgagaatgcccagcgtgacccagagactgagagaccccgacatcaacccctgcctgagcgagagcgacgccagcaccagatgcctggacgagaacaactacgacagagagagatgcagcacctacttcctgagatacaagaactgcagaagattctggaacagcatcgtgatgcagagaagaaagaacggcgtgaagcccttcatgcccaccgccgccgagagagacgagatcctgagagccgtgggcaacatgccctactag

SEQ ID NO: 77243 - DNA, 135 bp, Artificial Sequence
  Description of Artificial Sequence: Synthetic coding sequence
atgcccagcgtgacccagagactgagagaccccgacatcaacccctgcctgagcgagagcgacgccagcaccagatgcctggacgagaacaactacgacagagagagatgcagcacctacttcctgagatactag

SEQ ID NO: 77244 - DNA, 294 bp, Artificial Sequence
  Description of Artificial Sequence: Synthetic coding sequence
atgcaccagaccagaaccggcaagaagaccgtgagaatgcccagcgtgacccagagactgagagaccccgacatcaacccctgcctgagcgagagcgacgccagcaccagatgcctggacgagaacaactacgacagagagagatgcagcacctacttcctgagatacaagaactgcagaagattctggaacagcatcgtgatgcagagaagaaagaacggcgtgaagcccttcatgcccaccgccgccgagagagacgagatcctgagagccgtgggcaacatgccctactag

SEQ ID NO: 77245 - DNA, 207 bp, Artificial Sequence
  Description of Artificial Sequence: Synthetic coding sequence
atgcaccagaccagaaccggcaagaagaccgtgagaatgcccagcgtgacccagagactgagagaccccgacatcaacccctgcctgagcatcctgttctacctgctgaacgacgccagcctgatcagcgtgagaaacctgatgctgccccccgacgtgtggatgaagatcaccatgaccggcaagggcgtgcccctgaccagctag

SEQ ID NO: 77246 - DNA, 264 bp, Artificial Sequence
  Description of Artificial Sequence: Synthetic coding sequence
atgagcaccagcgtgccccagggccacacctggacccagagagtgaagaaggacgacgaggaggaggaccccctggaccagctgatcagcagaagcggctgcgccgccagccacttcgccgtgcaggagtgcatggcccagcaccaggactggagacagtgccagccccaggtgcaggccttcaaggactgcatgagcgagcagcaggccagaagacaggaggagctgcagagaagacaggagcaggccggcgcccaccactag

SEQ ID NO: 77247 - DNA, 264 bp, Artificial Sequence; identical to SEQ ID NO: 77246
  Description of Artificial Sequence: Synthetic coding sequence

SEQ ID NO: 77248 - DNA, 291 bp, Artificial Sequence
  Description of Artificial Sequence: Synthetic coding sequence
atgttctacagactgcccatccccagaatgagcaccagcgtgccccagggccacacctggacccagagagtgaagaaggacgacgaggaggaggaccccctggaccagctgatcagcagaagcggctgcgccgccagccacttcgccgtgcaggagtgcatggcccagcaccaggactggagacagtgccagccccaggtgcaggccttcaaggactgcatgagcgagcagcaggccagaagacaggaggagctgcagagaagacaggagcaggccggcgcccaccactag

SEQ ID NO: 77249 - DNA, 264 bp, Artificial Sequence; identical to SEQ ID NO: 77246
  Description of Artificial Sequence: Synthetic coding sequence

SEQ ID NO: 77250 - DNA, 1731 bp, Artificial Sequence
  Description of Artificial Sequence: Synthetic coding sequence
atggccgccagcgagaccgtgagactgagactgcagttcgactaccccccccccgccaccccccactgcaccgccttctggctgctggtggacctgaacagatgcagagtggtgaccgacctgatcagcctgatcagacagagattcggcttcagcagcggcgccttcctgggcctgtacctggagggcggcctgctgccccccgccgagagcgccagactggtgagagacaacgactgcctgagagtgaagctggaggagagaggcgtggccgagaacagcgtggtgatcagcaacggcgacatcaacctgagcctgagaaaggccaagaagagagccttccagctggaggagggcgaggagaccgagcccgactgcaagtacagcaagaagcactggaagagcagagagaacaacaacaacaacgagaaggtgctggacctggagcccaaggccgtgaccgaccagaccgtgagcaagaagaacaagagaaagaacaaggccacctgcggcaccgtgggcgacgacaacgaggaggccaagagaaagagccccaagaagaaggagaagtgcgagtacaagaagaaggccaagaaccccaagagccccaaggtgcaggccgtgaaggactgggccaaccagagatgcagcagccccaagggcagcgccagaaacagcctggtgaaggccaagagaaagggcagcgtgagcgtgtgcagcaaggagagccccagcagcagcagcgagagcgagagctgcgacgagagcatcagcgacggccccagcaaggtgaccctggaggccagaaacagcagcgagaagctgcccaccgagctgagcaaggaggagcccagcaccaagaacaccaccgccgacaagctggccatcaagctgggcttcagcctgacccccagcaagggcaagaccagcggcaccaccagcagcagcagcgacagcagcgccgagagcgacgaccagtgcctgatgagcagcagcacccccgagtgcgccgccggcttcctgaagaccgtgggcctgttcgccggcagaggcagacccggccccggcctgagcagccagaccgccggcgccgccggctggagaagaagcggcagcaacggcggcggccaggcccccggcgccagccccagcgtgagcctgcccgccagcctgggcagaggctggggcagagaggagaacctgttcagctggaagggcgccaagggcagaggcatgagaggcagaggcagaggcagaggccaccccgtgagctgcgtggtgaacagaagcaccgacaaccagagacagcagcagctgaacgacgtggtgaagaacagcagcaccatcatccagaaccccgtggagacccccaagaaggactacagcctgctgcccctgctggccgccgccccccaggtgggcgagaagatcgccttcaagctgctggagctgaccagcagctacagccccgacgtgagcgactacaaggagggcagaatcctgagccacaaccccgagacccagcaggtggacatcgagatcctgagcagcctgcccgccctgagagagcccggcaagttcgacctggtgtaccacaacgagaacggcgccgaggtggtggagtacgccgtgacccaggagagcaagatcaccgtgttctggaaggagctgatcgaccccagactgatcatcgagagccccagcaacaccagcagcaccgagcccgcctag

SEQ ID NO: 77251 - DNA, 519 bp, Artificial Sequence
  Description of Artificial Sequence: Synthetic coding sequence
atggccagcgacgagggcaagctgttcgtgggcggcctgagcttcgacaccaacgagcagagcctggagcaggtgttcagcaagtacggccagatcagcgaggtggtggtggtgaaggacagagagacccagagaagcagaggcttcggcttcgtgaccttcgagaacatcgacgacgccaaggacgccatgatggccatgaacggcaagagcgtggacggcagacagatcagagtggaccaggccggcaagagcagcgacaacagaagcagaggctacagaggcggcagcgccggcggcagaggcttcttcagaggcggcagaggcagaggcagaggcttcagcagaggcggcggcgacagaggctacggcggcaacagattcgagagcagaagcggcggctacggcggcagcagagactactacagcagcagaagccagagcggcggctacagcgacagaagcagcggcggcagctacagagacagctacgacagctacgccacccacaacgagtag

SEQ ID NO: 77252 - DNA, 792 bp, Artificial Sequence
  Description of Artificial Sequence: Synthetic coding sequence
atggccagcgacgagggcaagctgttcgtgggcggcctgagcttcgacaccaacgagcagagcctggagcaggtgttcagcaagtacggccagatcagcgaggtggtggtggtgaaggacagagagacccagagaagcagaggcttcggcttcgtgaccttcgagaacatcgacgacgccaaggacgccatgatggccatgaacggcaagagcgtggacggcagacagatcagagtggaccaggccggcggcggcgacagaggctacggcggcaacagattcgagagcagaagcggcggctacggcggcagcagagactactacagcagcagaagccagagcggcggctacagcgacagaagcagcggcggcagctacagagacagctacgacagctacggcaagagccacagcgagggcgccaccctgctgtggcccgccgtgggcgccagattcaccctggtgcccagccccagcaccctgggctggaccctgagaccctgccactgcgcctgccccgaggaggcccacctgagcagccagagccacttctacagaagaacccagaagcccaacgagaccgaccagaagggcaagggcgagagaggccccgccggccagagcgccagatgcatgtgcggcagaagacccgccagcctgggctgcggcggctggctgctgcccggcagaagacccagacccggcctggccagcggcgtgaagctgcccctggtggccagcgtgcccctgcactgcgcctgcttcctgagcagcgccacccacaacgagtag

SEQ ID NO: 77253 - DNA, 735 bp, Artificial Sequence
  Description of Artificial Sequence: Synthetic coding sequence
atgagcagcagatggagcagaagcagccagagcaccgacagaagcctgaagagcgtggacggcagacagatcagagtggaccaggccggcaagagcagcgacaacagaagcagaggctacagaggcggcagcgccggcggcagaggcttcttcagaggcggcagaggcagaggcagaggcttcagcagaggcggcggcgacagaggctacggcggcaacagattcgagagcagaagcggcggctacggcggcagcagagactactacagcagcagaagccagagcggcggctacagcgacagaagcagcggcggcagctacagagacagctacgacagctacggcaagagccacagcgagggcgccaccctgctgtggcccgccgtgggcgccagattcaccctggtgcccagccccagcaccctgggctggaccctgagaccctgccactgcgcctgccccgaggaggcccacctgagcagccagagccacttctacagaagaacccagaagcccaacgagaccgaccagaagggcaagggcgagagaggccccgccggccagagcgccagatgcatgtgcggcagaagacccgccagcctgggctgcggcggctggctgctgcccggcagaagacccagacccggcctggccagcggcgtgaagctgcccctggtggccagcgtgcccctgcactgcgcctgcttcctgagcagcgccacccacaacgagtag

SEQ ID NO: 77254 - DNA, 519 bp, Artificial Sequence; identical to SEQ ID NO: 77251
  Description of Artificial Sequence: Synthetic coding sequence

SEQ ID NO: 77255 - DNA, 2304 bp, Artificial Sequence
  Description of Artificial Sequence: Synthetic coding sequence
atgagcttcgaccccaacctgctgcacaacaacggccacaacggctaccccaacggcaccagcgccgccctgagagagaccggcgtgatcgagaagctgctgaccagctacggcttcatccagtgcagcgagagacaggccagactgttcttccactgcagccagtacaacggcaacctgcaggacctgaaggtgggcgacgacgtggagttcgaggtgagcagcgacagaagaaccggcaagcccatcgccgtgaagctggtgaagatcaagcaggagatcctgcccgaggagagaatgaacggccaggaggtgttctacctgacctacacccccgaggacgtggagggcaacgtgcagctggagaccggcgacaagatcaacttcgtgatcgacaacaacaagcacaccggcgccgtgagcgccagaaacatcatgctgctgaagaagaagcaggccagatgccagggcgtggtgtgcgccatgaaggaggccttcggcttcatcgagagaggcgacgtggtgaaggagatcttcttccactacagcgagttcaagggcgacctggagaccctgcagcccggcgacgacgtggagttcaccatcaaggacagaaacggcaaggaggtggccaccgacgtgagactgctgccccagggcaccgtgatcttcgaggacatcagcatcgagcacttcgagggcaccgtgaccaaggtgatccccaaggtgcccagcaagaaccagaacgaccccctgcccggcagaatcaaggtggacttcgtgatccccaaggagctgcccttcggcgacaaggacaccaagagcaaggtgaccctgctggagggcgaccacgtgagattcaacatcagcaccgacagaagagacaagctggagagagccaccaacatcgaggtgctgagcaacaccttccagttcaccaacgaggccagagagatgggcgtgatcgccgccatgagagacggcttcggcttcatcaagtgcgtggacagagacgtgagaatgttcttccacttcagcgagatcctggacggcaaccagctgcacatcgccgacgaggtggagttcaccgtggtgcccgacatgctgagcgcccagagaaaccacgccatcagaatcaagaagctgcccaagggcaccgtgagcttccacagccacagcgaccacagattcctgggcaccgtggagaaggaggccaccttcagcaaccccaagaccaccagccccaacaagggcaaggagaaggaggccgaggacggcatcatcgcctacgacgactgcggcgtgaagctgaccatcgccttccaggccaaggacgtggagggcagcaccagcccccagatcggcgacaaggtggagttcagcatcagcgacaagcagagacccggccagcaggtggccacctgcgtgagactgctgggcagaaacagcaacagcaagagactgctgggctacgtggccaccctgaaggacaacttcggcttcatcgagaccgccaaccacgacaaggagatcttcttccactacagcgagttcagcggcgacgtggacagcctggagctgggcgacatggtggagtacagcctgagcaagggcaagggcaacaaggtgagcgccgagaaggtgaacaagacccacagcgtgaacggcatcaccgaggaggccgaccccaccatctacagcggcaaggtgatcagacccctgagaagcgtggaccccacccagaccgagtaccagggcatgatcgagatcgtggaggagggcgacatgaagggcgaggtgtaccccttcggcatcgtgggcatggccaacaagggcgactgcctgcagaagggcgagagcgtgaagttccagctgtgcgtgctgggccagaacgcccagaccatggcctacaacatcacccccctgagaagagccaccgtggagtgcgtgaaggaccagttcggcttcatcaactacgaggtgggcgacagcaagaagctgttcttccacgtgaaggaggtgcaggacggcatcgagctgcaggccggcgacgaggtggagttcagcgtgatcctgaaccagagaaccggcaagtgcagcgcctgcaacgtgtggagagtgtgcgagggccccaaggccgtggccgcccccagacccgacagactggtgaacagactgaagaacatcaccctggacgacgccagcgcccccagactgatggtgctgagacagcccagaggccccgacaacagcatgggcttcggcgccgagagaaagatcagacaggccggcgtgatcgactag

SEQ ID NO: 77256 - DNA, 2304 bp, Artificial Sequence; identical to SEQ ID NO: 77255
  Description of Artificial Sequence: Synthetic coding sequence

SEQ ID NO: 77257 - DNA, 2397 bp, Artificial Sequence
  Description of Artificial Sequence: Synthetic coding sequence
atgagcttcgaccccaacctgctgcacaacaacggccacaacggctaccccaacggcaccagcgccgccctgagagagaccggcgtgatcgagaagctgctgaccagctacggcttcatccagtgcagcgagagacaggccagactgttcttccactgcagccagtacaacggcaacctgcaggacctgaaggtgggcgacgacgtggagttcgaggtgagcagcgacagaagaaccggcaagcccatcgccgtgaagctggtgaagatcaagcaggagatcctgcccgaggagagaatgaacggccaggtggtgtgcgccgtgccccacaacctggagagcaagagccccgccgcccccggccagagccccaccggcagcgtgtgctacgagagaaacggcgaggtgttctacctgacctacacccccgaggacgtggagggcaacgtgcagctggagaccggcgacaagatcaacttcgtgatcgacaacaacaagcacaccggcgccgtgagcgccagaaacatcatgctgctgaagaagaagcaggccagatgccagggcgtggtgtgcgccatgaaggaggccttcggcttcatcgagagaggcgacgtggtgaaggagatcttcttccactacagcgagttcaagggcgacctggagaccctgcagcccggcgacgacgtggagttcaccatcaaggacagaaacggcaaggaggtggccaccgacgtgagactgctgccccagggcaccgtgatcttcgaggacatcagcatcgagcacttcgagggcaccgtgaccaaggtgatccccaaggtgcccagcaagaaccagaacgaccccctgcccggcagaatcaaggtggacttcgtgatccccaaggagctgcccttcggcgacaaggacaccaagagcaaggtgaccctgctggagggcgaccacgtgagattcaacatcagcaccgacagaagagacaagctggagagagccaccaacatcgaggtgctgagcaacaccttccagttcaccaacgaggccagagagatgggcgtgatcgccgccatgagagacggcttcggcttcatcaagtgcgtggacagagacgtgagaatgttcttccacttcagcgagatcctggacggcaaccagctgcacatcgccgacgaggtggagttcaccgtggtgcccgacatgctgagcgcccagagaaaccacgccatcagaatcaagaagctgcccaagggcaccgtgagcttccacagccacagcgaccacagattcctgggcaccgtggagaaggaggccaccttcagcaaccccaagaccaccagccccaacaagggcaaggagaaggaggccgaggacggcatcatcgcctacgacgactgcggcgtgaagctgaccatcgccttccaggccaaggacgtggagggcagcaccagcccccagatcggcgacaaggtggagttcagcatcagcgacaagcagagacccggccagcaggtggccacctgcgtgagactgctgggcagaaacagcaacagcaagagactgctgggctacgtggccaccctgaaggacaacttcggcttcatcgagaccgccaaccacgacaaggagatcttcttccactacagcgagttcagcggcgacgtggacagcctggagctgggcgacatggtggagtacagcctgagcaagggcaagggcaacaaggtgagcgccgagaaggtgaacaagacccacagcgtgaacggcatcaccgaggaggccgaccccaccatctacagcggcaaggtgatcagacccctgagaagcgtggaccccacccagaccgagtaccagggcatgatcgagatcgtggaggagggcgacatgaagggcgaggtgtaccccttcggcatcgtgggcatggccaacaagggcgactgcctgcagaagggcgagagcgtgaagttccagctgtgcgtgctgggccagaacgcccagaccatggcctacaacatcacccccctgagaagagccaccgtggagtgcgtgaaggaccagttcggcttcatcaactacgaggtgggcgacagcaagaagctgttcttccacgtgaaggaggtgcaggacggcatcgagctgcaggccggcgacgaggtggagttcagcgtgatcctgaaccagagaaccggcaagtgcagcgcctgcaacgtgtggagagtgtgcgagggccccaaggccgtggccgcccccagacccgacagactggtgaacagactgaagaacatcaccctggacgacgccagcgcccccagactgatggtgctgagacagcccagaggccccgacaacagcatgggcttcggcgccgagagaaagatcagacaggccggcgtgatcgactag

SEQ ID NO: 77258 - DNA, 2442 bp, Artificial Sequence
  Description of Artificial Sequence: Synthetic coding sequence
atggagaacgtgttcaccgtgagcagcgacccccaccccagccccgccgccccccccagcctgagcctgcccctgagcagcagcagcaccagcagcggcaccaagaagcagaagagaacccccacctaccagagaagcatgagcttcgaccccaacctgctgcacaacaacggccacaacggctaccccaacggcaccagcgccgccctgagagagaccggcgtgatcgagaagctgctgaccagctacggcttcatccagtgcagcgagagacaggccagactgttcttccactgcagccagtacaacggcaacctgcaggacctgaaggtgggcgacgacgtggagttcgaggtgagcagcgacagaagaaccggcaagcccatcgccgtgaagctggtgaagatcaagcaggagatcctgcccgaggagagaatgaacggccaggaggtgttctacctgacctacacccccgaggacgtggagggcaacgtgcagctggagaccggcgacaagatcaacttcgtgatcgacaacaacaagcacaccggcgccgtgagcgccagaaacatcatgctgctgaagaagaagcaggccagatgccagggcgtggtgtgcgccatgaaggaggccttcggcttcatcgagagaggcgacgtggtgaaggagatcttcttccactacagcgagttcaagggcgacctggagaccctgcagcccggcgacgacgtggagttcaccatcaaggacagaaacggcaaggaggtggccaccgacgtgagactgctgccccagggcaccgtgatcttcgaggacatcagcatcgagcacttcgagggcaccgtgaccaaggtgatccccaaggtgcccagcaagaaccagaacgaccccctgcccggcagaatcaaggtggacttcgtgatccccaaggagctgcccttcggcgacaaggacaccaagagcaaggtgaccctgctggagggcgaccacgtgagattcaacatcagcaccgacagaagagacaagctggagagagccaccaacatcgaggtgctgagcaacaccttccagttcaccaacgaggccagagagatgggcgtgatcgccgccatgagagacggcttcggcttcatcaagtgcgtggacagagacgtgagaatgttcttccacttcagcgagatcctggacggcaaccagctgcacatcgccgacgaggtggagttcaccgtggtgcccgacatgctgagcgcccagagaaaccacgccatcagaatcaagaagctgcccaagggcaccgtgagcttccacagccacagcgaccacagattcctgggcaccgtggagaaggaggccaccttcagcaaccccaagaccaccagccccaacaagggcaaggagaaggaggccgaggacggcatcatcgcctacgacgactgcggcgtgaagctgaccatcgccttccaggccaaggacgtggagggcagcaccagcccccagatcggcgacaaggtggagttcagcatcagcgacaagcagagacccggccagcaggtggccacctgcgtgagactgctgggcagaaacagcaacagcaagagactgctgggctacgtggccaccctgaaggacaacttcggcttcatcgagaccgccaaccacgacaaggagatcttcttccactacagcgagttcagcggcgacgtggacagcctggagctgggcgacatggtggagtacagcctgagcaagggcaagggcaacaaggtgagcgccgagaaggtgaacaagacccacagcgtgaacggcatcaccgaggaggccgaccccaccatctacagcggcaaggtgatcagacccctgagaagcgtggaccccacccagaccgagtaccagggcatgatcgagatcgtggaggagggcgacatgaagggcgaggtgtaccccttcggcatcgtgggcatggccaacaagggcgactgcctgcagaagggcgagagcgtgaagttccagctgtgcgtgctgggccagaacgcccagaccatggcctacaacatcacccccctgagaagagccaccgtggagtgcgtgaaggaccagttcggcttcatcaactacgaggtgggcgacagcaagaagctgttcttccacgtgaaggaggtgcaggacggcatcgagctgcaggccggcgacgaggtggagttcagcgtgatcctgaaccagagaaccggcaagtgcagcgcctgcaacgtgtggagagtgtgcgagggccccaaggccgtggccgcccccagacccgacagactggtgaacagactgaagaacatcaccctggacgacgccagcgcccccagactgatggtgctgagacagcccagaggccccgacaacagcatgggcttcggcgccgagagaaagatcagacaggccggcgtgatcgactag

SEQ ID NO: 77259 - DNA, 2535 bp, Artificial Sequence
  Description of Artificial Sequence: Synthetic coding sequence
atggagaacgtgttcaccgtgagcagcgacccccaccccagccccgccgccccccccagcctgagcctgcccctgagcagcagcagcaccagcagcggcaccaagaagcagaagagaacccccacctaccagagaagcatgagcttcgaccccaacctgctgcacaacaacggccacaacggctaccccaacggcaccagcgccgccctgagagagaccggcgtgatcgagaagctgctgaccagctacggcttcatccagtgcagcgagagacaggccagactgttcttccactgcagccagtacaacggcaacctgcaggacctgaaggtgggcgacgacgtggagttcgaggtgagcagcgacagaagaaccggcaagcccatcgccgtgaagctggtgaagatcaagcaggagatcctgcccgaggagagaatgaacggccaggtggtgtgcgccgtgccccacaacctggagagcaagagccccgccgcccccggccagagccccaccggcagcgtgtgctacgagagaaacggcgaggtgttctacctgacctacacccccgaggacgtggagggcaacgtgcagctggagaccggcgacaagatcaacttcgtgatcgacaacaacaagcacaccggcgccgtgagcgccagaaacatcatgctgctgaagaagaagcaggccagatgccagggcgtggtgtgcgccatgaaggaggccttcggcttcatcgagagaggcgacgtggtgaaggagatcttcttccactacagcgagttcaagggcgacctggagaccctgcagcccggcgacgacgtggagttcaccatcaaggacagaaacggcaaggaggtggccaccgacgtgagactgctgccccagggcaccgtgatcttcgaggacatcagcatcgagcacttcgagggcaccgtgaccaaggtgatccccaaggtgcccagcaagaaccagaacgaccccctgcccggcagaatcaaggtggacttcgtgatccccaaggagctgcccttcggcgacaaggacaccaagagcaaggtgaccctgctggagggcgaccacgtgagattcaacatcagcaccgacagaagagacaagctggagagagccaccaacatcgaggtgctgagcaacaccttccagttcaccaacgaggccagagagatgggcgtgatcgccgccatgagagacggcttcggcttcatcaagtgcgtggacagagacgtgagaatgttcttccacttcagcgagatcctggacggcaaccagctgcacatcgccgacgaggtggagttcaccgtggtgcccgacatgctgagcgcccagagaaaccacgccatcagaatcaagaagctgcccaagggcaccgtgagcttccacagccacagcgaccacagattcctgggcaccgtggagaaggaggccaccttcagcaaccccaagaccaccagccccaacaagggcaaggagaaggaggccgaggacggcatcatcgcctacgacgactgcggcgtgaagctgaccatcgccttccaggccaaggacgtggagggcagcaccagcccccagatcggcgacaaggtggagttcagcatcagcgacaagcagagacccggccagcaggtggccacctgcgtgagactgctgggcagaaacagcaacagcaagagactgctgggctacgtggccaccctgaaggacaacttcggcttcatcgagaccgccaaccacgacaaggagatcttcttccactacagcgagttcagcggcgacgtggacagcctggagctgggcgacatggtggagtacagcctgagcaagggcaagggcaacaaggtgagcgccgagaaggtgaacaagacccacagcgtgaacggcatcaccgaggaggccgaccccaccatctacagcggcaaggtgatcagacccctgagaagcgtggaccccacccagaccgagtaccagggcatgatcgagatcgtggaggagggcgacatgaagggcgaggtgtaccccttcggcatcgtgggcatggccaacaagggcgactgcctgcagaagggcgagagcgtgaagttccagctgtgcgtgctgggccagaacgcccagaccatggcctacaacatcacccccctgagaagagccaccgtggagtgcgtgaaggaccagttcggcttcatcaactacgaggtgggcgacagcaagaagctgttcttccacgtgaaggaggtgcaggacggcatcgagctgcaggccggcgacgaggtggagttcagcgtgatcctgaaccagagaaccggcaagtgcagcgcctgcaacgtgtggagagtgtgcgagggccccaaggccgtggccgcccccagacccgacagactggtgaacagactgaagaacatcaccctggacgacgccagcgcccccagactgatggtgctgagacagcccagaggccccgacaacagcatgggcttcggcgccgagagaaagatcagacaggccggcgtgatcgactag

SEQ ID NO: 77260 - DNA, 141 bp, Artificial Sequence
  Description of Artificial Sequence: Synthetic coding sequence
atgagcttcgaccccaacctgctgcacaacaacggccacaacggctaccccaacggcaccagcgccgccctgagagagaccggcgtgatcgagaagctgctgaccagctacggcttcatccagtgcagcgagagacagtag

SEQ ID NO: 77261 - DNA, 24 bp, Artificial Sequence
  Description of Artificial Sequence: Synthetic coding sequence
atgagcttcgaccccaacctgtag

SEQ ID NO: 77262 - DNA, 2007 bp, Artificial Sequence
  Description of Artificial Sequence: Synthetic coding sequence
atgaacggccaggaggtgttctacctgacctacacccccgaggacgtggagggcaacgtgcagctggagaccggcgacaagatcaacttcgtgatcgacaacaacaagcacaccggcgccgtgagcgccagaaacatcatgctgctgaagaagaagcaggccagatgccagggcgtggtgtgcgccatgaaggaggccttcggcttcatcgagagaggcgacgtggtgaaggagatcttcttccactacagcgagttcaagggcgacctggagaccctgcagcccggcgacgacgtggagttcaccatcaaggacagaaacggcaaggaggtggccaccgacgtgagactgctgccccagggcaccgtgatcttcgaggacatcagcatcgagcacttcgagggcaccgtgaccaaggtgatccccaaggtgcccagcaagaaccagaacgaccccctgcccggcagaatcaaggtggacttcgtgatccccaaggagctgcccttcggcgacaaggacaccaagagcaaggtgaccctgctggagggcgaccacgtgagattcaacatcagcaccgacagaagagacaagctggagagagccaccaacatcgaggtgctgagcaacaccttccagttcaccaacgaggccagagagatgggcgtgatcgccgccatgagagacggcttcggcttcatcaagtgcgtggacagagacgtgagaatgttcttccacttcagcgagatcctggacggcaaccagctgcacatcgccgacgaggtggagttcaccgtggtgcccgacatgctgagcgcccagagaaaccacgccatcagaatcaagaagctgcccaagggcaccgtgagcttccacagccacagcgaccacagattcctgggcaccgtggagaaggaggccaccttcagcaaccccaagaccaccagccccaacaagggcaaggagaaggaggccgaggacggcatcatcgcctacgacgactgcggcgtgaagctgaccatcgccttccaggccaaggacgtggagggcagcaccagcccccagatcggcgacaaggtggagttcagcatcagcgacaagcagagacccggccagcaggtggccacctgcgtgagactgctgggcagaaacagcaacagcaagagactgctgggctacgtggccaccctgaaggacaacttcggcttcatcgagaccgccaaccacgacaaggagatcttcttccactacagcgagttcagcggcgacgtggacagcctggagctgggcgacatggtggagtacagcctgagcaagggcaagggcaacaaggtgagcgccgagaaggtgaacaagacccacagcgtgaacggcatcaccgaggaggccgaccccaccatctacagcggcaaggtgatcagacccctgagaagcgtggaccccacccagaccgagtaccagggcatgatcgagatcgtggaggagggcgacatgaagggcgaggtgtaccccttcggcatcgtgggcatggccaacaagggcgactgcctgcagaagggcgagagcgtgaagttccagctgtgcgtgctgggccagaacgcccagaccatggcctacaacatcacccccctgagaagagccaccgtggagtgcgtgaaggaccagttcggcttcatcaactacgaggtgggcgacagcaagaagctgttcttccacgtgaaggaggtgcaggacggcatcgagctgcaggccggcgacgaggtggagttcagcgtgatcctgaaccagagaaccggcaagtgcagcgcctgcaacgtgtggagagtgtgcgagggccccaaggccgtggccgcccccagacccgacagactggtgaacagactgaagaacatcaccctggacgacgccagcgcccccagactgatggtgctgagacagcccagaggccccgacaacagcatgggcttcggcgccgagagaaagatcagacaggccggcgtgatcgactag

SEQ ID NO: 77263 - DNA, 288 bp, Artificial Sequence
  Description of Artificial Sequence: Synthetic coding sequence
atgagcttcgaccccaacctgctgcacaacaacggccacaacggctaccccaacggcaccagcgccgccctgagagagaccggcgtgatcgagaagctgctgaccagctacggcttcatccagtgcagcgagagacaggccagactgttcttccactgcagccagtacaacggcaacctgcaggacctgaaggtgggcgacgacgtggagttcgaggtgagcagcgacagaagaaccggcaagcccatcgccgtgaagctggtgaagatcaagcaggagatcctgtag

SEQ ID NO: 77264 - DNA, 2397 bp, Artificial Sequence; identical to SEQ ID NO: 77257
  Description of Artificial Sequence: Synthetic coding sequence

SEQ ID NO: 77265 - DNA, 1329 bp, Artificial Sequence
  Description of Artificial Sequence: Synthetic coding sequence
atggaggccagcagatgcagactgagccccagcggcgacagcgtgttccacgaggagatgatgaagatgagacaggccaagctggactaccagagactgctgctggagaagagacagagaaagaagagactggagcccttcatggtgcagcccaaccccgaggccagactgagaagagccaagcccagagccagcgacgagcagacccccctggtgaactgccacaccccccacagcaacgtgatcctgcacggcatcgacggccccgccgccgtgctgaagcccgacgaggtgcacgcccccagcgtgagcagcagcgtggtggaggaggacgccgagaacaccgtggacaccgccagcaagcccggcctgcaggagagactgcagaagcacgacatcagcgagagcgtgaacttcgacgaggagaccgacggcatcagccagagcgcctgcctggagagacccaacagcgccagcagccagaacagcaccgacaccggcaccagcggcagcgccaccgccgcccagcccgccgacaacctgctgggcgacatcgacgacctggaggacttcgtgtacagccccgccccccagggcgtgaccgtgagatgcagaatcatcagagacaagagaggcatggacagaggcctgttccccacctactacatgtacctggagaaggaggagaaccagaagatcttcctgctggccgccagaaagagaaagaagagcaagaccgccaactacctgatcagcatcgaccccgtggacctgagcagagagggcgagagctacgtgggcaagctgagaagcaacctgatgggcaccaagttcaccgtgtacgacagaggcatctgccccatgaagggcagaggcctggtgggcgccgcccacaccagacaggagctggccgccatcagctacgagaccaacgtgctgggcttcaagggccccagaaagatgagcgtgatcatccccggcatgaccctgaaccacaagcagatcccctaccagccccagaacaaccacgacagcctgctgagcagatggcagaacagaaccatggagaacctggtggagctgcacaacaaggcccccgtgtggaacagcgacacccagagctacgtgctgaacttcagaggcagagtgacccaggccagcgtgaagaacttccagatcgtgcacaagaacgaccccgactacatcgtgatgcagttcggcagagtggccgacgacgtgttcaccctggactacaactaccccctgtgcgccgtgcaggccttcggcatcggcctgagcagcttcgacagcaagctggcctgcgagtag

SEQ ID NO: 77266 - DNA, 912 bp, Artificial Sequence
  Description of Artificial Sequence: Synthetic coding sequence
atgagcgaggccggcgaggccaccaccaccaccaccaccaccctgccccaggcccccaccgaggccgccgccgccgccccccaggaccccgcccccaagagccccgtgggcagcggcgccccccaggccgccgcccccgcccccgccgcccacgtggccggcaaccccggcggcgacgccgcccccgccgccaccggcaccgccgccgccgccagcctggccaccgccgccggcagcgaggacgccgagaagaaggtgctggccaccaaggtgctgggcaccgtgaagtggttcaacgtgagaaacggctacggcttcatcaacagaaacgacaccaaggaggacgtgttcgtgcaccagaccgccatcaagaagaacaaccccagaaagtacctgagaagcgtgggcgacggcgagaccgtggagttcgacgtggtggagggcgagaagggcgccgaggccgccaacgtgaccggccccgacggcgtgcccgtggagggcagcagatacgccgccgacagaagaagatacagaagaggctactacggcagaagaagaggcccccccagaaacgccggcgagatcggcgagatgaaggacggcgtgcccgagggcgcccagctgcagggccccgtgcacagaaaccccacctacagacccagatacagaagcagaggcccccccagacccagacccgcccccgccgtgggcgaggccgaggacaaggagaaccagcaggccaccagcggccccaaccagcccagcgtgagaagaggctacagaagaccctacaactacagaagaagacccagaccccccaacgcccccagccaggacggcaaggaggccaaggccggcgaggcccccaccgagaaccccgccccccccacccagcagagcagcgccgagtag

SEQ ID NO: 77267 - DNA, 339 bp, Artificial Sequence
  Description of Artificial Sequence: Synthetic coding sequence
atggagaagatcctgatcctgctgctggtggccctgagcgtggcctacgccgcccccggccccagaggcatcatcatcaacctggagaacggcgagctgtgcatgaacagcgcccagtgcaagagcaactgctgccagcacagcagcgccctgggcctggccagatgcaccagcatggccagcgagaacagcgagtgcagcgtgaagaccctgtacggcatctactacaagtgcccctgcgagagaggcctgacctgcgagggcgacaagaccatcgtgggcagcatcaccaacaccaacttcggcatctgccacgacgccggcagaagcaagcagtag

SEQ ID NO: 77268 - DNA, 216 bp, Artificial Sequence
  Description of Artificial Sequence: Synthetic coding sequence
atggagaagatcctgatcctgctgctggtggccctgagcgtggcctacgccgcccccggccccagaggcatcatcatcaacctgaccctgtacggcatctactacaagtgcccctgcgagagaggcctgacctgcgagggcgacaagaccatcgtgggcagcatcaccaacaccaacttcggcatctgccacgacgccggcagaagcaagcagtag

SEQ ID NO: 77269 - DNA, 408 bp, Artificial Sequence
  Description of Artificial Sequence: Synthetic coding sequence
atgcagctgacctgggccagcatcagcctggtgaccagatgctggccccagacccccaccttccaggacctgctggcctgcctgggcgccagagccctgcccggcccccccggcgcccccggcagagacggcagcaagggcgagagaggcgcccccggccccagaggcagccccggcccccccggcagcttcgacttcctgctgctgatgctggccgacatcagaaacgacatcaccgagctgcaggagaaggtgttcggccacagaacccacagcagcgccgaggagttccccctgccccaggagttccccagctaccccgaggccatggacctgggcagcggcgacgaccaccccagaagaaccgagaccagagacctgagagcccccagagacttctacccctag

SEQ ID NO: 77270 - DNA, 1221 bp, Artificial Sequence
  Description of Artificial Sequence: Synthetic coding sequence
atggtgccccccccccccagcagaggcggcgccgccagaggccagctgggcagaagcctgggccccctgctgctgctgctggccctgggccacacctggacctacagagaggagcccgaggacggcgacagagagatctgcagcgagagcaagatcgccaccaccaagtacccctgcctgaagagcagcggcgagctgaccacctgctacagaaagaagtgctgcaagggctacaagttcgtgctgggccagtgcatccccgaggactacgacgtgtgcgccgaggccccctgcgagcagcagtgcaccgacaacttcggcagagtgctgtgcacctgctaccccggctacagatacgacagagagagacacagaaagagagagaagccctactgcctggacatcgacgagtgcgccagcagcaacggcaccctgtgcgcccacatctgcatcaacaccctgggcagctacagatgcgagtgcagagagggctacatcagagaggacgacggcaagacctgcaccagaggcgacaagtaccccaacgacaccggccacgagaagagcgagaacatggtgaaggccggcacctgctgcgccacctgcaaggagttctaccagatgaagcagaccgtgctgcagctgaagcagaagatcgccctgctgcccaacaacgccgccgacctgggcaagtacatcaccggcgacaaggtgctggccagcaacacctacctgcccggcccccccggcctgcccggcggccagggcccccccggcagccccggccccaagggcagccccggcttccccggcatgcccggcccccccggccagcccggccccagaggcagcatgggccccatgggccccagccccgacctgagccacatcaagcagggcagaagaggccccgtgggcccccccggcgcccccggcagagacggcagcaagggcgagagaggcgcccccggccccagaggcagccccggcccccccggcagcttcgacttcctgctgctgatgctggccgacatcagaaacgacatcaccgagctgcaggagaaggtgttcggccacagaacccacagcagcgccgaggagttccccctgccccaggagttccccagctaccccgaggccatggacctgggcagcggcgacgaccaccccagaagaaccgagaccagagacctgagagcccccagagacttctacccctag

SEQ ID NO: 77271 - DNA, 699 bp, Artificial Sequence
  Description of Artificial Sequence: Synthetic coding sequence
atgtggccccccggcagaagcatcaccgtgaagctgagagagaagaccgtgagcagaaagctggagatgaacggccccagcgccttccagggcctgatctgcggcaagtacaacggcatgtgcctgcagggccccgccggcgtgcccggcagagacggcagccccggcgccaacggcatccccggcacccccggcatccccggcagagacggcttcaagggcgagaagggcgagtgcctgagagagagcttcgaggagagctggacccccaactacaagcagtgcagctggagcagcctgaactacggcatcgacctgggcaagatcgccgagtgcaccttcaccaagatgagaagcaacagcgccctgagagtgctgttcagcggcagcctgagactgaagtgcagaaacgcctgctgccagagatggtacttcaccttcaacggcgccgagtgcagcggccccctgcccatcgaggccatcatctacctggaccagggcagccccgagatgaacagcaccatcaacatccacagaaccagcagcgtggagggcctgtgcgagggcatcggcgccggcctggtggacgtggccatctgggtgggcacctgcagcgactaccccaagggcgacgccagcaccggctggaacagcgtgagcagaatcatcatcgaggagctgcccaactacctgttctag

SEQ ID NO: 77272 - DNA, 732 bp, Artificial Sequence
  Description of Artificial Sequence: Synthetic coding sequence
atgagaccccagggccccgccgccagcccccagagactgagaggcctgctgctgctgctgctgctgcagctgcccgcccccagcagcgccagcgagatccccaagggcaagcagaaggcccagctgagacagagagaggtggtggacctgtacaacggcatgtgcctgcagggccccgccggcgtgcccggcagagacggcagccccggcgccaacggcatccccggcacccccggcatccccggcagagacggcttcaagggcgagaagggcgagtgcctgagagagagcttcgaggagagctggacccccaactacaagcagtgcagctggagcagcctgaactacggcatcgacctgggcaagatcgccgagtgcaccttcaccaagatgagaagcaacagcgccctgagagtgctgttcagcggcagcctgagactgaagtgcagaaacgcctgctgccagagatggtacttcaccttcaacggcgccgagtgcagcggccccctgcccatcgaggccatcatctacctggaccagggcagccccgagatgaacagcaccatcaacatccacagaaccagcagcgtggagggcctgtgcgagggcatcggcgccggcctggtggacgtggccatctgggtgggcacctgcagcgactaccccaagggcgacgccagcaccggctggaacagcgtgagcagaatcatcatcgaggagctgcccaagtag

SEQ ID NO: 77273 - DNA, 690 bp, Artificial Sequence
  Description of Artificial Sequence: Synthetic coding sequence
atgtggccccccggcagaagcatcaccgtgaagctgagagagaagaccgtgagcagaaagctggagatgaacggccccagcgccttccagggcctgatctgcggcaagtacaacggcatgtgcctgcagggccccgccggcgtgcccggcagagacggcagccccggcgccaacggcatccccggcacccccggcatccccggcagagacggcttcaagggcgagaagggcgagtgcctgagagagagcttcgaggagagctggacccccaactacaagcagtgcagctggagcagcctgaactacggcatcgacctgggcaagatcgccgagtgcaccttcaccaagatgagaagcaacagcgccctgagagtgctgttcagcggcagcctgagactgaagtgcagaaacgcctgctgccagagatggtacttcaccttcaacggcgccgagtgcagcggccccctgcccatcgaggccatcatctacctggaccagggcagccccgagatgaacagcaccatcaacatccacagaaccagcagcgtggagggcctgtgcgagggcatcggcgccggcctggtggacgtggccatctgggtgggcacctgcagcgactaccccaagggcgacgccagcaccggctggaacagcgtgagcagaatcatcatcgaggagctgcccaagtag

SEQ ID NO: 77274 - DNA, 5037 bp, Artificial Sequence
  Description of Artificial Sequence: Synthetic coding sequence
atgcaccccggcctgtggctgctgctggtgaccctgtgcctgaccgaggagctggccgccgccggcgagaagagctacggcaagccctgcggcggccaggactgcagcggcagctgccagtgcttccccgagaagggcgccagaggcagacccggccccatcggcatccagggccccaccggcccccagggcttcaccggcagcaccggcctgagcggcctgaagggcgagagaggcttccccggcctgctgggcccctacggccccaagggcgacaagggccccatgggcgtgcccggcttcctgggcatcaacggcatccccggccaccccggccagcccggccccagaggcccccccggcctggacggctgcaacggcacccagggcgccgtgggcttccccggccccgacggctaccccggcctgctgggcccccccggcctgcccggccagaagggcagcaagggcgaccccgtgctggcccccggcagcttcaagggcatgaagggcgaccccggcctgcccggcctggacggcatcaccggcccccagggcgcccccggcttccccggcgccgtgggccccgccggcccccccggcctgcagggcccccccggcccccccggccccctgggccccgacggcaacatgggcctgggcttccagggcgagaagggcgtgaagggcgacgtgggcctgcccggccccgccggccccccccccagcaccggcgagctggagttcatgggcttccccaagggcaagaagggcagcaagggcgagcccggccccaagggcttccccggcatcagcggcccccccggcttccccggcctgggcaccaccggcgagaagggcgagaagggcgagaagggcatccccggcctgcccggccccagaggccccatgggcagcgagggcgtgcagggcccccccggccagcagggcaagaagggcaccctgggcttccccggcctgaacggcttccagggcatcgagggccagaagggcgacatcggcctgcccggccccgacgtgttcatcgacatcgacggcgccgtgatcagcggcaaccccggcgaccccggcgtgcccggcctgcccggcctgaagggcgacgagggcatccagggcctgagaggccccagcggcgtgcccggcctgcccgccctgagcggcgtgcccggcgccctgggcccccagggcttccccggcctgaagggcgaccagggcaaccccggcagaaccaccatcggcgccgccggcctgcccggcagagacggcctgcccggcccccccggcccccccggcccccccagccccgagttcgagaccgagaccctgcacaacaaggagagcggcttccccggcctgagaggcgagcagggccccaagggcaacctgggcctgaagggcatcaagggcgacagcggcttctgcgcctgcgacggcggcgtgcccaacaccggcccccccggcgagcccggcccccccggcccctggggcctgatcggcctgcccggcctgaagggcgccagaggcgacagaggcagcggcggcgcccagggccccgccggcgcccccggcctggtgggccccctgggccccagcggccccaagggcaagaagggcgagcccatcctgagcaccatccagggcatgcccggcgacagaggcgacagcggcagccagggcttcagaggcgtgatcggcgagcccggcaaggacggcgtgcccggcctgcccggcctgcccggcctgcccggcgacggcggccagggcttccccggcgagaagggcctgcccggcctgcccggcgagaagggccaccccggcccccccggcctgcccggcaacggcctgcccggcctgcccggccccagaggcctgcccggcgacaagggcaaggacggcctgcccggccagcagggcctgcccggcagcaagggcatcaccctgccctgcatcatccccggcagctacggccccagcggcttccccggcacccccggcttccccggccccaagggcagcagaggcctgcccggcacccccggccagcccggcagcagcggcagcaagggcgagcccggcagccccggcctggtgcacctgcccgagctgcccggcttccccggccccagaggcgagaagggcctgcccggcttccccggcctgcccggcaaggacggcctgcccggcatgatcggcagccccggcctgcccggcagcaagggcgccaccggcgacatcttcggcgccgagaacggcgcccccggcgagcagggcctgcagggcctgaccggccacaagggcttcctgggcgacagcggcctgcccggcctgaagggcgtgcacggcaagcccggcctgctgggccccaagggcgagagaggcagccccggcacccccggccaggtgggccagcccggcacccccggcagcagcggcccctacggcatcaagggcaagagcggcctgcccggcgcccccggcttccccggcatcagcggccaccccggcaagaagggcaccagaggcaagaagggcccccccggcagcatcgtgaagaagggcctgcccggcctgaagggcctgcccggcaaccccggcctggtgggcctgaagggcagccccggcagccccggcgtggccggcctgcccgccctgagcggccccaagggcgagaagggcagcgtgggcttcgtgggcttccccggcatccccggcctgcccggcatccccggcaccagaggcctgaagggcatccccggcagcaccggcaagatgggccccagcggcagagccggcacccccggcgagaagggcgacagaggcaaccccggccccgtgggcatccccagccccagaagacccatgagcaacctgtggctgaagggcgacaagggcagccagggcagcgccggcagcaacggcttccccggccccagaggcgacaagggcgaggccggcagacccggcccccccggcctgcccggcgcccccggcctgcccggcatcatcaagggcgtgagcggcaagcccggcccccccggcttcatgggcatcagaggcctgcccggcctgaagggcagcagcggcatcaccggcttccccggcatgcccggcgagagcggcagccagggcatcagaggcagccccggcctgcccggcgccagcggcctgcccggcctgaagggcgacaacggccagaccgtggagatcagcggcagccccggccccaagggccagcccggcgagagcggcttcaagggcaccaagggcagagacggcctgatcggcaacatcggcttccccggcaacaagggcgaggacggcaaggtgggcgtgagcggcgacgtgggcctgcccggcgcccccggcttccccggcgtggccggcatgagaggcgagcccggcctgcccggcagcagcggccaccagggcgccatcggccccctgggcagccccggcctgatcggccccaagggcttccccggcttccccggcctgcacggcctgaacggcctgcccggcaccaagggcacccacggcacccccggccccagcatcaccggcgtgcccggccccgccggcctgcccggccccaagggcgagaagggctaccccggcatcggcatcggcgcccccggcaagcccggcctgagaggccagaagggcgacagaggcttccccggcctgcagggccccgccggcctgcccggcgcccccggcatcagcctgcccagcctgatcgccggccagcccggcgaccccggcagacccggcctggacggcgagagaggcagacccggccccgccggcccccccggcccccccggccccagcagcaaccagggcgacaccggcgaccccggcttccccggcatccccggcttcagcggcctgcccggcgagctgggcctgaagggcatgagaggcgagcccggcttcatgggcacccccggcaaggtgggcccccccggcgaccccggcttccccggcatgaagggcaaggccggccccagaggcagcagcggcctgcagggcgaccccggccagacccccaccgccgaggccgtgcaggtgccccccggccccctgggcctgcccggcatcgacggcatccccggcctgaccggcgaccccggcgcccagggccccgtgggcctgcagggcagcaagggcctgcccggcatccccggcaaggacggccccagcggcctgcccggcccccccggcgccctgggcgaccccggcctgcccggcctgcagggcccccccggcttcgagggcgcccccggccagcagggccccttcggcatgcccggcatgcccggccagagcatgagagtgggctacaccctggtgaagcacagccagagcgagcaggtgcccccctgccccatcggcatgagccagctgtgggtgggctacagcctgctgttcgtggagggccaggagaaggcccacaaccaggacctgggcttcgccggcagctgcctgcccagattcagcaccatgcccttcatctactgcaacatcaacgaggtgtgccactacgccagaagaaacgacaagagctactggctgagcaccaccgcccccatccccatgatgcccgtgagccagacccagatcccccagtacatcagcagatgcagcgtgtgcgaggcccccagccaggccatcgccgtgcacagccaggacatcaccatcccccagtgccccctgggctggagaagcctgtggatcggctacagcttcctgatgcacaccgccgccggcgccgagggcggcggccagagcctggtgagccccggcagctgcctggaggacttcagagccacccccttcatcgagtgcagcggcgccagaggcacctgccactacttcgccaacaagtacagcttctggctgaccaccgtggaggagagacagcagttcggcgagctgcccgtgagcgagaccctgaaggccggccagctgcacaccagagtgagcagatgccaggtgtgcatgaagagcctgtag

SEQ ID NO: 77275 - DNA, 3087 bp, Artificial Sequence
  Description of Artificial Sequence: Synthetic coding sequence
atgagagccgccagagccctgctgcccctgctgctgcaggcctgctggaccgccgcccaggacgagcccgagacccccagagccgtggccttccaggactgccccgtggacctgttcttcgtgctggacaccagcgagagcgtggccctgagactgaagccctacggcgccctggtggacaaggtgaagagcttcaccaagagattcatcgacaacctgagagacagatactacagatgcgacagaaacctggtgtggaacgccggcgccctgcactacagcgacgaggtggagatcatccagggcctgaccagaatgcccggcggcagagacgccctgaagagcagcgtggacgccgtgaagtacttcggcaagggcacctacaccgactgcgccatcaagaagggcctggagcagctgctggtgggcggcagccacctgaaggagaacaagtacctgatcgtggtgaccgacggccaccccctggagggctacaaggagccctgcggcggcctggaggacgccgtgaacgaggccaagcacctgggcgtgaaggtgttcagcgtggccatcacccccgaccacctggagcccagactgagcatcatcgccaccgaccacacctacagaagaaacttcaccgccgccgactggggccagagcagagacgccgaggaggccatcagccagaccatcgacaccatcgtggacatgatcaagaacaacgtggagcaggtgtgctgcagcttcgagtgccagcccgccagaggcccccccggcctgagaggcgaccccggcttcgagggcgagagaggcaagcccggcctgcccggcgagaagggcgaggccggcgaccccggcagacccggcgacctgggccccgtgggctaccagggcatgaagggcgagaagggcagcagaggcgagaagggcagcagaggccccaagggctacaagggcgagaagggcaagagaggcatcgacggcgtggacggcgtgaagggcgagatgggctaccccggcctgcccggctgcaagggcagccccggcttcgacggcatccagggcccccccggccccaagggcgaccccggcgccttcggcctgaagggcgagaagggcgagcccggcgccgacggcgaggccggcagacccggcagcagcggccccagcggcgacgagggccagcccggcgagcccggcccccccggcgagaagggcgaggccggcgacgagggcaaccccggccccgacggcgcccccggcgagagaggcggccccggcgagagaggccccagaggcacccccggcaccagaggccccagaggcgaccccggcgaggccggcccccagggcgaccagggcagagagggccccgtgggcgtgcccggcgaccccggcgaggccggccccatcggccccaagggctacagaggcgacgagggcccccccggcagcgagggcgccagaggcgcccccggccccgccggcccccccggcgaccccggcctgatgggcgagagaggcgaggacggccccgccggcaacggcaccgagggcttccccggcttccccggctaccccggcaacagaggcgcccccggcatcaacggcaccaagggctaccccggcctgaagggcgacgagggcgaggccggcgaccccggcgacgacaacaacgacatcgcccccagaggcgtgaagggcgccaagggctacagaggccccgagggcccccagggcccccccggccaccagggcccccccggccccgacgagtgcgagatcctggacatcatcatgaagatgtgcagctgctgcgagtgcaagtgcggccccatcgacctgctgttcgtgctggacagcagcgagagcatcggcctgcagaacttcgagatcgccaaggacttcgtggtgaaggtgatcgacagactgagcagagacgagctggtgaagttcgagcccggccagagctacgccggcgtggtgcagtacagccacagccagatgcaggagcacgtgagcctgagaagccccagcatcagaaacgtgcaggagctgaaggaggccatcaagagcctgcagtggatggccggcggcaccttcaccggcgaggccctgcagtacaccagagaccagctgctgccccccagccccaacaacagaatcgccctggtgatcaccgacggcagaagcgacacccagagagacaccacccccctgaacgtgctgtgcagccccggcatccaggtggtgagcgtgggcatcaaggacgtgttcgacttcatccccggcagcgaccagctgaacgtgatcagctgccagggcctggcccccagccagggcagacccggcctgagcctggtgaaggagaactacgccgagctgctggaggacgccttcctgaagaacgtgaccgcccagatctgcatcgacaagaagtgccccgactacacctgccccatcaccttcagcagccccgccgacatcaccatcctgctggacggcagcgccagcgtgggcagccacaacttcgacaccaccaagagattcgccaagagactggccgagagattcctgaccgccggcagaaccgaccccgcccacgacgtgagagtggccgtggtgcagtacagcggcaccggccagcagagacccgagagagccagcctgcagttcctgcagaactacaccgccctggccagcgccgtggacgccatggacttcatcaacgacgccaccgacgtgaacgacgccctgggctacgtgaccagattctacagagaggccagcagcggcgccgccaagaagagactgctgctgttcagcgacggcaacagccagggcgccacccccgccgccatcgagaaggccgtgcaggaggcccagagagccggcatcgagatcttcgtggtggtggtgggcagacaggtgaacgagccccacatcagagtgctggtgaccggcaagaccgccgagtacgacgtggcctacggcgagagccacctgttcagagtgcccagctaccaggccctgctgagaggcgtgttccaccagaccgtgagcagaaaggtggccctgggctag

SEQ ID NO: 77276 - DNA, 1770 bp, Artificial Sequence
  Description of Artificial Sequence: Synthetic coding sequence
atgagagccgccagagccctgctgcccctgctgctgcaggcctgctggaccgccgcccaggacgagcccgagacccccagagccgtggccttccaggactgccccgtggacctgttcttcgtgctggacaccagcgagagcgtggccctgagactgaagccctacggcgccctggtggacaaggtgaagagcttcaccaagagattcatcgacaacctgagagacagatactacagatgcgacagaaacctggtgtggaacgccggcgccctgcactacagcgacgaggtggagatcatccagggcctgaccagaatgcccggcggcagagacgccctgaagagcagcgtggacgccgtgaagtacttcggcaagggcacctacaccgactgcgccatcaagaagggcctggagcagctgctggtgggcggcagccacctgaaggagaacaagtacctgatcgtggtgaccgacggccaccccctggagggctacaaggagccctgcggcggcctggaggacgccgtgaacgaggccaagcacctgggcgtgaaggtgttcagcgtggccatcacccccgaccacctggagcccagactgagcatcatcgccaccgaccacacctacagaagaaacttcaccgccgccgactggggccagagcagagacgccgaggaggccatcagccagaccatcgacaccatcgtggacatgatcaagaacaacgtggagcaggtgtgctgcagcttcgagtgccagcccgccagaggcccccccggcctgagaggcgaccccggcttcgagggcgagagaggcaagcccggcctgcccggcgagaagggcgaggccggcgaccccggcagacccggcgacctgggccccgtgggctaccagggcatgaagggcgagaagggcagcagaggcgagaagggcagcagaggccccaagggctacaagggcgagaagggcaagagaggcatcgacggcgtggacggcgtgaagggcgagatgggctaccccggcctgcccggctgcaagggcagccccggcttcgacggcatccagggcccccccggccccaagggcgaccccggcgccttcggcctgaagggcgagaagggcgagcccggcgccgacggcgaggccggcagacccggcagcagcggccccagcggcgacgagggccagcccggcgagcccggcccccccggcgagaagggcgaggccggcgacgagggcaaccccggccccgacggcgcccccggcgagagaggcggccccggcgagagaggccccagaggcacccccggcaccagaggccccagaggcgaccccggcgaggccggcccccagggcgaccagggcagagagggccccgtgggcgtgcccggcgaccccggcgaggccggccccatcggccccaagggctacagaggcgacgagggcccccccggcagcgagggcgccagaggcgcccccggccccgccggcccccccggcgaccccggcctgatgggcgagagaggcgaggacggccccgccggcaacggcaccgagggcttccccggcttccccggctaccccggcaacagaggcgcccccggcatcaacggcaccaagggctaccccggcctgaagggcgacgagggcgaggccggcgaccccggcgacgacaacaacgacatcgcccccagactgctgagagtgctgctggtgaccggcctggacctgggccccaccgccctggaggccgccgccgaccagcactag

SEQ ID NO: 77277 - DNA, 324 bp, Artificial Sequence
  Description of Artificial Sequence: Synthetic coding sequence
atgagagccgccagagccctgctgcccctgctgctgcaggcctgctggaccgccgcccaggacgagcccgagacccccagagccgtggccttccaggactgccccgtggacctgttcttcgtgctggacaccagcgagagcgtggccctgagactgaagccctacggcgccctggtggacaaggtgaagagcttcaccaagagattcatcgacaacctgagagacagatactacagatgcgacagaaacctggtgtggaacgccggcgccctgcactacagcgacgaggtggagatcatccagggcctgaccagaatgccctag

SEQ ID NO: 77278 - DNA, 3060 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagccccgacaccaccgagagaaacaacaactgccccgagaagaccgactgccccatccacgtgtacttcgtgctggacaccagcgagagcgtgaccatgcagagccccaccgacatcctgctgttccacatgaagcagttcgtgccccagttcatcagccagctgcagaacgagttctacctggaccaggtggccctgagctggagatacggcggcctgcacttcagcgaccaggtggaggtgttcagcccccccggcagcgacagagccagcttcatcaagaacctgcagggcatcagcagcttcagaagaggcaccttcaccgactgcgccctggccaacatgaccgagcagatcagacaggacagaagcaagggcaccgtgcacttcgccgtggtgatcaccgacggccacgtgaccggcagcccctgcggcggcatcaagctgcaggccgagagagccagagaggagggcatcagactgttcgccgtggcccccaaccagaacctgaaggagcagggcctgagagacatcgccagcaccccccacgagctgtacagaaacgactacgccaccatgctgcccgacagcaccgagatcgaccaggacaccatcaacagaatcatcaaggtgatgaagcacgaggcctacggcgagtgctacaaggtgagctgcctggagatccccggccccagcggccccaagggctacagaggccagaagggcgccaagggcaacatgggcgagcccggcgagcccggccagaagggcagacagggcgaccccggcatcgagggccccatcggcttccccggccccaagggcgtgcccggcttcaagggcgagaagggcgagttcggcgccgacggcagaaagggcgcccccggcctggccggcaagaacggcaccgacggccagaagggcaagctgggcagaatcggcccccccggctgcaagggcgaccccggcaacagaggccccgacggctaccccggcgaggccggcagccccggcgagagaggcgaccagggcggcaagggcgaccccggcagacccggcagaagaggcccccccggcgagatcggcgccaagggcagcaagggctaccagggcaacagcggcgcccccggcagccccggcgtgaagggcgccaagggcggccccggccccagaggccccaagggcgagcccggcagaagaggcgaccccggcaccaagggcagccccggcagcgacggccccaagggcgagaagggcgaccccggccccgagggccccagaggcctggccggcgaggtgggcaacaagggcgccaagggcgacagaggcctgcccggccccagaggcccccagggcgccctgggcgagcccggcaagcagggcagcagaggcgaccccggcgacgccggccccagaggcgacagcggccagcccggccccaagggcgaccccggcagacccggcttcagctaccccggccccagaggcgcccccggcgagaagggcgagcccggccccagaggccccgagggcggcagaggcgacttcggcctgaagggcgagcccggcagaaagggcgagaagggcgagcccgccgaccccggcccccccggcgagcccggccccagaggccccagaggcgtgcccggccccgagggcgagcccggcccccccggcgaccccggcctgaccgagtgcgacgtgatgacctacgtgagagagacctgcggctgctgcgactgcgagaagagatgcggcgccctggacgtggtgttcgtgatcgacagcagcgagagcatcggctacaccaacttcaccctggagaagaacttcgtgatcaacgtggtgaacagactgggcgccatcgccaaggaccccaagagcgagaccggcaccagagtgggcgtggtgcagtacagccacgagggcaccttcgaggccatccagctggacgacgagagaatcgacagcctgagcagcttcaaggaggccgtgaagaacctggagtggatcgccggcggcacctggacccccagcgccctgaagttcgcctacgacagactgatcaaggagagcagaagacagaagaccagagtgttcgccgtggtgatcaccgacggcagacacgaccccagagacgacgacctgaacctgagagccctgtgcgacagagacgtgaccgtgaccgccatcggcatcggcgacatgttccacgagaagcacgagagcgagaacctgtacagcatcgcctgcgacaagccccagcaggtgagaaacatgaccctgttcagcgacctggtggccgagaagttcatcgacgacatggaggacgtgctgtgccccgacccccagatcgtgtgccccgacctgccctgccagaccgagctgagcgtggcccagtgcacccagagacccgtggacatcgtgttcctgctggacggcagcgagagactgggcgagcagaacttccacaaggccagaagattcgtggagcaggtggccagaagactgaccctggccagaagagacgacgaccccctgaacgccagagtggccctgctgcagttcggcggccccggcgagcagcaggtggccttccccctgagccacaacctgaccgccatccacgaggccctggagaccacccagtacctgaacagcttcagccacgtgggcgccggcgtggtgcacgccatcaacgccatcgtgagaagccccagaggcggcgccagaagacacgccgagctgagcttcgtgttcctgaccgacggcgtgaccggcaacgacagcctgcacgagagcgcccacagcatgagaaagcagaacgtggtgcccaccgtgctggccctgggcagcgacgtggacatggacgtgctgaccaccctgagcctgggcgacagagccgccgtgttccacgagaaggactacgacagcctggcccagcccggcttcttcgacagattcatcagatggatctgctag

SEQ ID NO: 77279 - DNA, 2487 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagccccgacaccaccgagagaaacaacaactgccccgagaagaccgactgccccatccacgtgtacttcgtgctggacaccagcgagagcgtgaccatgcagagccccaccgacatcctgctgttccacatgaagcagttcgtgccccagttcatcagccagctgcagaacgagttctacctggaccaggtggccctgagctggagatacggcggcctgcacttcagcgaccaggtggaggtgttcagcccccccggcagcgacagagccagcttcatcaagaacctgcagggcatcagcagcttcagaagaggcaccttcaccgactgcgccctggccaacatgaccgagcagatcagacaggacagaagcaagggcaccgtgcacttcgccgtggtgatcaccgacggccacgtgaccggcagcccctgcggcggcatcaagctgcaggccgagagagccagagaggagggcatcagactgttcgccgtggcccccaaccagaacctgaaggagcagggcctgagagacatcgccagcaccccccacgagctgtacagaaacgactacgccaccatgctgcccgacagcaccgagatcgaccaggacaccatcaacagaatcatcaaggtgatgaagcacgaggcctacggcgagtgctacaaggtgagctgcctggagatccccggccccagcggccccaagggctacagaggccagaagggcgccaagggcaacatgggcgagcccggcgagcccggccagaagggcagacagggcgaccccggcatcgagggccccatcggcttccccggccccaagggcgtgcccggcttcaagggcgagaagggcgagttcggcgccgacggcagaaagggcgcccccggcctggccggcaagaacggcaccgacggccagaagggcaagctgggcagaatcggcccccccggctgcaagggcgaccccggcaacagaggccccgacggctaccccggcgaggccggcagccccggcgagagaggcgaccagggcggcaagggcgaccccggcagacccggcagaagaggcccccccggcgagatcggcgccaagggcagcaagggctaccagggcaacagcggcgcccccggcagccccggcgtgaagggcgccaagggcggccccggccccagaggccccaagggcgagcccggcagaagaggcgaccccggcaccaagggcagccccggcagcgacggccccaagggcgagaagggcgaccccggccccgagggccccagaggcctggccggcgaggtgggcaacaagggcgccaagggcgacagaggcctgcccggccccagaggcccccagggcgccctgggcgagcccggcaagcagggcagcagaggcgaccccggcgacgccggccccagaggcgacagcggccagcccggccccaagggcgaccccggcagacccggcttcagctaccccggccccagaggcgcccccggcgagaagggcgagcccggccccagaggccccgagggcggcagaggcgacttcggcctgaagggcgagcccggcagaaagggcgagaagggcgagcccgccgaccccggcccccccggcgagcccggccccagaggccccagaggcgtgcccggccccgagggcgagcccggcccccccggcgaccccggcctgaccgagtgcgacgtgatgacctacgtgagagagacctgcggctgctgcgactgcgagaagagatgcggcgccctggacgtggtgttcgtgatcgacagcagcgagagcatcggctacaccaacttcaccctggagaagaacttcgtgatcaacgtggtgaacagactgggcgccatcgccaaggaccccaagagcgagaccggcaccagagtgggcgtggtgcagtacagccacgagggcaccttcgaggccatccagctggacgacgagagaatcgacagcctgagcagcttcaaggaggccgtgaagaacctggagtggatcgccggcggcacctggacccccagcgccctgaagttcgcctacgacagactgatcaaggagagcagaagacagaagaccagagtgttcgccgtggtgatcaccgacggcagacacgaccccagagacgacgacctgaacctgagagccctgtgcgacagagacgtgaccgtgaccgccatcggcatcggcgacatgttccacgagaagcacgagagcgagaacctgtacagcatcgcctgcgacaagccccagcaggtgagaaacatgaccctgttcagcgacctggtggccgagaagttcatcgacgacatggaggacgtgctgtgccccgacccccagatcgtgtgccccgacctgccctgccagaccggcctggacggcgccgtgctgtgctag

SEQ ID NO: 77280 - DNA, 2757 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagccccgacaccaccgagagaaacaacaactgccccgagaagaccgactgccccatccacgtgtacttcgtgctggacaccagcgagagcgtgaccatgcagagccccaccgacatcctgctgttccacatgaagcagttcgtgccccagttcatcagccagctgcagaacgagttctacctggaccaggtggccctgagctggagatacggcggcctgcacttcagcgaccaggtggaggtgttcagcccccccggcagcgacagagccagcttcatcaagaacctgcagggcatcagcagcttcagaagaggcaccttcaccgactgcgccctggccaacatgaccgagcagatcagacaggacagaagcaagggcaccgtgcacttcgccgtggtgatcaccgacggccacgtgaccggcagcccctgcggcggcatcaagctgcaggccgagagagccagagaggagggcatcagactgttcgccgtggcccccaaccagaacctgaaggagcagggcctgagagacatcgccagcaccccccacgagctgtacagaaacgactacgccaccatgctgcccgacagcaccgagatcgaccaggacaccatcaacagaatcatcaaggtgatgaagcacgaggcctacggcgagtgctacaaggtgagctgcctggagatccccggccccagcggccccaagggctacagaggccagaagggcgccaagggcaacatgggcgagcccggcgagcccggccagaagggcagacagggcgaccccggcatcgagggccccatcggcttccccggccccaagggcgtgcccggcttcaagggcgagaagggcgagttcggcgccgacggcagaaagggcgcccccggcctggccggcaagaacggcaccgacggccagaagggcaagctgggcagaatcggcccccccggctgcaagggcgaccccggcaacagaggccccgacggctaccccggcgaggccggcagccccggcgagagaggcgaccagggcggcaagggcgaccccggcagacccggcagaagaggcccccccggcgagatcggcgccaagggcagcaagggctaccagggcaacagcggcgcccccggcagccccggcgtgaagggcgccaagggcggccccggccccagaggccccaagggcgagcccggcagaagaggcgaccccggcaccaagggcagccccggcagcgacggccccaagggcgagaagggcgaccccggccccgagggccccagaggcctggccggcgaggtgggcaacaagggcgccaagggcgacagaggcctgcccggccccagaggcccccagggcgccctgggcgagcccggcaagcagggcagcagaggcgaccccggcgacgccggccccagaggcgacagcggccagcccggccccaagggcgaccccggcagacccggcttcagctaccccggccccagaggcgcccccggcgagaagggcgagcccggccccagaggccccgagggcggcagaggcgacttcggcctgaagggcgagcccggcagaaagggcgagaagggcgagcccgccgaccccggcccccccggcgagcccggccccagaggccccagaggcgtgcccggccccgagggcgagcccggcccccccggcgaccccggcctgaccgagtgcgacgtgatgacctacgtgagagagacctgcggctgctgcgactgcgagaagagatgcggcgccctggacgtggtgttcgtgatcgacagcagcgagagcatcggctacaccaacttcaccctggagaagaacttcgtgatcaacgtggtgaacagactgggcgccatcgccaaggaccccaagagcgagaccggcaccagagtgggcgtggtgcagtacagccacgagggcaccttcgaggccatccagctggacgacgagagaatcgacagcctgagcagcttcaaggaggccgtgaagaacctggagtggatcgccggcggcacctggacccccagcgccctgaagttcgcctacgacagactgatcaaggagagcagaagacagaagaccagagtgttcgccgtggtgatcaccgacggcagacacgaccccagagacgacgacctgaacctgagagccctgtgcgacagagacgtgaccgtgaccgccatcggcatcggcgacatgttccacgagaagcacgagagcgagaacctgtacagcatcgcctgcgacaagccccagcaggtgagaaacatgaccctgttcagcgacctggtggccgagaagttcatcgacgacatggaggacgtgctgtgccccgacccccagatcgtgtgccccgacctgccctgccagaccgacgccccctggcccggcggcgagccccccgtgaccttcctgagaaccgaggagggccccgacgccaccttccccagaaccatccccctgatccagcagctgctgaacgccaccgagctgacccaggaccccgccgcctacagccagctggtggccgtgctggtgtacaccgccgagagagccaagttcgccaccggcgtggagagacaggactggatggagctgttcatcgacaccttcaagctggtgcacagagacatcgtgggcgaccccgagaccgccctggccctgtgctag

SEQ ID NO: 77281 - DNA, 2757 bp, Artificial Sequence; identical to SEQ ID NO: 77280
  Description of Artificial Sequence: Synthetic coding sequence

SEQ ID NO: 77282 - DNA, 2487 bp, Artificial Sequence; identical to SEQ ID NO: 77279
  Description of Artificial Sequence: Synthetic coding sequence

SEQ ID NO: 77283 - DNA, 543 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagccccgacaccaccgagagaaacaacaactgccccgagaagaccgactgccccatccacgtgtacttcgtgctggacaccagcgagagcgtgaccatgcagagccccaccgacatcctgctgttccacatgaagcagttcgtgccccagttcatcagccagctgcagaacgagttctacctggaccaggtggccctgagctggagatacggcggcctgcacttcagcgaccaggtggaggtgttcagcccccccggcagcgacagagccagcttcatcaagaacctgcagggcatcagcagcttcagaagaggcaccttcaccgactgcgccctggccaacatgaccgagcagatcagacaggacagaagcaagggcaccgtgcacttcgccgtggtgatcaccgacggccacgtgaccggcagcccctgcggcggcatcaagctgcaggccgagagagcctag

SEQ ID NO: 77284 - DNA, 2235 bp, Artificial Sequence
  Description of Artificial Sequence: Synthetic coding sequence
atggccgtgctgcccggccccctgcagctgctgggcgtgctgctgaccatcagcctgagcagcatcagactgatccaggccggcgcctactacggcatcaagcccctgcccccccagatccccccccagatgcccccccagatcccccagtaccagcccctgggccagcaggtgccccacatgcccctggccaaggacggcctggccatgggcaaggagatgccccacctgcagtacggcaaggagtacccccacctgccccagtacatgaaggagatccagcccgcccccagaatgggcaaggaggccgtgcccaagaagggcaaggagatccccctggccagcctgagaggcgagcagggccccagaggcgagcccggccccagaggcccccccggcccccccggcctgcccggccacggcatccccggcatcaagggcaagcccggcccccagggctaccccggcgtgggcaagcccggcatgcccggcatgcccggcaagcccggcgccatgggcatgcccggcgccaagggcgagatcggccagaagggcgagatcggccccatgggcatccccggcccccagggcccccccggcccccacggcctgcccggcatcggcaagcccggcggccccggcctgcccggccagcccggccccaagggcgacagaggccccaagggcctgcccggcccccagggcctgagaggccccaagggcgacaagggcttcggcatgcccggcgcccccggcgtgaagggcccccccggcatgcacggcccccccggccccgtgggcctgcccggcgtgggcaagcccggcgtgaccggcttccccggcccccagggccccctgggcaagcccggcgcccccggcgagcccggcccccagggccccatcggcgtgcccggcgtgcagggcccccccggcatccccggcatcggcaagcccggccaggacggcatccccggccagcccggcttccccggcggcaagggcgagcagggcctgcccggcctgcccggcccccccggcctgcccggcatcggcaagcccggcttccccggccccaagggcgacagaggcatgggcggcgtgcccggcgccctgggccccagaggcgagaagggccccatcggcgcccccggcatcggcggcccccccggcgagcccggcctgcccggcatccccggccccatgggcccccccggcgccatcggcttccccggccccaagggcgagggcggcatcgtgggcccccagggcccccccggccccaagggcgagcccggcctgcagggcttccccggcaagcccggcttcctgggcgaggtgggcccccccggcatgagaggcctgcccggccccatcggccccaagggcgaggccggccagaagggcgtgcccggcctgcccggcgtgcccggcctgctgggccccaagggcgagcccggcatccccggcgaccagggcctgcagggcccccccggcatccccggcatcggcggccccagcggccccatcggcccccccggcatccccggccccaagggcgagcccggcctgcccggcccccccggcttccccggcatcggcaagcccggcgtggccggcctgcacggcccccccggcaagcccggcgccctgggcccccagggccagcccggcctgcccggcccccccggcccccccggcccccccggcccccccgccgtgatgccccccaccccccccccccagggcgagtacctgcccgacatgggcctgggcatcgacggcgtgaagcccccccacgcctacggcgccaagaagggcaagaacggcggccccgcctacgagatgcccgccttcaccgccgagctgaccgcccccttcccccccgtgggcgcccccgtgaagttcaacaagctgctgtacaacggcagacagaactacaacccccagaccggcatcttcacctgcgaggtgcccggcgtgtactacttcgcctaccacgtgcactgcaagggcggcaacgtgtgggtggccctgttcaagaacaacgagcccgtgatgtacacctacgacgagtacaagaagggcttcctggaccaggccagcggcagcgccgtgctgctgctgagacccggcgacagagtgttcctgcagatgcccagcgagcaggccgccggcctgtacgccggccagtacgtgcacagcagcttcagcggctacctgctgtaccccatgtag

SEQ ID NO: 77285 - DNA, 2235 bp, Artificial Sequence; identical to SEQ ID NO: 77284
  Description of Artificial Sequence: Synthetic coding sequence

SEQ ID NO: 77286 - DNA, 345 bp, Artificial Sequence
  Description of Artificial Sequence: Synthetic coding sequence
atggccgtgctgcccggccccctgcagctgctgggcgtgctgctgaccatcagcctgagcagcatcagactgatccaggccggcgcctactacggcatcaagcccctgcccccccagatccccccccagatgcccccccagatcccccagtaccagcccctgggccagcaggtgccccacatgcccctggccaaggacggcctggccatgggcaaggagatgccccacctgcagtacggcaaggagtacccccacctgccccagtacatgaaggagatccagcccgcccccagaatgggcaaggaggccgtgcccaagaagggcaaggagatccccctggcctag

SEQ ID NO: 77287 - DNA, 2061 bp, Artificial Sequence
  Description of Artificial Sequence: Synthetic coding sequence
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagactgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 77288 - DNA, 1338 bp, Artificial Sequence
  Description of Artificial Sequence: Synthetic coding sequence
atgaccggcagcagcttcagcctggcccacctgctgatcatcagcggcctgctgtgctacagcgccggctgcctggccctgcccagcctggaccagaagaagagaggcggccacaaggcctgctgcctgctgacccccccccccccccccctgttccccccccccttcttcagaggcggcagaagccccctgctgagccccgacatgaagaacctgatgctggagctggagaccagccagagcccctgcatgcagggcagcctgggcagccccggcccccccggcccccagggcccccccggcctgcccggcaagaccggccccaagggcgagaagggcgagctgggcagacccggcagaaagggcagacccggcccccccggcgtgcccggcatgcccggccccatcggctggcccggccccgagggccccagaggcgagaagggcgacctgggcatgatgggcctgcccggcagcagaggccccatgggcagcaagggctaccccggcagcagaggcgagaagggcagcagaggcgagaagggcgacctgggccccaagggcgagaagggcttccccggcttccccggcatgctgggccagaagggcgagatgggccccaagggcgagcccggcatcgccggccacagaggccccaccggcagacccggcaagagaggcaagcagggccagaagggcgacagcggcgtgatgggcccccccggcaagcccggccccagcggccagcccggcagacccggcccccccggccccccccccgccggccagctgatcatgggccccaagggcgagagaggcttccccggcccccccggcagatgcctgtgcggccccaccatgaacgtgaacaaccccagctacggcgagagcgtgtacggccccagcagccccagagtgcccgtgatcttcgtggtgaacaaccaggaggagctggagagactgaacacccagaacgccatcgccttcagaagagaccagagaagcctgtacttcaaggacagcctgggctggctgcccatccagctgacccccttctaccccgtggactacaccgccgaccagcacggcacctgcggcgacggcctgctgcagcccggcgaggagtgcgacgacggcaacagcgacgtgggcgacgactgcatcagatgccacagagcctactgcggcgacggccacagacacgagggcgtggaggactgcgacggcagcgacttcggctacctgacctgcgagacctacctgcccggcagctacggcgacctgcagtgcacccagtactgctacatcgacagcaccccctgcagatacttcacctag

SEQ ID NO: 77289 - DNA, 876 bp, Artificial Sequence
  Description of Artificial Sequence: Synthetic coding sequence
atggtggtgctgaaccccatgaccctgggcatctacctgcagctgttcttcctgagcatcgtgagccagcccaccttcatcaacagcgtgctgcccatcagcgccgccctgcccagcctggaccagaagaagagaggcggccacaaggcctgctgcctgctgacccccccccccccccccctgttccccccccccttcttcagaggcggcagaagccccctgctgagccccgacatgaagaacctgatgctggagctggagaccagccagagcccctgcatgcagggcagcctgggcagccccggcccccccggcccccagggcccccccggcctgcccggcaagaccggccccaagggcgagaagggcgagctgggcagacccggcagaaagggcagacccggcccccccggcgtgcccggcatgcccggccccatcggctggcccggccccgagggccccagaggcgagaagggcgacctgggcatgatgggcctgcccggcagcagaggccccatgggcagcaagggctaccccggcagcagaggcgagaagggcagcagaggcgagaagggcgacctgggccccaagggcgagaagggcttccccggcttccccggcatgctgggccagaagggcgagatgggccccaagggcgagcccggcatcgccggccacagaggccccaccggcagacccggcaagagaggcaagcagagcagcagaaccccctgcaccctgcccagaagaccccccgtgccctgcggccagggcagcagaagccccgtgaccgtggtggccggcaaggagagccaggcctgcctgctgcccagattcgaggaggactacatcagcagcggcaccgagagaggctag

SEQ ID NO: 77290 - DNA, 1266 bp, Artificial Sequence
  Description of Artificial Sequence: Synthetic coding sequence
atggtggtgctgaaccccatgaccctgggcatctacctgcagctgttcttcctgagcatcgtgagccagcccaccttcatcaacagcgtgctgcccatcagcgccgccctgcccagcctggaccagaagaagagaggcggccacaaggcctgctgcctgctgacccccccccccccccccctgttccccccccccttcttcagaggcggcagaagccccggcccccccggcctgcccggcaagaccggccccaagggcgagaagggcgagctgggcagacccggcagaaagggcagacccggcccccccggcgtgcccggcatgcccggccccatcggctggcccggccccgagggccccagaggcgagaagggcgacctgggcatgatgggcctgcccggcagcagaggccccatgggcagcaagggctaccccggcagcagaggcgagaagggcagcagaggcgagaagggcgacctgggccccaagggcgagaagggcttccccggcttccccggcatgctgggccagaagggcgagatgggccccaagggcgagcccggcatcgccggccacagaggccccaccggcagacccggcaagagaggcaagcagggccagaagggcgacagcggcgtgatgggcccccccggcaagcccggccccagcggccagcccggcagacccggcccccccggccccccccccgccggccagctgatcatgggccccaagggcgagagaggcttccccggcccccccggcagatgcctgtgcggccccaccatgaacgtgaacaaccccagctacggcgagagcgtgtacggccccagcagccccagagtgcccgtgatcttcgtggtgaacaaccaggaggagctggagagactgaacacccagaacgccatcgccttcagaagagaccagagaagcctgtacttcaaggacagcctgggctggctgcccatccagctgacccccttctaccccgtggactacaccgccgaccagcacggcacctgcggcgacggcctgctgcagcccggcgaggagtgcgacgacggcaacagcgacgtgggcgacgactgcatcagatgccacagagcctactgcggcgacggccacagacacgagggcgtggaggactgcgacggcagcgacttcggctacctgacctgcgagacctacctgcccggcagctacggcgacctgcagtgcacccagtactgctacatcgacagcaccccctgcagatacttcacctag

SEQ ID NO: 77291 - DNA, 1341 bp, Artificial Sequence
  Description of Artificial Sequence: Synthetic coding sequence
atggtggtgctgaaccccatgaccctgggcatctacctgcagctgttcttcctgagcatcgtgagccagcccaccttcatcaacagcgtgctgcccatcagcgccgccctgcccagcctggaccagaagaagagaggcggccacaaggcctgctgcctgctgacccccccccccccccccctgttccccccccccttcttcagaggcggcagaagccccctgctgagccccgacatgaagaacctgatgctggagctggagaccagccagagcccctgcatgcagggcagcctgggcagccccggcccccccggcccccagggcccccccggcctgcccggcaagaccggccccaagggcgagaagggcagacccggcccccccggcgtgcccggcatgcccggccccatcggctggcccggccccgagggccccagaggcgagaagggcgacctgggcatgatgggcctgcccggcagcagaggccccatgggcagcaagggctaccccggcagcagaggcgagaagggcagcagaggcgagaagggcgacctgggccccaagggcgagaagggcttccccggcttccccggcatgctgggccagaagggcgagatgggccccaagggcgagcccggcatcgccggccacagaggccccaccggcagacccggcaagagaggcaagcagggccagaagggcgacagcggcgtgatgggcccccccggcaagcccggccccagcggccagcccggcagacccggcccccccggccccccccccgccggccagctgatcatgggccccaagggcgagagaggcttccccggcccccccggcagatgcctgtgcggccccaccatgaacgtgaacaaccccagctacggcgagagcgtgtacggccccagcagccccagagtgcccgtgatcttcgtggtgaacaaccaggaggagctggagagactgaacacccagaacgccatcgccttcagaagagaccagagaagcctgtacttcaaggacagcctgggctggctgcccatccagctgacccccttctaccccgtggactacaccgccgaccagcacggcacctgcggcgacggcctgctgcagcccggcgaggagtgcgacgacggcaacagcgacgtgggcgacgactgcatcagatgccacagagcctactgcggcgacggccacagacacgagggcgtggaggactgcgacggcagcgacttcggctacctgacctgcgagacctacctgcccggcagctacggcgacctgcagtgcacccagtactgctacatcgacagcaccccctgcagatacttcacctag

SEQ ID NO: 77292 - DNA, 1368 bp, Artificial Sequence
  Description of Artificial Sequence: Synthetic coding sequence
atggtggtgctgaaccccatgaccctgggcatctacctgcagctgttcttcctgagcatcgtgagccagcccaccttcatcaacagcgtgctgcccatcagcgccgccctgcccagcctggaccagaagaagagaggcggccacaaggcctgctgcctgctgacccccccccccccccccctgttccccccccccttcttcagaggcggcagaagccccctgctgagccccgacatgaagaacctgatgctggagctggagaccagccagagcccctgcatgcagggcagcctgggcagccccggcccccccggcccccagggcccccccggcctgcccggcaagaccggccccaagggcgagaagggcgagctgggcagacccggcagaaagggcagacccggcccccccggcgtgcccggcatgcccggccccatcggctggcccggccccgagggccccagaggcgagaagggcgacctgggcatgatgggcctgcccggcagcagaggccccatgggcagcaagggctaccccggcagcagaggcgagaagggcagcagaggcgagaagggcgacctgggccccaagggcgagaagggcttccccggcttccccggcatgctgggccagaagggcgagatgggccccaagggcgagcccggcatcgccggccacagaggccccaccggcagacccggcaagagaggcaagcagggccagaagggcgacagcggcgtgatgggcccccccggcaagcccggccccagcggccagcccggcagacccggcccccccggccccccccccgccggccagctgatcatgggccccaagggcgagagaggcttccccggcccccccggcagatgcctgtgcggccccaccatgaacgtgaacaaccccagctacggcgagagcgtgtacggccccagcagccccagagtgcccgtgatcttcgtggtgaacaaccaggaggagctggagagactgaacacccagaacgccatcgccttcagaagagaccagagaagcctgtacttcaaggacagcctgggctggctgcccatccagctgacccccttctaccccgtggactacaccgccgaccagcacggcacctgcggcgacggcctgctgcagcccggcgaggagtgcgacgacggcaacagcgacgtgggcgacgactgcatcagatgccacagagcctactgcggcgacggccacagacacgagggcgtggaggactgcgacggcagcgacttcggctacctgacctgcgagacctacctgcccggcagctacggcgacctgcagtgcacccagtactgctacatcgacagcaccccctgcagatacttcacctag

SEQ ID NO: 77293 - DNA, 1338 bp, Artificial Sequence; identical to SEQ ID NO: 77288
  Description of Artificial Sequence: Synthetic coding sequence

SEQ ID NO: 77294 - DNA, 585 bp, Artificial Sequence
  Description of Artificial Sequence: Synthetic coding sequence
atcagcggcctgctgtgctacagcgccggctgcctggccctgcccagcctggaccagaagaagagaggcggccacaaggcctgctgcctgctgacccccccccccccccccctgttccccccccccttcttcagaggcggcagaagccccggcccccccggcctgcccggcaagaccggccccaagggcgagaagggcgagctgggcagacccggcagaaagggcagacccggcccccccggcgtgcccggcatgcccggccccatcggctggcccggccccgagggccccagaggcgagaagggcgacctgggcatgatgggcctgcccggcagcagaggccccatgggcagcaagggctaccccggcagcagaggcgagaagggcagcagaggcgagaagggcgacctgggccccaagggcgagaagggcttccccggcttccccggcatgctgggccagaagggcgagatgggccccaagggcgagcccggcatcgccggccacagaggccccaccggcagacccggcaagagaggcaagcagggccagaagggcgacagcggcgtgatgggccccccctag

SEQ ID NO: 77295 - DNA, 1338 bp, Artificial Sequence
  Description of Artificial Sequence: Synthetic coding sequence
atgaccggcagcagcttcagcctggcccacctgctgatcatcagcggcctgctgtgctacagcgccggctgcctggccctgcccagcctggaccagaagaagagaggcggccacaaggcctgctgcctgctgacccccccccccccccccctgttccccccccccttcttcagaggcggcagaagccccctgctgagccccgacatgaagaacctgatgctggagctggagaccagccagagcccctgcatgcagggcagcctgggcagccccggcccccccggcccccagggcccccccggcctgcccggcaagaccggccccaagggcgagaagggcgagctgggcagacccggcagaaagggcagacccggcccccccggcgtgcccggcatgcccggccccatcggctggcccggccccgagggccccagaggcgagaagggcgacctgggcatgatgggcctgcccggcagcagaggccccatgggcagcaagggctaccccggcagcagaggcgagaagggcagcagaggcgagaagggcgacctgggccccaagggcgagaagtgcaaccccctgctgctgctgttccccagcttccagggcgagatgggccccaagggcgagcccggcatcgccggccacagaggccccaccggcagacccggcaagagaggcaagcagggccagaagggcgacagcggcgtgatgggcccccccggcaagcccggccccagcggccagcccggcagacccggcccccccggccccccccccgccggccagctgatcatgggccccaagggcgagagaggcttccccggcccccccggcagatgcctgtgcggccccaccatgaacgtgaacaaccccagctacggcgagagcgtgtacggccccagcagccccagagtgcccgtgatcttcgtggtgaacaaccaggaggagctggagagactgaacacccagaacgccatcgccttcagaagagaccagagaagcctgtacttcaaggacagcctgggctggctgcccatccagctgacccccttctaccccgtggactacaccgccgaccagcacggcacctgcggcgacggcctgctgcagcccggcgaggagtgcgacgacggcaacagcgacgtgggcgacgactgcatcagatgccacagagcctactgcggcgacggccacagacacgagggcgtggaggactgcgacggcagcgacttcggctacctgacctgcgagacctacctgcccggcagctacggcgacctgcagtgcacccagtactgctacatcgacagcaccccctgcagatacttcacctag

SEQ ID NO: 77296 - DNA, 2061 bp, Artificial Sequence
  Description of Artificial Sequence: Synthetic coding sequence
atggccgacagaagaagagcctggaacaccgaggacgacctgcccgtgtacctggccagacccggcagcgccgcccagacccccagacagaagtacggcggcatgttcgccgccgtggagggcgcctacgagaacaagaccatcgacttcgacgcctacagcgtgggcagaagaggcagcgccagaacccccagaagcgccggcagacccgacgccgtgggcctgcccggccccggcggcagcgaggacaccgccagcgacgtgagcgagcccagcggcagcgccgtgagcagccccggcgagagagacgagagaccccccaccctgagaatcagaagacccgcccccagagacctgcccctgggcagagacaacggccagagcgacagactgctgatcaagggcggcagaatcatcaacgacgaccagagcctgtacgccgacgtgtacctggaggacggcctgatcaagcagatcggcgagaacctgatcgtgcccggcggcgtgaagaccatcgaggccaacggcagaatggtgatccccggcggcatcgacgtgaacacctacctgcagaagcccagccagggcatgaccgccgccgacgacttcttccagggcaccagagccgccctggtgggcggcaccaccatgatcatcgaccacgtggtgcccgagcccggcagcagcctgctgaccagcttcgagaagtggcacgaggccgccgacaccaagagctgctgcgactacagcctgcacgtggacatcaccagctggtacgacggcgtgagagaggagctggaggtgctggtgcaggacaagggcgtgaacagcttccaggtgtacatggcctacaaggacgtgtaccagatgagcgacagccagctgtacgaggccttcaccttcctgaagggcctgggcgccgtgatcctggtgcacgccgagaacggcgacctgatcgcccaggagcagaagagaatcctggagatgggcatcaccggccccgagggccacgccctgagcagacccgaggagctggaggccgaggccgtgttcagagccatcaccatcgccggcagaatcaactgccccgtgtacatcaccaaggtgatgagcaagagcgccgccgacatcatcgccctggccagaaagaagggccccctggtgttcggcgagcccatcgccgccagcctgggcaccgacggcacccactactggagcaagaactgggccaaggccgccgccttcgtgaccagcccccccctgagccccgaccccaccacccccgactacctgaccagcctgctggcctgcggcgacctgcaggtgaccggcagcggccactgcccctacagcaccgcccagaaggccgtgggcaaggacaacttcaccctgatccccgagggcgtgaacggcatcgaggagagaatgaccgtggtgtgggacaaggccgtggccaccggcaagatggacgagaaccagttcgtggccgtgaccagcaccaacgccgccaagatcttcaacctgtaccccagaaagggcagaatcgccgtgggcagcgacgccgacgtggtgatctgggaccccgacaagctgaagaccatcaccgccaagagccacaagagcgccgtggagtacaacatcttcgagggcatggagtgccacggcagccccctggtggtgatcagccagggcaagatcgtgttcgaggacggcaacatcaacgtgaacaagggcatgggcagattcatccccagaaaggccttccccgagcacctgtaccagagagtgaagatcagaaacaaggtgttcggcctgcagggcgtgagcagaggcatgtacgacggccccgtgtacgaggtgcccgccacccccaagtacgccacccccgcccccagcgccaagagcagccccagcaagcaccagcccccccccatcagaaacctgcaccagagcaacttcagcctgagcggcgcccagatcgacgacaacaaccccagaagaaccggccacagaatcgtggccccccccggcggcagaagcaacatcaccagcctgggctag

SEQ ID NO: 77297 - DNA, 1719 bp, Artificial Sequence
  Description of Artificial Sequence: Synthetic coding sequence
atgagctaccagggcaagaagagcatcccccacatcaccagcgacagactgctgatcaagggcggcagaatcatcaacgacgaccagagcctgtacgccgacgtgtacctggaggacggcctgatcaagcagatcggcgagaacctgatcgtgcccggcggcgtgaagaccatcgaggccaacggcagaatggtgatccccggcggcatcgacgtgaacacctacctgcagaagcccagccagggcatgaccgccgccgacgacttcttccagggcaccagagccgccctggtgggcggcaccaccatgatcatcgaccacgtggtgcccgagcccggcagcagcctgctgaccagcttcgagaagtggcacgaggccgccgacaccaagagctgctgcgactacagcctgcacgtggacatcaccagctggtacgacggcgtgagagaggagctggaggtgctggtgcaggacaagggcgtgaacagcttccaggtgtacatggcctacaaggacgtgtaccagatgagcgacagccagctgtacgaggccttcaccttcctgaagggcctgggcgccgtgatcctggtgcacgccgagaacggcgacctgatcgcccaggagcagaagagaatcctggagatgggcatcaccggccccgagggccacgccctgagcagacccgaggagctggaggccgaggccgtgttcagagccatcaccatcgccggcagaatcaactgccccgtgtacatcaccaaggtgatgagcaagagcgccgccgacatcatcgccctggccagaaagaagggccccctggtgttcggcgagcccatcgccgccagcctgggcaccgacggcacccactactggagcaagaactgggccaaggccgccgccttcgtgaccagcccccccctgagccccgaccccaccacccccgactacctgaccagcctgctggcctgcggcgacctgcaggtgaccggcagcggccactgcccctacagcaccgcccagaaggccgtgggcaaggacaacttcaccctgatccccgagggcgtgaacggcatcgaggagagaatgaccgtggtgtgggacaaggccgtggccaccggcaagatggacgagaaccagttcgtggccgtgaccagcaccaacgccgccaagatcttcaacctgtaccccagaaagggcagaatcgccgtgggcagcgacgccgacgtggtgatctgggaccccgacaagctgaagaccatcaccgccaagagccacaagagcgccgtggagtacaacatcttcgagggcatggagtgccacggcagccccctggtggtgatcagccagggcaagatcgtgttcgaggacggcaacatcaacgtgaacaagggcatgggcagattcatccccagaaaggccttccccgagcacctgtaccagagagtgaagatcagaaacaaggtgttcggcctgcagggcgtgagcagaggcatgtacgacggccccgtgtacgaggtgcccgccacccccaagtacgccacccccgcccccagcgccaagagcagccccagcaagcaccagcccccccccatcagaaacctgcaccagagcaacttcagcctgagcggcgcccagatcgacgacaacaaccccagaagaaccggccacagaatcgtggccccccccggcggcagaagcaacatcaccagcctgggctag

SEQ ID NO: 77298 - DNA, 1713 bp, Artificial Sequence
  Description of Artificial Sequence: Synthetic coding sequence
atgcagaagatgaacaacgaggtggtggacaagagcgacagactgctgatcaagggcggcagaatcatcaacgacgaccagagcctgtacgccgacgtgtacctggaggacggcctgatcaagcagatcggcgagaacctgatcgtgcccggcggcgtgaagaccatcgaggccaacggcagaatggtgatccccggcggcatcgacgtgaacacctacctgcagaagcccagccagggcatgaccgccgccgacgacttcttccagggcaccagagccgccctggtgggcggcaccaccatgatcatcgaccacgtggtgcccgagcccggcagcagcctgctgaccagcttcgagaagtggcacgaggccgccgacaccaagagctgctgcgactacagcctgcacgtggacatcaccagctggtacgacggcgtgagagaggagctggaggtgctggtgcaggacaagggcgtgaacagcttccaggtgtacatggcctacaaggacgtgtaccagatgagcgacagccagctgtacgaggccttcaccttcctgaagggcctgggcgccgtgatcctggtgcacgccgagaacggcgacctgatcgcccaggagcagaagagaatcctggagatgggcatcaccggccccgagggccacgccctgagcagacccgaggagctggaggccgaggccgtgttcagagccatcaccatcgccggcagaatcaactgccccgtgtacatcaccaaggtgatgagcaagagcgccgccgacatcatcgccctggccagaaagaagggccccctggtgttcggcgagcccatcgccgccagcctgggcaccgacggcacccactactggagcaagaactgggccaaggccgccgccttcgtgaccagcccccccctgagccccgaccccaccacccccgactacctgaccagcctgctggcctgcggcgacctgcaggtgaccggcagcggccactgcccctacagcaccgcccagaaggccgtgggcaaggacaacttcaccctgatccccgagggcgtgaacggcatcgaggagagaatgaccgtggtgtgggacaaggccgtggccaccggcaagatggacgagaaccagttcgtggccgtgaccagcaccaacgccgccaagatcttcaacctgtaccccagaaagggcagaatcgccgtgggcagcgacgccgacgtggtgatctgggaccccgacaagctgaagaccatcaccgccaagagccacaagagcgccgtggagtacaacatcttcgagggcatggagtgccacggcagccccctggtggtgatcagccagggcaagatcgtgttcgaggacggcaacatcaacgtgaacaagggcatgggcagattcatccccagaaaggccttccccgagcacctgtaccagagagtgaagatcagaaacaaggtgttcggcctgcagggcgtgagcagaggcatgtacgacggccccgtgtacgaggtgcccgccacccccaagtacgccacccccgcccccagcgccaagagcagccccagcaagcaccagcccccccccatcagaaacctgcaccagagcaacttcagcctgagcggcgcccagatcgacgacaacaaccccagaagaaccggccacagaatcgtggccccccccggcggcagaagcaacatcaccagcctgggctag

SEQ ID NO: 77299 - DNA, 1719 bp, Artificial Sequence; identical to SEQ ID NO: 77297
  Description of Artificial Sequence: Synthetic coding sequence

SEQ ID NO: 77300 - DNA, 834 bp, Artificial Sequence
  Description of Artificial Sequence: Synthetic coding sequence
atgaacggcttcgccagcctgctgagaagaaaccagttcatcctgctggtgctgttcctgctgcagatccagagcctgggcctggacatcgacagcagacccaccgccgaggtgtgcgccacccacaccatcagccccggccccaagggcgacgacggcgagaagggcgaccccggcgaggagggcaagcacggcaaggtgggcagaatgggccccaagggcatcaagggcgagctgggcgacatgggcgaccagggcaacatcggcaagaccggccccatcggcaagaagggcgacaagggcgagaagggcctgctgggcatccccggcgagaagggcaaggccggcaccgtgtgcgactgcggcagatacagaaagttcgtgggccagctggacatcagcatcgccagactgaagaccagcatgaagttcgtgaagaacgtgatcgccggcatcagagagaccgaggagaagttctactacatcgtgcaggaggagaagaactacagagagagcctgacccactgcagaatcagaggcggcatgctggccatgcccaaggacgaggccgccaacaccctgatcgccgactacgtggccaagagcggcttcttcagagtgttcatcggcgtgaacgacctggagagagagggccagtacatgttcaccgacaacacccccctgcagaactacagcaactggaacgagggcgagcccagcgacccctacggccacgaggactgcgtggagatgctgagcagcggcagatggaacgacaccgagtgccacctgaccatgtacttcgtgtgcgagttcatcaagaagaagaagtag

SEQ ID NO: 77301 - DNA, 807 bp, Artificial Sequence
  Description of Artificial Sequence: Synthetic coding sequence
atgacccccgccctgtgcagaagcagcagcctggccagcaagggcatgagagagagaagagagaccaaggccccccccgacggcctggaggagagcgcccccagagagaagaagcagagccagcccgtggtgaccgccagcgacatcagcaagagaaagtgcaccagcagcttcgtggagatgggcagccagggcgacatgggcgacaagggccagaagggcagcgtgggcagacacggcaagatcggccccatcggcagcaagggcgagaagggcgacagcggcgacatcggcccccccggccccaacggcgagcccggcctgccctgcgagtgcagccagctgagaaaggccatcggcgagatggacaaccaggtgagccagctgaccagcgagctgaagttcatcaagaacgccgtggccggcgtgagagagaccgagagcaagatctacctgctggtgaaggaggagaagagatacgccgacgcccagctgagctgccagggcagaggcggcaccctgagcatgcccaaggacgaggccgccaacggcctgatggccgcctacctggcccaggccggcctggccagagtgttcatcggcatcaacgacctggagaaggagggcgccttcgtgtacagcgaccacagccccatgagaaccttcaacaagtggagaagcggcgagcccaacaacgcctacgacgaggaggactgcgtggagatggtggccagcggcggctggaacgacgtggcctgccacaccaccatgtacttcatgtgcgagttcgacaaggagaacatgtag

SEQ ID NO: 77302 - DNA, 816 bp, Artificial Sequence
  Description of Artificial Sequence: Synthetic coding sequence
atgagaggcaacctggccctggtgggcgtgctgatcagcctggccttcctgagcctgctgcccagcggccacccccagcccgccggcgacgacgcctgcagcgtgcagatcctggtgcccggcctgaagggcgacgccggcgagaagggcgacaagggcgcccccggcagacccggcagagtgggccccaccggcgagaagggcgacatgggcgacaagggccagaagggcagcgtgggcagacacggcaagatcggccccatcggcagcaagggcgagaagggcgacagcggcgacatcggcccccccggccccaacggcgagcccggcctgccctgcgagtgcagccagctgagaaaggccatcggcgagatggacaaccaggtgagccagctgaccagcgagctgaagttcatcaagaacgccgtggccggcgtgagagagaccgagagcaagatctacctgctggtgaaggaggagaagagatacgccgacgcccagctgagctgccagggcagaggcggcaccctgagcatgcccaaggacgaggccgccaacggcctgatggccgcctacctggcccaggccggcctggccagagtgttcatcggcatcaacgacctggagaaggagggcgccttcgtgtacagcgaccacagccccatgagaaccttcaacaagtggagaagcggcgagcccaacaacgcctacgacgaggaggactgcgtggagatggtggccagcggcggctggaacgacgtggcctgccacaccaccatgtacttcatgtgcgagttcgacaaggagaacatgtag

SEQ ID NO: 77303 - DNA, 744 bp, Artificial Sequence
  Description of Artificial Sequence: Synthetic coding sequence
atgagaggcaacctggccctggtgggcgtgctgatcagcctggccttcctgagcctgctgcccagcggccacccccagcccgccggcgacgacgcctgcagcgtgcagatcctggtgcccggcctgaagggcgacgccggcgagaagggcgacaagggcgcccccggcagacccggcagagtgggccccaccggcgagaagggcgagaagggcgacagcggcgacatcggcccccccggccccaacggcgagcccggcctgccctgcgagtgcagccagctgagaaaggccatcggcgagatggacaaccaggtgagccagctgaccagcgagctgaagttcatcaagaacgccgtggccggcgtgagagagaccgagagcaagatctacctgctggtgaaggaggagaagagatacgccgacgcccagctgagctgccagggcagaggcggcaccctgagcatgcccaaggacgaggccgccaacggcctgatggccgcctacctggcccaggccggcctggccagagtgttcatcggcatcaacgacctggagaaggagggcgccttcgtgtacagcgaccacagccccatgagaaccttcaacaagtggagaagcggcgagcccaacaacgcctacgacgaggaggactgcgtggagatggtggccagcggcggctggaacgacgtggcctgccacaccaccatgtacttcatgtgcgagttcgacaaggagaacatgtag

SEQ ID NO: 77304 - DNA, 858 bp, Artificial Sequence
  Description of Artificial Sequence: Synthetic coding sequence
atgaagaagcagagaggcgtgggcgtgctgcccgccctgagaatgagaggcaacctggccctggtgggcgtgctgatcagcctggccttcctgagcctgctgcccagcggccacccccagcccgccggcgacgacgcctgcagcgtgcagatcctggtgcccggcctgaagggcgacgccggcgagaagggcgacaagggcgcccccggcagacccggcagagtgggccccaccggcgagaagggcgacatgggcgacaagggccagaagggcagcgtgggcagacacggcaagatcggccccatcggcagcaagggcgagaagggcgacagcggcgacatcggcccccccggccccaacggcgagcccggcctgccctgcgagtgcagccagctgagaaaggccatcggcgagatggacaaccaggtgagccagctgaccagcgagctgaagttcatcaagaacgccgtggccggcgtgagagagaccgagagcaagatctacctgctggtgaaggaggagaagagatacgccgacgcccagctgagctgccagggcagaggcggcaccctgagcatgcccaaggacgaggccgccaacggcctgatggccgcctacctggcccaggccggcctggccagagtgttcatcggcatcaacgacctggagaaggagggcgccttcgtgtacagcgaccacagccccatgagaaccttcaacaagtggagaagcggcgagcccaacaacgcctacgacgaggaggactgcgtggagatggtggccagcggcggctggaacgacgtggcctgccacaccaccatgtacttcatgtgcgagttcgacaaggagaacatgtag

SEQ ID NO: 77305 - DNA, 666 bp, Artificial Sequence
  Description of Artificial Sequence: Synthetic coding sequence
atgtggtgggtgccccccagcccctacggctgcctgccctgcgccctgcccggcgacatgggcgacaagggccagaagggcagcgtgggcagacacggcaagatcggccccatcggcagcaagggcgagaagggcgacagcggcgacatcggcccccccggccccaacggcgagcccggcctgccctgcgagtgcagccagctgagaaaggccatcggcgagatggacaaccaggtgagccagctgaccagcgagctgaagttcatcaagaacgccgtggccggcgtgagagagaccgagagcaagatctacctgctggtgaaggaggagaagagatacgccgacgcccagctgagctgccagggcagaggcggcaccctgagcatgcccaaggacgaggccgccaacggcctgatggccgcctacctggcccaggccggcctggccagagtgttcatcggcatcaacgacctggagaaggagggcgccttcgtgtacagcgaccacagccccatgagaaccttcaacaagtggagaagcggcgagcccaacaacgcctacgacgaggaggactgcgtggagatggtggccagcggcggctggaacgacgtggcctgccacaccaccatgtacttcatgtgcgagttcgacaaggagaacatgtag

SEQ ID NO: 77306 - DNA, 666 bp, Artificial Sequence
  Description of Artificial Sequence: Synthetic coding sequence
atgtggtgggtgccccccagcccctacggctgcctgccctgcgccctgcccggcgacgccggcgagaagggcgacaagggcgcccccggcagacccggcagagtgggccccaccggcgagaagggcgagaagggcgacagcggcgacatcggcccccccggccccaacggcgagcccggcctgccctgcgagtgcagccagctgagaaaggccatcggcgagatggacaaccaggtgagccagctgaccagcgagctgaagttcatcaagaacgccgtggccggcgtgagagagaccgagagcaagatctacctgctggtgaaggaggagaagagatacgccgacgcccagctgagctgccagggcagaggcggcaccctgagcatgcccaaggacgaggccgccaacggcctgatggccgcctacctggcccaggccggcctggccagagtgttcatcggcatcaacgacctggagaaggagggcgccttcgtgtacagcgaccacagccccatgagaaccttcaacaagtggagaagcggcgagcccaacaacgcctacgacgaggaggactgcgtggagatggtggccagcggcggctggaacgacgtggcctgccacaccaccatgtacttcatgtgcgagttcgacaaggagaacatgtag

SEQ ID NO: 77307 - DNA, 594 bp, Artificial Sequence
  Description of Artificial Sequence: Synthetic coding sequence
atgtggtgggtgccccccagcccctacggctgcctgccctgcgccctgcccggcgagaagggcgacagcggcgacatcggcccccccggccccaacggcgagcccggcctgccctgcgagtgcagccagctgagaaaggccatcggcgagatggacaaccaggtgagccagctgaccagcgagctgaagttcatcaagaacgccgtggccggcgtgagagagaccgagagcaagatctacctgctggtgaaggaggagaagagatacgccgacgcccagctgagctgccagggcagaggcggcaccctgagcatgcccaaggacgaggccgccaacggcctgatggccgcctacctggcccaggccggcctggccagagtgttcatcggcatcaacgacctggagaaggagggcgccttcgtgtacagcgaccacagccccatgagaaccttcaacaagtggagaagcggcgagcccaacaacgcctacgacgaggaggactgcgtggagatggtggccagcggcggctggaacgacgtggcctgccacaccaccatgtacttcatgtgcgagttcgacaaggagaacatgtag

SEQ ID NO: 77308 - DNA, 2229 bp, Artificial Sequence
  Description of Artificial Sequence: Synthetic coding sequence
atgaaggacgacttcgccgaggaggaggaggtgcagagcttcggctacaagagattcggcatccaggagggcacccagtgcaccaagtgcaagaacaactgggccctgaagttcagcatcatcctgctgtacatcctgtgcgccctgctgaccatcaccgtggccatcctgggctacaaggtggtggagaagatggacaacgtgaccggcggcatggagaccagcagacagacctacgacgacaagctgaccgccgtggagagcgacctgaagaagctgggcgaccagaccggcaagaaggccatcagcaccaacagcgagctgagcaccttcagaagcgacatcctggacctgagacagcagctgagagagatcaccgagaagaccagcaagaacaaggacaccctggagaagctgcaggccagcggcgacgccctggtggacagacagagccagctgaaggagaccctggagaacaacagcttcctgatcaccaccgtgaacaagaccctgcaggcctacaacggctacgtgaccaacctgcagcaggacaccagcgtgctgcagggcaacctgcagaaccagatgtacagccacaacgtggtgatcatgaacctgaacaacctgaacctgacccaggtgcagcagagaaacctgatcaccaacctgcagagaagcgtggacgacaccagccaggccatccagagaatcaagaacgacttccagaacctgcagcaggtgttcctgcaggccaagaaggacaccgactggctgaaggagaaggtgcagagcctgcagaccctggccgccaacaacagcgccctggccaaggccaacaacgacaccctggaggacatgaacagccagctgaacagcttcaccggccagatggagaacatcaccaccatcagccaggccaacgagcagaacctgaaggacctgcaggacctgcacaaggacgccgagaacagaaccgccatcaagttcaaccagctggaggagagattccagctgttcgagaccgacatcgtgaacatcatcagcaacatcagctacaccgcccaccacctgagaaccctgaccagcaacctgaacgaggtgagaaccacctgcaccgacaccctgaccaagcacaccgacgacctgaccagcctgaacaacaccctggccaacatcagactggacagcgtgagcctgagaatgcagcaggacctgatgagaagcagactggacaccgaggtggccaacctgagcgtgatcatggaggagatgaagctggtggacagcaagcacggccagctgatcaagaacttcaccatcctgcagggcccccccggccccagaggccccagaggcgacagaggcagccagggcccccccggccccaccggcaacaagggccagaagggcgagaagggcgagcccggcccccccggccccgccggcgagagaggccccatcggccccgccggcccccccggcgagagaggcggcaagggcagcaagggcagccagggccccaagggcagcagaggcagccccggcaagcccggcccccagggcagcagcggcgaccccggcccccccggcccccccggcaaggagggcctgcccggcccccagggcccccccggcttccagggcctgcagggcaccgtgggcgagcccggcgtgcccggccccagaggcctgcccggcctgcccggcgtgcccggcatgcccggccccaagggcccccccggcccccccggccccagcggcgccgtggtgcccctggccctgcagaacgagcccacccccgcccccgaggacaacggctgccccccccactggaagaacttcaccgacaagtgctactacttcagcgtggagaaggagatcttcgaggacgccaagctgttctgcgaggacaagagcagccacctggtgttcatcaacaccagagaggagcagcagtggatcaagaagcagatggtgggcagagagagccactggatcggcctgaccgacagcgagagagagaacgagtggaagtggctggacggcaccagccccgactacaagaactggaaggccggccagcccgacaactggggccacggccacggccccggcgaggactgcgccggcctgatctacgccggccagtggaacgacttccagtgcgaggacgtgaacaacttcatctgcgagaaggacagagagaccgtgctgagcagcgccctgtag

SEQ ID NO: 77309 - DNA, 2919 bp, Artificial Sequence
  Description of Artificial Sequence: Synthetic coding sequence
atgggccccggcgtgctgctgctgctgctggtggccaccgcctggcacggccagggcatccccgtgatcgagcccagcgtgcccgagctggtggtgaagcccggcgccaccgtgaccctgagatgcgtgggcaacggcagcgtggagtgggacggcccccccagcccccactggaccctgtacagcgacggcagcagcagcatcctgagcaccaacaacgccaccttccagaacaccggcacctacagatgcaccgagcccggcgaccccctgggcggcagcgccgccatccacctgtacgtgaaggaccccgccagaccctggaacgtgctggcccaggaggtggtggtgttcgaggaccaggacgccctgctgccctgcctgctgaccgaccccgtgctggaggccggcgtgagcctggtgagagtgagaggcagacccctgatgagacacaccaactacagcttcagcccctggcacggcttcaccatccacagagccaagttcatccagagccaggactaccagtgcagcgccctgatgggcggcagaaaggtgatgagcatcagcatcagactgaaggtgcagaaggtgatccccggcccccccgccctgaccctggtgcccgccgagctggtgagaatcagaggcgaggccgcccagatcgtgtgcagcgccagcagcgtggacgtgaacttcgacgtgttcctgcagcacaacaacaccaagctggccatcccccagcagagcgacttccacaacaacagataccagaaggtgctgaccctgaacctggaccaggtggacttccagcacgccggcaactacagctgcgtggccagcaacgtgcagggcaagcacagcaccagcatgttcttcagagtggtggagagcgcctacctgaacctgagcagcgagcagaacctgatccaggaggtgaccgtgggcgagggcctgaacctgaaggtgatggtggaggcctaccccggcctgcagggcttcaactggacctacctgggccccttcagcgaccaccagcccgagcccaagctggccaacgccaccaccaaggacacctacagacacaccttcaccctgagcctgcccagactgaagcccagcgaggccggcagatacagcttcctggccagaaaccccggcggctggagagccctgaccttcgagctgaccctgagatacccccccgaggtgagcgtgatctggaccttcatcaacggcagcggcaccctgctgtgcgccgccagcggctacccccagcccaacgtgacctggctgcagtgcagcggccacaccgacagatgcgacgaggcccaggtgctgcaggtgtgggacgacccctaccccgaggtgctgagccaggagcccttccacaaggtgaccgtgcagagcctgctgaccgtggagaccctggagcacaaccagacctacgagtgcagagcccacaacagcgtgggcagcggcagctgggccttcatccccatcagcgccggcgcccacacccacccccccgacgagttcctgttcacccccgtggtggtggcctgcatgagcatcatggccctgctgctgctgctgctgctgctgctgctgtacaagtacaagcagaagcccaagtaccaggtgagatggaagatcatcgagagctacgagggcaacagctacaccttcatcgaccccacccagctgccctacaacgagaagtgggagttccccagaaacaacctgcagttcggcaagaccctgggcgccggcgccttcggcaaggtggtggaggccaccgccttcggcctgggcaaggaggacgccgtgctgaaggtggccgtgaagatgctgaagagcaccgcccacgccgacgagaaggaggccctgatgagcgagctgaagatcatgagccacctgggccagcacgagaacatcgtgaacctgctgggcgcctgcacccacggcggccccgtgctggtgatcaccgagtactgctgctacggcgacctgctgaacttcctgagaagaaaggccgaggccatgctgggccccagcctgagccccggccaggaccccgagggcggcgtggactacaagaacatccacctggagaagaagtacgtgagaagagacagcggcttcagcagccagggcgtggacacctacgtggagatgagacccgtgagcaccagcagcaacgacagcttcagcgagcaggacctggacaaggaggacggcagacccctggagctgagagacctgctgcacttcagcagccaggtggcccagggcatggccttcctggccagcaagaactgcatccacagagacgtggccgccagaaacgtgctgctgaccaacggccacgtggccaagatcggcgacttcggcctggccagagacatcatgaacgacagcaactacatcgtgaagggcaacgccagactgcccgtgaagtggatggcccccgagagcatcttcgactgcgtgtacaccgtgcagagcgacgtgtggagctacggcatcctgctgtgggagatcttcagcctgggcctgaacccctaccccggcatcctggtgaacagcaagttctacaagctggtgaaggacggctaccagatggcccagcccgccttcgcccccaagaacatctacagcatcatgcaggcctgctgggccctggagcccacccacagacccaccttccagcagatctgcagcttcctgcaggagcaggcccaggaggacagaagagagagagactacaccaacctgcccagcagcagcagaagcggcggcagcggcagcagcagcagcgagctggaggaggagagcagcagcgagcacctgacctgctgcgagcagggcgacatcgcccagcccctgctgcagcccaacaactaccagttctgctag

SEQ ID NO: 77310 - DNA, 1506 bp, Artificial Sequence
  Description of Artificial Sequence: Synthetic coding sequence
atgagacacaccaactacagcttcagcccctggcacggcttcaccatccacagagccaagttcatccagagccaggactaccagtgcagcgccctgatgggcggcagaaaggtgatgagcatcagcatcagactgaaggtgcagaaggtgatccccggcccccccgccctgaccctggtgcccgccgagctggtgagaatcagaggcgaggccgcccagatcgtgtgcagcgccagcagcgtggacgtgaacttcgacgtgttcctgcagcacaacaacaccaagctggccatcccccagcagagcgacttccacaacaacagataccagaaggtgctgaccctgaacctggaccaggtggacttccagcacgccggcaactacagctgcgtggccagcaacgtgcagggcaagcacagcaccagcatgttcttcagagtggtggagagcgcctacctgaacctgagcagcgagcagaacctgatccaggaggtgaccgtgggcgagggcctgaacctgaaggtgatggtggaggcctaccccggcctgcagggcttcaactggacctacctgggccccttcagcgaccaccagcccgagcccaagctggccaacgccaccaccaaggacacctacagacacaccttcaccctgagcctgcccagactgaagcccagcgaggccggcagatacagcttcctggccagaaaccccggcggctggagagccctgaccttcgagctgaccctgagatacccccccgaggtgagcgtgatctggaccttcatcaacggcagcggcaccctgctgtgcgccgccagcggctacccccagcccaacgtgacctggctgcagtgcagcggccacaccgacagatgcgacgaggcccaggtgctgcaggtgtgggacgacccctaccccgaggtgctgagccaggagcccttccacaaggtgaccgtgcagagcctgctgaccgtggagaccctggagcacaaccagacctacgagtgcagagcccacaacagcgtgggcagcggcagctgggccttcatccccatcagcgccggcgcccacacccacccccccgacgagttcctgttcacccccgtggtggtggcctgcatgagcatcatggccctgctgctgctgctgctgctgctgctgctgtacaagtacaagcagaagcccaagtaccaggtgagatggaagatcatcgagagctacgagggcaacagctacaccttcatcgaccccacccagctgccctacaacgagaagtgggagttccccagaaacaacctgcagttcggcaagaccctgggcgccggcgccttcggcaaggtggtggaggccaccgccttcggcctgggcaaggaggacgccgtgctgaaggtggccgtgaagatgctgaagagcaccgcccacgccgacgagaaggaggccagcggcctgtaccagagcgccgagcagcagcagaagagatggcagagacagcagcagcagtag

SEQ ID NO: 77311 - DNA, 2016 bp, Artificial Sequence
  Description of Artificial Sequence: Synthetic coding sequence
atgggccccggcgtgctgctgctgctgctggtggccaccgcctggcacggccagggcatccccgtgatcgagcccagcgtgcccgagctggtggtgaagcccggcgccaccgtgaccctgagatgcgtgggcaacggcagcgtggagtgggacggcccccccagcccccactggaccctgtacagcgacggcagcagcagcatcctgagcaccaacaacgccaccttccagaacaccggcacctacagatgcaccgagcccggcgaccccctgggcggcagcgccgccatccacctgtacgtgaaggaccccgccagaccctggaacgtgctggcccaggaggtggtggtgttcgaggaccaggacgccctgctgccctgcctgctgaccgaccccgtgctggaggccggcgtgagcctggtgagagtgagaggcagacccctgatgagacacaccaactacagcttcagcccctggcacggcttcaccatccacagagccaagttcatccagagccaggactaccagtgcagcgccctgatgggcggcagaaaggtgatgagcatcagcatcagactgaaggtgcagaaggtgatccccggcccccccgccctgaccctggtgcccgccgagctggtgagaatcagaggcgaggccgcccagatcgtgtgcagcgccagcagcgtggacgtgaacttcgacgtgttcctgcagcacaacaacaccaagctggccatcccccagcagagcgacttccacaacaacagataccagaaggtgctgaccctgaacctggaccaggtggacttccagcacgccggcaactacagctgcgtggccagcaacgtgcagggcaagcacagcaccagcatgttcttcagagtggtggagagcgcctacctgaacctgagcagcgagcagaacctgatccaggaggtgaccgtgggcgagggcctgaacctgaaggtgatggtggaggcctaccccggcctgcagggcttcaactggacctacctgggccccttcagcgaccaccagcccgagcccaagctggccaacgccaccaccaaggacacctacagacacaccttcaccctgagcctgcccagactgaagcccagcgaggccggcagatacagcttcctggccagaaaccccggcggctggagagccctgaccttcgagctgaccctgagatacccccccgaggtgagcgtgatctggaccttcatcaacggcagcggcaccctgctgtgcgccgccagcggctacccccagcccaacgtgacctggctgcagtgcagcggccacaccgacagatgcgacgaggcccaggtgctgcaggtgtgggacgacccctaccccgaggtgctgagccaggagcccttccacaaggtgaccgtgcagagcctgctgaccgtggagaccctggagcacaaccagacctacgagtgcagagcccacaacagcgtgggcagcggcagctgggccttcatccccatcagcgccggcgcccacacccacccccccgacgagttcctgttcacccccgtggtggtggcctgcatgagcatcatggccctgctgctgctgctgctgctgctgctgctgtacaagtacaagcagaagcccaagtaccaggtgagatggaagatcatcgagagctacgagggcaacagctacaccttcatcgaccccacccagctgccctacaacgagaagtgggagttccccagaaacaacctgcagttcggcaagaccctgggcgccggcgccttcggcaaggtggtggaggccaccgccttcggcctgggcaaggaggacgccgtgctgaaggtggccgtgaagatgctgaagagcaccgcccacgccgacgagaaggaggccctgatgagcgagctgaagatcatgagccacctgggccagcacgagaacatcgtgaacctgctgggcgcctgcacccacggcggcaccgtggccagccccgccagagtgtggacccccatgtggagatag

SEQ ID NO: 77312 - DNA, 921 bp, Artificial Sequence
  Description of Artificial Sequence: Synthetic coding sequence
atgggccccggcgtgctgctgctgctgctggtggccaccgcctggcacggccagggcatccccgtgatcgagcccagcgtgcccgagctggtggtgaagcccggcgccaccgtgaccctgagatgcgtgggcaacggcagcgtggagtgggacggcccccccagcccccactggaccctgtacagcgacggcagcagcagcatcctgagcaccaacaacgccaccttccagaacaccggcacctacagatgcaccgagcccggcgaccccctgggcggcagcgccgccatccacctgtacgtgaaggaccccgccagaccctggaacgtgctggcccaggaggtggtggtgttcgaggaccaggacgccctgctgccctgcctgctgaccgaccccgtgctggaggccggcgtgagcctggtgagagtgagaggcagacccctgatgagacacaccaactacagcttcagcccctggcacggcttcaccatccacagagccaagttcatccagagccaggactaccagtgcagcgccctgatgggcggcagaaaggtgatgagcatcagcatcagactgaaggtgcagaaggtgatccccggcccccccgccctgaccctggtgcccgccgagctggtgagaatcagaggcgaggccgcccagatcgtgtgcagcgccagcagcgtggacgtgaacttcgacgtgttcctgcagcacaacaacaccaagctggccatcccccagcagagcgacttccacaacaacagataccagaaggtgctgaccctgaacctggaccaggtggacttccagcacgccggcaactacagctgcgtggccagcaacgtgcagggcaagcacagcaccagcatgttcttcagagtggtgggcacccccagccccagcctgtgccccgcctag

SEQ ID NO: 77313 - DNA, 1134 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagcagcccagaacctaccagaagctgagctacctggacttccagtaccagctggacgtgcacagaaagaacacccagcccggcaccgagaacctgctgatcaacgtgagcggcgacctggagaacagatacaacttccccagcagcgagcccagagccaagcacagcgtgaagatcagagccgccgacgtgagaatcctgaactggagcagctggagcgaggccatcgagttcgaccacctgggcggcatccaccccagaggcagagagagactgcccagaagaggcctggacagagagggcaactacctgagacccagaggctgcagaaacggcatggacatcagcgccagcgccaccagaggcaactgcttcctggacgacgccgtgaacctgtacatcatcttctacgtgttcatctag

SEQ ID NO: 77314 - DNA, 702 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcggcagcctgggctacagcggctgcagcagacagttccacagaagcaagaccaactag

SEQ ID NO: 77315 - DNA, 1002 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagcagcccagaacctaccagaagctgagctacctggacttccagtaccagctggacgtgcacagaaagaacacccagcccggcaccgagaacctgctgatcaacgtgagcggcgacctggagaacagatacaacttccccagcagcgagcccagagccaagcacagcgtgaagatcagagccgccgacgtgagaatcctgaactggagcagctggagcgaggccatcgagttcggcagcctgggctacagcggctgcagcagacagttccacagaagcaagaccaactag

SEQ ID NO: 77316 - DNA, 1002 bp, Artificial Sequence; identical to SEQ ID NO: 77315
  Description of Artificial Sequence: Synthetic coding sequence

SEQ ID NO: 77317 - DNA, 861 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagcagcccagaacctaccagaagctgagctacctggacttccagtaccagctggacgtgcacagaaagaacacccagcccggcaccgagaacctgctggtggtgctgaccaccggcaccagcgccctgtgcaccttcatgtgcagctag

SEQ ID NO: 77318 - DNA, 1233 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagcagcccagaacctaccagaagctgagctacctggacttccagtaccagctggacgtgcacagaaagaacacccagcccggcaccgagaacctgctgatcaacgtgagcggcgacctggagaacagatacaacttccccagcagcgagcccagagccaagcacagcgtgaagatcagagccgccgacgtgagaatcctgaactggagcagctggagcgaggccatcgagttcggcagcgacgacggcaacctgggcagcgtgtacatctacgtgctgctgatcgtgggcaccctggtgtgcggcatcgtgctgggcttcctgttcaagagattcctgagaatccagagactgttcccccccgtgccccagatcaaggacaagctgaacgacaaccacgaggtggaggacgagatgggcccccagagacaccacagatgcggctggaacctgtaccccacccccggccccagccccggcagcggcagcagccccagactgggcagcgagagcagcctgtag

SEQ ID NO: 77319 - DNA, 1203 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagcagcccagaacctaccagaagctgagctacctggacttccagtaccagctggacgtgcacagaaagaacacccagcccggcaccgagaacctgctgatcaacgtgagcggcgacctggagaacagatacaacttccccagcagcgagcccagagccaagcacagcgtgaagatcagagccgccgacgtgagaatcctgaactggagcagctggagcgaggccatcgagttcggcagcgacgacggcaacctgggcagcgtgtacatctacgtgctgctgatcgtgggcaccctggtgtgcggcatcgtgctgggcttcctgttcaagagattcctgagaatccagagactgttcccccccgtgccccagatcaaggacaagctgaacgacaaccacgaggtggaggacgagatcatctgggaggagttcacccccgaggagggcaagggctacagagaggaggtgctgaccgtgaaggagatcacctag

SEQ ID NO: 77320 - DNA, 1203 bp, Artificial Sequence; identical to SEQ ID NO: 77319
  Description of Artificial Sequence: Synthetic coding sequence

SEQ ID NO: 77321 - DNA, 717 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagtag

SEQ ID NO: 77322 - DNA, 1305 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagcagcccagaacctaccagaagctgagctacctggacttccagtaccagctggacgtgcacagaaagaacacccagcccggcaccgagaacctgctgatcaacgtgagcggcgacctggagaacagatacaacttccccagcagcgagcccagagccaagcacagcgtgaagatcagagccgccgacgtgagaatcctgaactggagcagctggagcgaggccatcgagttcggcagccacagcgtgacccaggccggcgtgcagtggcacaacctgggcagcctgcagccccccagccccagactgaagagattcagctgcctgagactgcccggcagcgacgacggcaacctgggcagcgtgtacatctacgtgctgctgatcgtgggcaccctggtgtgcggcatcgtgctgggcttcctgttcaagagattcctgagaatccagagactgttcccccccgtgccccagatcaaggacaagctgaacgacaaccacgaggtggaggacgagatcatctgggaggagttcacccccgaggagggcaagggctacagagaggaggtgctgaccgtgaaggagatcacctag

SEQ ID NO: 77323 - DNA, 567 bp, Artificial Sequence
  Description of Artificial Sequence: Synthetic coding sequence
atgctgctgctggtgaccagcctgctgctgtgcgagctgccccaccccgccttcctgctgatccccgagaagagcgacctgagaaccgtggcccccgccagcagcctgaacgtgagattcgacagcagaaccatgaacctgagctgggactgccaggagaacaccaccttcagcaagtgcttcctgaccgacaagaagaacagagtggtggagcccagactgagcaacaacgagtgcagctgcaccttcagagagatctgcctgcacgagggcgtgaccttcgaggtgcacgtgaacaccagccagagaggcttccagcagaagctgctgtaccccaacagcggcagagagggcaccgccgcccagaacttcagctgcttcatctacaacgccgacctgatgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagctag

SEQ ID NO: 77324 - DNA, 1203 bp, Artificial Sequence; identical to SEQ ID NO: 77319
  Description of Artificial Sequence: Synthetic coding sequence

SEQ ID NO: 77325 - DNA, 804 bp, Artificial Sequence
  Description of Artificial Sequence: Synthetic coding sequence
atgaactgcacctgggccagaggccccaccgcccccagagacgtgcagtacttcctgtacatcagaaacagcaagagaagaagagagatcagatgcccctactacatccaggacagcggcacccacgtgggctgccacctggacaacctgagcggcctgaccagcagaaactacttcctggtgaacggcaccagcagagagatcggcatccagttcttcgacagcctgctggacaccaagaagatcgagagattcaacccccccagcaacgtgaccgtgagatgcaacaccacccactgcctggtgagatggaagcagcccagaacctaccagaagctgagctacctggacttccagtaccagctggacgtgcacagaaagaacacccagcccggcaccgagaacctgctgatcaacgtgagcggcgacctggagaacagatacaacttccccagcagcgagcccagagccaagcacagcgtgaagatcagagccgccgacgtgagaatcctgaactggagcagctggagcgaggccatcgagttcggcagcgacgacggcaacctgggcagcgtgtacatctacgtgctgctgatcgtgggcaccctggtgtgcggcatcgtgctgggcttcctgttcaagagattcctgagaatccagagactgttcccccccgtgccccagatcaaggacaagctgaacgacaaccacgaggtggaggacgagatcatctgggaggagttcacccccgaggagggcaagggctacagagaggaggtgctgaccgtgaaggagatcacctag

SEQ ID NO: 77326 - DNA, 2712 bp, Artificial Sequence
  Description of Artificial Sequence: Synthetic coding sequence
atggtgctggcccagggcctgctgagcatggccctgctggccctgtgctgggagagaagcctggccggcgccgaggagaccatccccctgcagaccctgagatgctacaacgactacaccagccacatcacctgcagatgggccgacacccaggacgcccagagactggtgaacgtgaccctgatcagaagagtgaacgaggacctgctggagcccgtgagctgcgacctgagcgacgacatgccctggagcgcctgcccccaccccagatgcgtgcccagaagatgcgtgatcccctgccagagcttcgtggtgaccgacgtggactacttcagcttccagcccgacagacccctgggcaccagactgaccgtgaccctgacccagcacgtgcagccccccgagcccagagacctgcagatcagcaccgaccaggaccacttcctgctgacctggagcgtggccctgggcagcccccagagccactggctgagccccggcgacctggagttcgaggtggtgtacaagagactgcaggacagctgggaggacgccgccatcctgctgagcaacaccagccaggccaccctgggccccgagcacctgatgcccagcagcacctacgtggccagagtgagaaccagactggcccccggcagcagactgagcggcagacccagcaagtggagccccgaggtgtgctgggacagccagcccggcgacgaggcccagccccagaacctggagtgcttcttcgacggcgccgccgtgctgagctgcagctgggaggtgagaaaggaggtggccagcagcgtgagcttcggcctgttctacaagcccagccccgacgccggcagcgccgtgctgctgagagaggaggagtgcagccccgtgctgagagagggcctgggcagcctgcacaccagacaccactgccagatccccgtgcccgaccccgccacccacggccagtacatcgtgagcgtgcagcccagaagagccgagaagcacatcaagagcagcgtgaacatccagatggccccccccagcctgaacgtgaccaaggacggcgacagctacagcctgagatgggagaccatgaagatgagatacgagcacatcgaccacaccttcgagatccagtacagaaaggacaccgccacctggaaggacagcaagaccgagaccctgcagaacgcccacagcatggccctgcccgccctggagcccagcaccagatactgggccagagtgagagtgagaaccagcagaaccggctacaacggcatctggagcgagtggagcgaggccagaagctgggacaccgagagcgtgctgcccatgtgggtgctggccctgatcgtgatcttcctgaccatcgccgtgctgctggccctgagattctgcggcatctacggctacagactgagaagaaagtgggaggagaagatccccaaccccagcaagagccacctgttccagaacggcagcgccgagctgtggccccccggcagcatgagcgccttcaccagcggcagccccccccaccagggcccctggggcagcagattccccgagctggagggcgtgttccccgtgggcttcggcgacagcgaggtgagccccctgaccatcgaggaccccaagcacgtgtgcgacccccccagcggccccgacaccacccccgccgccagcgacctgcccaccgagcagccccccagcccccagcccggcccccccgccgccagccacacccccgagaagcaggccagcagcttcgacttcaacggcccctacctgggccccccccacagcagaagcctgcccgacatcctgggccagcccgagcccccccaggagggcggcagccagaagagccccccccccggcagcctggagtacctgtgcctgcccgccggcggccaggtgcagctggtgcccctggcccaggccatgggccccggccaggccgtggaggtggagagaagacccagccagggcgccgccggcagccccagcctggagagcggcggcggccccgccccccccgccctgggccccagagtgggcggccaggaccagaaggacagccccgtggccatccccatgagcagcggcgacaccgaggaccccggcgtggccagcggctacgtgagcagcgccgacctggtgttcacccccaacagcggcgccagcagcgtgagcctggtgcccagcctgggcctgcccagcgaccagacccccagcctgtgccccggcctggccagcggcccccccggcgcccccggccccgtgaagagcggcttcgagggctacgtggagctgccccccatcgagggcagaagccccagaagccccagaaacaaccccgtgccccccgaggccaagagccccgtgctgaaccccggcgagagacccgccgacgtgagccccaccagcccccagcccgagggcctgctggtgctgcagcaggtgggcgactactgcttcctgcccggcctgggccccggccccctgagcctgagaagcaagcccagcagccccggccccggccccgagatcaagaacctggaccaggccttccaggtgaagaagccccccggccaggccgtgccccaggtgcccgtgatccagctgttcaaggccctgaagcagcaggactacctgagcctgcccccctgggaggtgaacaagcccggcgaggtgtgctag

SEQ ID NO: 77327 - DNA, 2694 bp, Artificial Sequence
  Description of Artificial Sequence: Synthetic coding sequence
atggtgctggcccagggcctgctgagcatggccctgctggccctgtgctgggagagaagcctggccggcgccgaggagaccatccccctgcagaccctgagatgctacaacgactacaccagccacatcacctgcagatgggccgacacccaggacgcccagagactggtgaacgtgaccctgatcagaagagtgaacgaggacctgctggagcccgtgagctgcgacctgagcgacgacatgccctggagcgcctgcccccaccccagatgcgtgcccagaagatgcgtgatcccctgccagagcttcgtggtgaccgacgtggactacttcagcttccagcccgacagacccctgggcaccagactgaccgtgaccctgacccagcacgtgcagccccccgagcccagagacctgcagatcagcaccgaccaggaccacttcctgctgacctggagcgtggccctgggcagcccccagagccactggctgagccccggcgacctggagttcgaggtggtgtacaagagactgcaggacagctgggaggacgccgccatcctgctgagcaacaccagccaggccaccctgggccccgagcacctgatgcccagcagcacctacgtggccagagtgagaaccagactggcccccggcagcagactgagcggcagacccagcaagtggagccccgaggtgtgctgggacagccagcccggcgacgaggcccagccccagaacctggagtgcttcttcgacggcgccgccgtgctgagctgcagctgggaggtgagaaaggaggtggccagcagcgtgagcttcggcctgttctacaagcccagccccgacgccggcgaggaggagtgcagccccgtgctgagagagggcctgggcagcctgcacaccagacaccactgccagatccccgtgcccgaccccgccacccacggccagtacatcgtgagcgtgcagcccagaagagccgagaagcacatcaagagcagcgtgaacatccagatggccccccccagcctgaacgtgaccaaggacggcgacagctacagcctgagatgggagaccatgaagatgagatacgagcacatcgaccacaccttcgagatccagtacagaaaggacaccgccacctggaaggacagcaagaccgagaccctgcagaacgcccacagcatggccctgcccgccctggagcccagcaccagatactgggccagagtgagagtgagaaccagcagaaccggctacaacggcatctggagcgagtggagcgaggccagaagctgggacaccgagagcgtgctgcccatgtgggtgctggccctgatcgtgatcttcctgaccatcgccgtgctgctggccctgagattctgcggcatctacggctacagactgagaagaaagtgggaggagaagatccccaaccccagcaagagccacctgttccagaacggcagcgccgagctgtggccccccggcagcatgagcgccttcaccagcggcagccccccccaccagggcccctggggcagcagattccccgagctggagggcgtgttccccgtgggcttcggcgacagcgaggtgagccccctgaccatcgaggaccccaagcacgtgtgcgacccccccagcggccccgacaccacccccgccgccagcgacctgcccaccgagcagccccccagcccccagcccggcccccccgccgccagccacacccccgagaagcaggccagcagcttcgacttcaacggcccctacctgggccccccccacagcagaagcctgcccgacatcctgggccagcccgagcccccccaggagggcggcagccagaagagccccccccccggcagcctggagtacctgtgcctgcccgccggcggccaggtgcagctggtgcccctggcccaggccatgggccccggccaggccgtggaggtggagagaagacccagccagggcgccgccggcagccccagcctggagagcggcggcggccccgccccccccgccctgggccccagagtgggcggccaggaccagaaggacagccccgtggccatccccatgagcagcggcgacaccgaggaccccggcgtggccagcggctacgtgagcagcgccgacctggtgttcacccccaacagcggcgccagcagcgtgagcctggtgcccagcctgggcctgcccagcgaccagacccccagcctgtgccccggcctggccagcggcccccccggcgcccccggccccgtgaagagcggcttcgagggctacgtggagctgccccccatcgagggcagaagccccagaagccccagaaacaaccccgtgccccccgaggccaagagccccgtgctgaaccccggcgagagacccgccgacgtgagccccaccagcccccagcccgagggcctgctggtgctgcagcaggtgggcgactactgcttcctgcccggcctgggccccggccccctgagcctgagaagcaagcccagcagccccggccccggccccgagatcaagaacctggaccaggccttccaggtgaagaagccccccggccaggccgtgccccaggtgcccgtgatccagctgttcaaggccctgaagcagcaggactacctgagcctgcccccctgggaggtgaacaagcccggcgaggtgtgctag

SEQ ID NO: 77328 - DNA, 690 bp, Artificial Sequence
  Description of Artificial Sequence: Synthetic coding sequence
atgccctggagcgcctgcccccaccccagatgcgtgcccagaagatgcgtgatcccctgccagagcttcgtggtgaccgacgtggactacttcagcttccagcccgacagacccctgggcaccagactgaccgtgaccctgacccagcacgtgcagccccccgagcccagagacctgcagatcagcaccgaccaggaccacttcctgctgacctggagcgtggccctgggcagcccccagagccactggctgagccccggcgacctggagttcgaggtggtgtacaagagactgcaggacagctgggaggacgccgccatcctgctgagcaacaccagccaggccaccctgggccccgagcacctgatgcccagcagcacctacgtggccagagtgagaaccagactggcccccggcagcagactgagcggcagacccagcaagtggagccccgaggtgtgctgggacagccagcccggcgacgaggcccagccccagaacctggagtgcttcttcgacggcgccgccgtgctgagctgcagctgggaggtgagaaaggaggtggccagcagcgtgagcttcggcctgttctacaagcccagccccgacgccggcgaggaggagtgcagccccgtgctgagagagggcctgggcagcctgcacaccagacaccactgccagatcccctag

SEQ ID NO: 77329 - DNA, 2535 bp, Artificial Sequence
  Description of Artificial Sequence: Synthetic coding sequence
atgggcaagctgagaccctggagagacctgctggagcccgtgagctgcgacctgagcgacgacatgccctggagcgcctgcccccaccccagatgcgtgcccagaagatgcgtgatcccctgccagagcttcgtggtgaccgacgtggactacttcagcttccagcccgacagacccctgggcaccagactgaccgtgaccctgacccagcacgtgcagccccccgagcccagagacctgcagatcagcaccgaccaggaccacttcctgctgacctggagcgtggccctgggcagcccccagagccactggctgagccccggcgacctggagttcgaggtggtgtacaagagactgcaggacagctgggaggacgccgccatcctgctgagcaacaccagccaggccaccctgggccccgagcacctgatgcccagcagcacctacgtggccagagtgagaaccagactggcccccggcagcagactgagcggcagacccagcaagtggagccccgaggtgtgctgggacagccagcccggcgacgaggcccagccccagaacctggagtgcttcttcgacggcgccgccgtgctgagctgcagctgggaggtgagaaaggaggtggccagcagcgtgagcttcggcctgttctacaagcccagccccgacgccggcagcgccgtgctgctgagagaggaggagtgcagccccgtgctgagagagggcctgggcagcctgcacaccagacaccactgccagatccccgtgcccgaccccgccacccacggccagtacatcgtgagcgtgcagcccagaagagccgagaagcacatcaagagcagcgtgaacatccagatggccccccccagcctgaacgtgaccaaggacggcgacagctacagcctgagatgggagaccatgaagatgagatacgagcacatcgaccacaccttcgagatccagtacagaaaggacaccgccacctggaaggacagcaagaccgagaccctgcagaacgcccacagcatggccctgcccgccctggagcccagcaccagatactgggccagagtgagagtgagaaccagcagaaccggctacaacggcatctggagcgagtggagcgaggccagaagctgggacaccgagagcgtgctgcccatgtgggtgctggccctgatcgtgatcttcctgaccatcgccgtgctgctggccctgagattctgcggcatctacggctacagactgagaagaaagtgggaggagaagatccccaaccccagcaagagccacctgttccagaacggcagcgccgagctgtggccccccggcagcatgagcgccttcaccagcggcagccccccccaccagggcccctggggcagcagattccccgagctggagggcgtgttccccgtgggcttcggcgacagcgaggtgagccccctgaccatcgaggaccccaagcacgtgtgcgacccccccagcggccccgacaccacccccgccgccagcgacctgcccaccgagcagccccccagcccccagcccggcccccccgccgccagccacacccccgagaagcaggccagcagcttcgacttcaacggcccctacctgggccccccccacagcagaagcctgcccgacatcctgggccagcccgagcccccccaggagggcggcagccagaagagccccccccccggcagcctggagtacctgtgcctgcccgccggcggccaggtgcagctggtgcccctggcccaggccatgggccccggccaggccgtggaggtggagagaagacccagccagggcgccgccggcagccccagcctggagagcggcggcggccccgccccccccgccctgggccccagagtgggcggccaggaccagaaggacagccccgtggccatccccatgagcagcggcgacaccgaggaccccggcgtggccagcggctacgtgagcagcgccgacctggtgttcacccccaacagcggcgccagcagcgtgagcctggtgcccagcctgggcctgcccagcgaccagacccccagcctgtgccccggcctggccagcggcccccccggcgcccccggccccgtgaagagcggcttcgagggctacgtggagctgccccccatcgagggcagaagccccagaagccccagaaacaaccccgtgccccccgaggccaagagccccgtgctgaaccccggcgagagacccgccgacgtgagccccaccagcccccagcccgagggcctgctggtgctgcagcaggtgggcgactactgcttcctgcccggcctgggccccggccccctgagcctgagaagcaagcccagcagccccggccccggccccgagatcaagaacctggaccaggccttccaggtgaagaagccccccggccaggccgtgccccaggtgcccgtgatccagctgttcaaggccctgaagcagcaggactacctgagcctgcccccctgggaggtgaacaagcccggcgaggtgtgctag

SEQ ID NO: 77330 - DNA, 2670 bp, Artificial Sequence
  Description of Artificial Sequence: Synthetic coding sequence
atggtgctggcccagggcctgctgagcatggccctgctggccctgtgctgggagagaagcctggccggcgccgaggagaccatccccctgcagaccctgagatgctacaacgactacaccagccacatcacctgcagatgggccgacacccaggacgcccagagactggtgaacgtgaccctgatcagaagagtgaacgaggacctgctggagcccgtgagctgcgacctgagcgacgacatgccctggagcgcctgcccccaccccagatgcgtgcccagaagatgcgtgatcccctgccagagcttcgtggtgaccgacgtggactacttcagcttccagcccgacagacccctgggcaccagactgaccgtgaccctgacccagcacgtgcagccccccgagcccagagacctgcagatcagcaccgaccaggaccacttcctgctgacctggagcgtggccctgggcagcccccagagccactggctgagccccggcgacctggagttcgaggtggtgtacaagagactgcaggacagctgggaggacgccgccatcctgctgagcaacaccagccaggccaccctgggccccgagcacctgatgcccagcagcacctacgtggccagagtgagaaccagactggcccccggcagcagactgagcggcagacccagcaagtggagccccgaggtgtgctgggacagccagcccggcgacgaggcccagccccagaacctggagtgcttcttcgacggcgccgccgtgctgagctgcagctgggaggtgagaaaggaggtggccagcagcgtgagcttcggcctgttctacaagcccagccccgacgccggcgaggaggagtgcagccccgtgctgagagagggcctgggcagcctgcacaccagacaccactgccagatccccgtgcccgaccccgccacccacggccagtacatcgtgagcgtgcagcccagaagagccgagaagcacatcaagagcagcgtgaacatccagatggccccccccagcctgaacgtgaccaaggacggcgacagctacagcctgagatgggagaccatgaagatgagatacgagcacatcgaccacaccttcgagatccagtacagaaaggacaccgccacctggaaggacagcaagaccgagaccctgcagaacgcccacagcatggccctgcccgccctggagcccagcaccagatactgggccagagtgagagtgagaaccagcagaaccggctacaacggcatctggagcgagtggagcgaggccagaagctgggacaccgagagcgtgctgcccatgtgggtgctggccctgatcgtgatcttcctgaccatcgccgtgctgctggccctgagattctgcggcatctacggctacagactgagaagaaagtgggaggagaagatccccaaccccagcaagagccacctgttccagaacggcagcgccgagctgtggccccccggcagcatgagcgccttcaccagcggcagccccccccaccagggcccctggggcagcagattccccgagctggagggcgtgttccccgtgggcttcggcgacagcgaggtgagccccctgaccatcgaggaccccaagcacgtgtgcgacccccccagcggccccgacaccacccccgccgccagcgacctgcccaccgagcagccccccagcccccagcccggcccccccgccgccagccacacccccgagaagcaggccagcagcttcgacttcaacggcccctacctgggccccccccacagcagaagcctgcccgacatcctgggccagcccgagcccccccaggagggcggcagccagaagagccccccccccggcagcctggagtacctgtgcctgcccgccggcggccaggtgcagctggtgcccctggcccaggccatgggccccggccaggccgtggaggtggagagaagacccagccagggcgccgccggcagccccagcctggagagcggcggcggccccgccccccccgccctgggccccagagtgggcggccaggaccagaaggacagccccgtggccatccccatgagcagcggcgacaccgaggaccccggcgtggccagcggctacgtgagcagcgccgacctggtgttcacccccaacagcggcgccagcagcgtgagcctggtgcccagcctgggcctgcccagcgaccagacccccagcctgtgccccggcctggccagcggcccccccggcgcccccggccccgtgaagagcggcttcgagggctacgtggagctgccccccatcgagggcagaagccccagaagccccagaaacaaccccgtgccccccgaggccaagagccccgtgctgaaccccggcgagagacccgccgacgtgagccccaccagcccccagcccgagggcctgctggtgctgcagcaggtgggcgactactgcttcctgcccggcctgggccccggccccctgagcctgagaagcaagcccagcagccccggccccggccccgagatcaagaacctggaccaggccttccaggtgaagaagccccccggccaggccgtgccccaggtgcccgtgatccagctgttcaaggccctggtggtgagcgtgatgagcgtgggcccccccgtgccctag

SEQ ID NO: 77331 - DNA, 2352 bp, Artificial Sequence
  Description of Artificial Sequence: Synthetic coding sequence
atggccagactgggcaactgcagcctgacctgggccgccctgatcatcctgctgctgcccggcagcctggaggagtgcggccacatcagcgtgagcgcccccatcgtgcacctgggcgaccccatcaccgccagctgcatcatcaagcagaactgcagccacctggaccccgagccccagatcctgtggagactgggcgccgagctgcagcccggcggcagacagcagagactgagcgacggcacccaggagagcatcatcaccctgccccacctgaaccacacccaggccttcctgagctgctgcctgaactggggcaacagcctgcagatcctggaccaggtggagctgagagccggctacccccccgccatcccccacaacctgagctgcctgatgaacctgaccaccagcagcctgatctgccagtgggagcccggccccgagacccacctgcccaccagcttcaccctgaagagcttcaagagcagaggcaactgccagacccagggcgacagcatcctggactgcgtgcccaaggacggccagagccactgctgcatccccagaaagcacctgctgctgtaccagaacatgggcatctgggtgcaggccgagaacgccctgggcaccagcatgagcccccagctgtgcctggaccccatggacgtggtgaagctggagccccccatgctgagaaccatggaccccagccccgaggccgcccccccccaggccggctgcctgcagctgtgctgggagccctggcagcccggcctgcacatcaaccagaagtgcgagctgagacacaagccccagagaggcgaggccagctgggccctggtgggccccctgcccctggaggccctgcagtacgagctgtgcggcctgctgcccgccaccgcctacaccctgcagatcagatgcatcagatggcccctgcccggccactggagcgactggagccccagcctggagctgagaaccaccgagagagcccccaccgtgagactggacacctggtggagacagagacagctggaccccagaaccgtgcagctgttctggaagcccgtgcccctggaggaggacagcggcagaatccagggctacgtggtgagctggagacccagcggccaggccggcgccatcctgcccctgtgcaacaccaccgagctgagctgcaccttccacctgcccagcgaggcccaggaggtggccctggtggcctacaacagcgccggcaccagcagacccacccccgtggtgttcagcgagagcagaggccccgccctgaccagactgcacgccatggccagagacccccacagcctgtgggtgggctgggagccccccaacccctggccccagggctacgtgatcgagtggggcctgggcccccccagcgccagcaacagcaacaagacctggagaatggagcagaacggcagagccaccggcttcctgctgaaggagaacatcagacccttccagctgtacgagatcatcgtgacccccctgtaccaggacaccatgggccccagccagcacgtgtacgcctacagccaggagatggcccccagccacgcccccgagctgcacctgaagcacatcggcaagacctgggcccagctggagtgggtgcccgagccccccgagctgggcaagagccccctgacccactacaccatcttctggaccaacgcccagaaccagagcttcagcgccatcctgaacgccagcagcagaggcttcgtgctgcacggcctggagcccgccagcctgtaccacatccacctgatggccgccagccaggccggcgccaccaacagcaccgtgctgaccctgatgaccctgacccccgagggcagcgagctgcacatcatcctgggcctgttcggcctgctgctgctgctgacctgcctgtgcggcaccgcctggctgtgctgcagccccaacagaaagaaccccctgtggcccagcgtgcccgaccccgcccacagcagcctgggcagctgggtgcccaccatcatggaggaggacgccttccagctgcccggcctgggcaccccccccatcaccaagctgaccgtgctggaggaggacgagaagaagcccgtgccctgggagagccacaacagcagcgagacctgcggcctgcccaccctggtgcagacctacgtgctgcagggcgaccccagagccgtgagcacccagccccagagccagagcggcaccagcgaccaggccggcccccccagaagaagcgcctacttcaaggaccagatcatgctgcaccccgccccccccaacggcctgctgtgcctgttccccatcaccagcgtgctgtag

SEQ ID NO: 77332 - DNA, 2310 bp, Artificial Sequence
  Description of Artificial Sequence: Synthetic coding sequence
atggccagactgggcaactgcagcctgacctgggccgccctgatcatcctgctgctgcccggcagcctggaggagtgcggccacatcagcgtgagcgcccccatcgtgcacctgggcgaccccatcaccgccagctgcatcatcaagcagaactgcagccacctggaccccgagccccagatcctgtggagactgggcgccgagctgcagcccggcggcagacagcagagactgagcgacggcacccaggagagcatcatcaccctgccccacctgaaccacacccaggccttcctgagctgctgcctgaactggggcaacagcctgcagatcctggaccaggtggagctgagagccggctacccccccgccatcccccacaacctgagctgcctgatgaacctgaccaccagcagcctgatctgccagtgggagcccggccccgagacccacctgcccaccagcttcaccctgaagagcttcaagagcagaggcaactgccagacccagggcgacagcatcctggactgcgtgcccaaggacggccagagccactgctgcatccccagaaagcacctgctgctgtaccagaacatgggcatctgggtgcaggccgagaacgccctgggcaccagcatgagcccccagctgtgcctggaccccatggacgtggtgaagctggagccccccatgctgagaaccatggaccccagccccgaggccgcccccccccaggccggctgcctgcagctgtgctgggagccctggcagcccggcctgcacatcaaccagaagtgcgagctgagacacaagccccagagaggcgaggccagctgggccctggtgggccccctgcccctggaggccctgcagtacgagctgtgcggcctgctgcccgccaccgcctacaccctgcagatcagatgcatcagatggcccctgcccggccactggagcgactggagccccagcctggagctgagaaccaccgagagagcccccaccgtgagactggacacctggtggagacagagacagctggaccccagaaccgtgcagctgttctggaagcccgtgcccctggaggaggacagcggcagaatccagggctacgtggtgagctggagacccagcggccaggccggcgccatcctgcccctgtgcaacaccaccgagctgagctgcaccttccacctgcccagcgaggcccaggaggtggccctggtggcctacaacagcgccggcaccagcagacccacccccgtggtgttcagcgagagcagaggccccgccctgaccagactgcacgccatggccagagacccccacagcctgtgggtgggctgggagccccccaacccctggccccagggctacgtgatcgagtggggcctgggcccccccagcgccagcaacagcaacaagacctggagaatggagcagaacggcagagccaccggcttcctgctgaaggagaacatcagacccttccagctgtacgagatcatcgtgacccccctgtaccaggacaccatgggccccagccagcacgtgtacgcctacagccaggagatggcccccagccacgcccccgagctgcacctgaagcacatcggcaagacctgggcccagctggagtgggtgcccgagccccccgagctgggcaagagccccctgacccactacaccatcttctggaccaacgcccagaaccagagcttcagcgccatcctgaacgccagcagcagaggcttcgtgctgcacggcctggagcccgccagcctgtaccacatccacctgatggccgccagccaggccggcgccaccaacagcaccgtgctgaccctgatgaccctgacccccgccggcagaatccccagcggccaggtgagccagacccagctgaccgccgcctgggcccccggctgcccccagagctggagaagaatgcccagcagctgccccgccctggccagacaccccagccccagcagccagtgctggagaagaatgaagagaagcagatgccccggcagccccatcaccgcccagagacccgtggccagccccctgtggagcagacccatgtgcagcagaggcacccaggagcagttcccccccagccccaaccccagcctggcccccgccatcagaagcttcatgggcagctgctgggccgccccccaggcccagggccagggcaccatcagcgccgtgacccccctgagccccagctggagagccagcccccccgcccccagccccatgagaaccagcggcagcagacccgccccctggggcccctggtag

SEQ ID NO: 77333 - DNA, 2511 bp, Artificial Sequence
  Description of Artificial Sequence: Synthetic coding sequence
atggccagactgggcaactgcagcctgacctgggccgccctgatcatcctgctgctgcccggcagcctggaggagtgcggccacatcagcgtgagcgcccccatcgtgcacctgggcgaccccatcaccgccagctgcatcatcaagcagaactgcagccacctggaccccgagccccagatcctgtggagactgggcgccgagctgcagcccggcggcagacagcagagactgagcgacggcacccaggagagcatcatcaccctgccccacctgaaccacacccaggccttcctgagctgctgcctgaactggggcaacagcctgcagatcctggaccaggtggagctgagagccggctacccccccgccatcccccacaacctgagctgcctgatgaacctgaccaccagcagcctgatctgccagtgggagcccggccccgagacccacctgcccaccagcttcaccctgaagagcttcaagagcagaggcaactgccagacccagggcgacagcatcctggactgcgtgcccaaggacggccagagccactgctgcatccccagaaagcacctgctgctgtaccagaacatgggcatctgggtgcaggccgagaacgccctgggcaccagcatgagcccccagctgtgcctggaccccatggacgtggtgaagctggagccccccatgctgagaaccatggaccccagccccgaggccgcccccccccaggccggctgcctgcagctgtgctgggagccctggcagcccggcctgcacatcaaccagaagtgcgagctgagacacaagccccagagaggcgaggccagctgggccctggtgggccccctgcccctggaggccctgcagtacgagctgtgcggcctgctgcccgccaccgcctacaccctgcagatcagatgcatcagatggcccctgcccggccactggagcgactggagccccagcctggagctgagaaccaccgagagagcccccaccgtgagactggacacctggtggagacagagacagctggaccccagaaccgtgcagctgttctggaagcccgtgcccctggaggaggacagcggcagaatccagggctacgtggtgagctggagacccagcggccaggccggcgccatcctgcccctgtgcaacaccaccgagctgagctgcaccttccacctgcccagcgaggcccaggaggtggccctggtggcctacaacagcgccggcaccagcagacccacccccgtggtgttcagcgagagcagaggccccgccctgaccagactgcacgccatggccagagacccccacagcctgtgggtgggctgggagccccccaacccctggccccagggctacgtgatcgagtggggcctgggcccccccagcgccagcaacagcaacaagacctggagaatggagcagaacggcagagccaccggcttcctgctgaaggagaacatcagacccttccagctgtacgagatcatcgtgacccccctgtaccaggacaccatgggccccagccagcacgtgtacgcctacagccaggagatggcccccagccacgcccccgagctgcacctgaagcacatcggcaagacctgggcccagctggagtgggtgcccgagccccccgagctgggcaagagccccctgacccactacaccatcttctggaccaacgcccagaaccagagcttcagcgccatcctgaacgccagcagcagaggcttcgtgctgcacggcctggagcccgccagcctgtaccacatccacctgatggccgccagccaggccggcgccaccaacagcaccgtgctgaccctgatgaccctgacccccgagggcagcgagctgcacatcatcctgggcctgttcggcctgctgctgctgctgacctgcctgtgcggcaccgcctggctgtgctgcagccccaacagaaagaaccccctgtggcccagcgtgcccgaccccgcccacagcagcctgggcagctgggtgcccaccatcatggaggaggacgccttccagctgcccggcctgggcaccccccccatcaccaagctgaccgtgctggaggaggacgagaagaagcccgtgccctgggagagccacaacagcagcgagacctgcggcctgcccaccctggtgcagacctacgtgctgcagggcgaccccagagccgtgagcacccagccccagagccagagcggcaccagcgaccaggtgctgtacggccagctgctgggcagccccaccagccccggccccggccactacctgagatgcgacagcacccagcccctgctggccggcctgacccccagccccaagagctacgagaacctgtggttccaggccagccccctgggcaccctggtgacccccgcccccagccaggaggacgactgcgtgttcggccccctgctgaacttccccctgctgcagggcatcagagtgcacggcatggaggccctgggcagcttctag

SEQ ID NO: 77334 - DNA, 2592 bp, Artificial Sequence
  Description of Artificial Sequence: Synthetic coding sequence
atggccagactgggcaactgcagcctgacctgggccgccctgatcatcctgctgctgcccggcagcctggaggagtgcggccacatcagcgtgagcgcccccatcgtgcacctgggcgaccccatcaccgccagctgcatcatcaagcagaactgcagccacctggaccccgagccccagatcctgtggagactgggcgccgagctgcagcccggcggcagacagcagagactgagcgacggcacccaggagagcatcatcaccctgccccacctgaaccacacccaggccttcctgagctgctgcctgaactggggcaacagcctgcagatcctggaccaggtggagctgagagccggctacccccccgccatcccccacaacctgagctgcctgatgaacctgaccaccagcagcctgatctgccagtgggagcccggccccgagacccacctgcccaccagcttcaccctgaagagcttcaagagcagaggcaactgccagacccagggcgacagcatcctggactgcgtgcccaaggacggccagagccactgctgcatccccagaaagcacctgctgctgtaccagaacatgggcatctgggtgcaggccgagaacgccctgggcaccagcatgagcccccagctgtgcctggaccccatggacgtggtgaagctggagccccccatgctgagaaccatggaccccagccccgaggccgcccccccccaggccggctgcctgcagctgtgctgggagccctggcagcccggcctgcacatcaaccagaagtgcgagctgagacacaagccccagagaggcgaggccagctgggccctggtgggccccctgcccctggaggccctgcagtacgagctgtgcggcctgctgcccgccaccgcctacaccctgcagatcagatgcatcagatggcccctgcccggccactggagcgactggagccccagcctggagctgagaaccaccgagagagcccccaccgtgagactggacacctggtggagacagagacagctggaccccagaaccgtgcagctgttctggaagcccgtgcccctggaggaggacagcggcagaatccagggctacgtggtgagctggagacccagcggccaggccggcgccatcctgcccctgtgcaacaccaccgagctgagctgcaccttccacctgcccagcgaggcccaggaggtggccctggtggcctacaacagcgccggcaccagcagacccacccccgtggtgttcagcgagagcagaggccccgccctgaccagactgcacgccatggccagagacccccacagcctgtgggtgggctgggagccccccaacccctggccccagggctacgtgatcgagtggggcctgggcccccccagcgccagcaacagcaacaagacctggagaatggagcagaacggcagagccaccggcttcctgctgaaggagaacatcagacccttccagctgtacgagatcatcgtgacccccctgtaccaggacaccatgggccccagccagcacgtgtacgcctacagccaggagatggcccccagccacgcccccgagctgcacctgaagcacatcggcaagacctgggcccagctggagtgggtgcccgagccccccgagctgggcaagagccccctgacccactacaccatcttctggaccaacgcccagaaccagagcttcagcgccatcctgaacgccagcagcagaggcttcgtgctgcacggcctggagcccgccagcctgtaccacatccacctgatggccgccagccaggccggcgccaccaacagcaccgtgctgaccctgatgaccctgacccccgagggcagcgagctgcacatcatcctgggcctgttcggcctgctgctgctgctgacctgcctgtgcggcaccgcctggctgtgctgcagccccaacagaaagaaccccctgtggcccagcgtgcccgaccccgcccacagcagcctgggcagctgggtgcccaccatcatggaggagctgcccggccccagacagggccagtggctgggccagaccagcgagatgagcagagccctgaccccccacccctgcgtgcaggacgccttccagctgcccggcctgggcaccccccccatcaccaagctgaccgtgctggaggaggacgagaagaagcccgtgccctgggagagccacaacagcagcgagacctgcggcctgcccaccctggtgcagacctacgtgctgcagggcgaccccagagccgtgagcacccagccccagagccagagcggcaccagcgaccaggtgctgtacggccagctgctgggcagccccaccagccccggccccggccactacctgagatgcgacagcacccagcccctgctggccggcctgacccccagccccaagagctacgagaacctgtggttccaggccagccccctgggcaccctggtgacccccgcccccagccaggaggacgactgcgtgttcggccccctgctgaacttccccctgctgcagggcatcagagtgcacggcatggaggccctgggcagcttctag

SEQ ID NO: 77335 - DNA, 2352 bp, Artificial Sequence; identical to SEQ ID NO: 77331
  Description of Artificial Sequence: Synthetic coding sequence

SEQ ID NO: 77336 - DNA, 2511 bp, Artificial Sequence; identical to SEQ ID NO: 77333
  Description of Artificial Sequence: Synthetic coding sequence

SEQ ID NO: 77337 - DNA, 2511 bp, Artificial Sequence; identical to SEQ ID NO: 77333
  Description of Artificial Sequence: Synthetic coding sequence

SEQ ID NO: 77338 - DNA, 2592 bp, Artificial Sequence; identical to SEQ ID NO: 77334
  Description of Artificial Sequence: Synthetic coding sequence

SEQ ID NO: 77339 - DNA, 1167 bp, Artificial Sequence
  Description of Artificial Sequence: Synthetic coding sequence
tgaaccagcagacccacccccgtggtgttcagcgagagcagaggccccgccctgaccagactgcacgccatggccagagacccccacagcctgtgggtgggctgggagccccccaacccctggccccagggctacgtgatcgagtggggcctgggcccccccagcgccagcaacagcaacaagacctggagaatggagcagaacggcagagccaccggcttcctgctgaaggcccccagccacgcccccgagctgcacctgaagcacatcggcaagacctgggcccagctggagtgggtgcccgagccccccgagctgggcaagagccccctgacccactacaccatcttctggaccaacgcccagaaccagagcttcagcgccatcctgaacgccagcagcagaggcttcgtgctgcacggcctggagcccgccagcctgtaccacatccacctgatggccgccagccaggccggcgccaccaacagcaccgtgctgaccctgatgaccctgacccccgagggcagcgagctgcacatcatcctgggcctgttcggcctgctgctgctgctgacctgcctgtgcggcaccgcctggctgtgctgcagccccaacagaaagaaccccctgtggcccagcgtgcccgaccccgcccacagcagcctgggcagctgggtgcccaccatcatggaggaggacgccttccagctgcccggcctgggcaccccccccatcaccaagctgaccgtgctggaggaggacgagaagaagcccgtgccctgggagagccacaacagcagcgagacctgcggcctgcccaccctggtgcagacctacgtgctgcagggcgaccccagagccgtgagcacccagccccagagccagagcggcaccagcgaccaggtgctgtacggccagctgctgggcagccccaccagccccggccccggccactacctgagatgcgacagcacccagcccctgctggccggcctgacccccagccccaagagctacgagaacctgtggttccaggccagccccctgggcaccctggtgacccccgcccccagccaggaggacgactgcgtgttcggccccctgctgaacttccccctgctgcagggcatcagagtgcacggcatggaggccctgggcagcttctag

SEQ ID NO: 77340 - DNA, 66 bp, Artificial Sequence
  Description of Artificial Sequence: Synthetic coding sequence
atggccagactgggcaactgcagcctgacctgggccgccctgatcatcctgctgctgcccggctag

SEQ ID NO: 77341 - DNA, 675 bp, Artificial Sequence
  Description of Artificial Sequence: Synthetic coding sequence
atgagcgccgtgggcgccgccaccccctacctgcaccaccccggcgacagccacagcggcagagtgagcttcctgggcgcccagctgccccccgaggtggccgccatggccagactgctgggcgacctggacagaagcaccttcagaaagctgctgaagttcgtggtgagcagcctgcagggcgaggactgcagagaggccgtgcagagactgggcgtgagcgccaacctgcccgaggagcagctgggcgccctgctggccggcatgcacaccctgctgcagcaggccctgagactgccccccaccagcctgaagcccgacaccttcagagaccagctgcaggagctgtgcatcccccaggacctggtgggcgacctggccagcgtggtgttcggcagccagagacccctgctggacagcgtggcccagcagcagggcgcctggctgccccacgtggccgacttcagatggagagtggacgtggccatcagcaccagcgccctggccagaagcctgcagcccagcgtgctgatgcagctgaagctgagcgacggcagcgcctacagattcgaggtgcccaccgccaagttccaggagctgagatacagcgtggccctggtgctgaaggagatggccgacctggagaagagatgcgagagaagactgcaggactag

SEQ ID NO: 77342 - DNA, 675 bp, Artificial Sequence; identical to SEQ ID NO: 77341
  Description of Artificial Sequence: Synthetic coding sequence

SEQ ID NO: 77343 - DNA, 675 bp, Artificial Sequence; identical to SEQ ID NO: 77341
  Description of Artificial Sequence: Synthetic coding sequence

SEQ ID NO: 77344 - DNA, 297 bp, Artificial Sequence
  Description of Artificial Sequence: Synthetic coding sequence
atggaggccagcagcgagccccccctggacgccaagagcgacgtgaccaaccagctggtggacttccagtggaagctgggcatggccgtgagcagcgacacctgcagaagcctgaagtacccctacgtggccgtgatgctgaaggtggccgaccacagcggccaggtgaagaccaagtgcttcgagatgaccatcccccagttccagccccagctgctggccaccagcagcctgctgagcgccagcaacttctacagacagttcaaggagatcgccgccgtgatcgagaccgtgtag

SEQ ID NO: 77345 - DNA, 258 bp, Artificial Sequence
  Description of Artificial Sequence: Synthetic coding sequence
atggaggccagcagcgagccccccctggacgccaagagcgacgtgaccaaccagctggtggacttccagtggaagctgggcatggccgtgagcagcgacacctgcagaagcctgaagtacccctacgtggccgtgatgctgaaggtggccgaccacagcggccaggtgaagaccaagtgcttcgagatgaccatcccccagttccagaacttctacagacagttcaaggagatcgccgccgtgatcgagaccgtgtag

SEQ ID NO: 77346 - DNA, 258 bp, Artificial Sequence; identical to SEQ ID NO: 77345
  Description of Artificial Sequence: Synthetic coding sequence

SEQ ID NO: 77347 - DNA, 7470 bp, Artificial Sequence
  Description of Artificial Sequence: Synthetic coding sequence
atgggcgccagcagccccagaagccccgagcccgtgggcccccccgcccccggcctgcccttctgctgcggcggcagcctgctggccgtggtggtgctgctggccctgcccgtggcctggggccagtgcaacgcccccgagtggctgcccttcgccagacccaccaacctgaccgacgagttcgagttccccatcggcacctacctgaactacgagtgcagacccggctacagcggcagacccttcagcatcatctgcctgaagaacagcgtgtggaccggcgccaaggacagatgcagaagaaagagctgcagaaacccccccgaccccgtgaacggcatggtgcacgtgatcaagggcatccagttcggcagccagatcaagtacagctgcaccaagggctacagactgatcggcagcagcagcgccacctgcatcatcagcggcgacaccgtgatctgggacaacgagacccccatctgcgacagaatcccctgcggcctgccccccaccatcaccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaagaccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacgccgcccactggagcaccaagccccccatctgccagagaatcccctgcggcctgccccccaccatcgccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaagaccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacgccgcccactggagcaccaagccccccatctgccagagaatcccctgcggcctgccccccaccatcgccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaaggccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacaccgcccactggagcaccaagccccccatctgccagagaatcccctgcggcctgccccccaccatcgccaacggcgacttcatcagcaccaacagagagaacttccactacggcagcgtggtgacctacagatgcaacctgggcagcagaggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgagatcctgcacggcgagcacacccccagccaccaggacaacttcagccccggccaggaggtgttctacagctgcgagcccggctacgacctgagaggcgccgccagcctgcactgcaccccccagggcgactggagccccgaggcccccagatgcgccgtgaagagctgcgacgacttcctgggccagctgccccacggcagagtgctgttccccctgaacctgcagctgggcgccaaggtgagcttcgtgtgcgacgagggcttcagactgaagggcagcagcgtgagccactgcgtgctggtgggcatgagaagcctgtggaacaacagcgtgcccgtgtgcgagcacatcttctgccccaacccccccgccatcctgaacggcagacacaccggcacccccagcggcgacatcccctacggcaaggagatcagctacacctgcgacccccaccccgacagaggcatgaccttcaacctgatcggcgagagcaccatcagatgcaccagcgacccccacggcaacggcgtgtggagcagccccgcccccagatgcgagctgagcgtgagagccggccactgcaagacccccgagcagttccccttcgccagccccaccatccccatcaacgacttcgagttccccgtgggcaccagcctgaactacgagtgcagacccggctacttcggcaagatgttcagcatcagctgcctggagaacctggtgtggagcagcgtggaggacaactgcagaagaaagagctgcggccccccccccgagcccttcaacggcatggtgcacatcaacaccgacacccagttcggcagcaccgtgaactacagctgcaacgagggcttcagactgatcggcagccccagcaccacctgcctggtgagcggcaacaacgtgacctgggacaagaaggcccccatctgcgagatcatcagctgcgagcccccccccaccatcagcaacggcgacttctacagcaacaacagaaccagcttccacaacggcaccgtggtgacctaccagtgccacaccggccccgacggcgagcagctgttcgagctggtgggcgagagaagcatctactgcaccagcaaggacgaccaggtgggcgtgtggagcagccccccccccagatgcatcagcaccaacaagtgcaccgcccccgaggtggagaacgccatcagagtgcccggcaacagaagcttcttcaccctgaccgagatcatcagattcagatgccagcccggcttcgtgatggtgggcagccacaccgtgcagtgccagaccaacggcagatggggccccaagctgccccactgcagcagagtgtgccagcccccccccgagatcctgcacggcgagcacaccctgagccaccaggacaacttcagccccggccaggaggtgttctacagctgcgagcccagctacgacctgagaggcgccgccagcctgcactgcaccccccagggcgactggagccccgaggcccccagatgcaccgtgaagagctgcgacgacttcctgggccagctgccccacggcagagtgctgctgcccctgaacctgcagctgggcgccaaggtgagcttcgtgtgcgacgagggcttcagactgaagggcagaagcgccagccactgcgtgctggccggcatgaaggccctgtggaacagcagcgtgcccgtgtgcgagcagatcttctgccccaacccccccgccatcctgaacggcagacacaccggcacccccttcggcgacatcccctacggcaaggagatcagctacgcctgcgacacccaccccgacagaggcatgaccttcaacctgatcggcgagagcagcatcagatgcaccagcgacccccagggcaacggcgtgtggagcagccccgcccccagatgcgagctgagcgtgcccgccgcctgcccccacccccccaagatccagaacggccactacatcggcggccacgtgagcctgtacctgcccggcatgaccatcagctacatctgcgaccccggctacctgctggtgggcaagggcttcatcttctgcaccgaccagggcatctggagccagctggaccactactgcaaggaggtgaactgcagcttccccctgttcatgaacggcatcagcaaggagctggagatgaagaaggtgtaccactacggcgactacgtgaccctgaagtgcgaggacggctacaccctggagggcagcccctggagccagtgccaggccgacgacagatgggacccccccctggccaagtgcaccagcagaacccacgacgccctgatcgtgggcaccctgagcggcaccatcttcttcatcctgctgatcatcttcctgagctggatcatcctgaagcacagaaagggcaacaacgcccacgagaaccccaaggaggtggccatccacctgcacagccagggcggcagcagcgtgcaccccagaaccctgcagaccaacgaggagaacagcagagtgctgccctag

SEQ ID NO: 77348 - DNA, 6120 bp, Artificial Sequence
  Description of Artificial Sequence: Synthetic coding sequence
atgggcgccagcagccccagaagccccgagcccgtgggcccccccgcccccggcctgcccttctgctgcggcggcagcctgctggccgtggtggtgctgctggccctgcccgtggcctggggccagtgcaacgcccccgagtggctgcccttcgccagacccaccaacctgaccgacgagttcgagttccccatcggcacctacctgaactacgagtgcagacccggctacagcggcagacccttcagcatcatctgcctgaagaacagcgtgtggaccggcgccaaggacagatgcagaagaaagagctgcagaaacccccccgaccccgtgaacggcatggtgcacgtgatcaagggcatccagttcggcagccagatcaagtacagctgcaccaagggctacagactgatcggcagcagcagcgccacctgcatcatcagcggcgacaccgtgatctgggacaacgagacccccatctgcgacagaatcccctgcggcctgccccccaccatcgccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaagaccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacgccgcccactggagcaccaagccccccatctgccagagaatcccctgcggcctgccccccaccatcgccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaaggccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacaccgcccactggagcaccaagccccccatctgccagagaatcccctgcggcctgccccccaccatcgccaacggcgacttcatcagcaccaacagagagaacttccactacggcagcgtggtgacctacagatgcaacctgggcagcagaggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgagatcctgcacggcgagcacacccccagccaccaggacaacttcagccccggccaggaggtgttctacagctgcgagcccggctacgacctgagaggcgccgccagcctgcactgcaccccccagggcgactggagccccgaggcccccagatgcgccgtgaagagctgcgacgacttcctgggccagctgccccacggcagagtgctgttccccctgaacctgcagctgggcgccaaggtgagcttcgtgtgcgacgagggcttcagactgaagggcagcagcgtgagccactgcgtgctggtgggcatgagaagcctgtggaacaacagcgtgcccgtgtgcgagcacatcttctgccccaacccccccgccatcctgaacggcagacacaccggcacccccagcggcgacatcccctacggcaaggagatcagctacacctgcgacccccaccccgacagaggcatgaccttcaacctgatcggcgagagcaccatcagatgcaccagcgacccccacggcaacggcgtgtggagcagccccgcccccagatgcgagctgagcgtgagagccggccactgcaagacccccgagcagttccccttcgccagccccaccatccccatcaacgacttcgagttccccgtgggcaccagcctgaactacgagtgcagacccggctacttcggcaagatgttcagcatcagctgcctggagaacctggtgtggagcagcgtggaggacaactgcagaagaaagagctgcggccccccccccgagcccttcaacggcatggtgcacatcaacaccgacacccagttcggcagcaccgtgaactacagctgcaacgagggcttcagactgatcggcagccccagcaccacctgcctggtgagcggcaacaacgtgacctgggacaagaaggcccccatctgcgagatcatcagctgcgagcccccccccaccatcagcaacggcgacttctacagcaacaacagaaccagcttccacaacggcaccgtggtgacctaccagtgccacaccggccccgacggcgagcagctgttcgagctggtgggcgagagaagcatctactgcaccagcaaggacgaccaggtgggcgtgtggagcagccccccccccagatgcatcagcaccaacaagtgcaccgcccccgaggtggagaacgccatcagagtgcccggcaacagaagcttcttcaccctgaccgagatcatcagattcagatgccagcccggcttcgtgatggtgggcagccacaccgtgcagtgccagaccaacggcagatggggccccaagctgccccactgcagcagagtgtgccagcccccccccgagatcctgcacggcgagcacaccctgagccaccaggacaacttcagccccggccaggaggtgttctacagctgcgagcccagctacgacctgagaggcgccgccagcctgcactgcaccccccagggcgactggagccccgaggcccccagatgcaccgtgaagagctgcgacgacttcctgggccagctgccccacggcagagtgctgctgcccctgaacctgcagctgggcgccaaggtgagcttcgtgtgcgacgagggcttcagactgaagggcagaagcgccagccactgcgtgctggccggcatgaaggccctgtggaacagcagcgtgcccgtgtgcgagcagatcttctgccccaacccccccgccatcctgaacggcagacacaccggcacccccttcggcgacatcccctacggcaaggagatcagctacgcctgcgacacccaccccgacagaggcatgaccttcaacctgatcggcgagagcagcatcagatgcaccagcgacccccagggcaacggcgtgtggagcagccccgcccccagatgcgagctgagcgtgcccgccgcctgcccccacccccccaagatccagaacggccactacatcggcggccacgtgagcctgtacctgcccggcatgaccatcagctacatctgcgaccccggctacctgctggtgggcaagggcttcatcttctgcaccgaccagggcatctggagccagctggaccactactgcaaggaggtgaactgcagcttccccctgttcatgaacggcatcagcaaggagctggagatgaagaaggtgtaccactacggcgactacgtgaccctgaagtgcgaggacggctacaccctggagggcagcccctggagccagtgccaggccgacgacagatgggacccccccctggccaagtgcaccagcagaacccacgacgccctgatcgtgggcaccctgagcggcaccatcttcttcatcctgctgatcatcttcctgagctggatcatcctgaagcacagaaagggcaacaacgcccacgagaaccccaaggaggtggccatccacctgcacagccagggcggcagcagcgtgcaccccagaaccctgcagaccaacgaggagaacagcagagtgctgccctag

SEQ ID NO: 77349 - DNA, 6120 bp, Artificial Sequence
  Description of Artificial Sequence: Synthetic coding sequence
atgggcgccagcagccccagaagccccgagcccgtgggcccccccgcccccggcctgcccttctgctgcggcggcagcctgctggccgtggtggtgctgctggccctgcccgtggcctggggccagtgcaacgcccccgagtggctgcccttcgccagacccaccaacctgaccgacgagttcgagttccccatcggcacctacctgaactacgagtgcagacccggctacagcggcagacccttcagcatcatctgcctgaagaacagcgtgtggaccggcgccaaggacagatgcagaagaaagagctgcagaaacccccccgaccccgtgaacggcatggtgcacgtgatcaagggcatccagttcggcagccagatcaagtacagctgcaccaagggctacagactgatcggcagcagcagcgccacctgcatcatcagcggcgacaccgtgatctgggacaacgagacccccatctgcgacagaatcccctgcggcctgccccccaccatcaccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaagaccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacgccgcccactggagcaccaagccccccatctgccagagaatcccctgcggcctgccccccaccatcgccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaagaccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacaccgcccactggagcaccaagccccccatctgccagagaatcccctgcggcctgccccccaccatcgccaacggcgacttcatcagcaccaacagagagaacttccactacggcagcgtggtgacctacagatgcaacctgggcagcagaggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgagatcctgcacggcgagcacacccccagccaccaggacaacttcagccccggccaggaggtgttctacagctgcgagcccggctacgacctgagaggcgccgccagcctgcactgcaccccccagggcgactggagccccgaggcccccagatgcgccgtgaagagctgcgacgacttcctgggccagctgccccacggcagagtgctgttccccctgaacctgcagctgggcgccaaggtgagcttcgtgtgcgacgagggcttcagactgaagggcagcagcgtgagccactgcgtgctggtgggcatgagaagcctgtggaacaacagcgtgcccgtgtgcgagcacatcttctgccccaacccccccgccatcctgaacggcagacacaccggcacccccagcggcgacatcccctacggcaaggagatcagctacacctgcgacccccaccccgacagaggcatgaccttcaacctgatcggcgagagcaccatcagatgcaccagcgacccccacggcaacggcgtgtggagcagccccgcccccagatgcgagctgagcgtgagagccggccactgcaagacccccgagcagttccccttcgccagccccaccatccccatcaacgacttcgagttccccgtgggcaccagcctgaactacgagtgcagacccggctacttcggcaagatgttcagcatcagctgcctggagaacctggtgtggagcagcgtggaggacaactgcagaagaaagagctgcggccccccccccgagcccttcaacggcatggtgcacatcaacaccgacacccagttcggcagcaccgtgaactacagctgcaacgagggcttcagactgatcggcagccccagcaccacctgcctggtgagcggcaacaacgtgacctgggacaagaaggcccccatctgcgagatcatcagctgcgagcccccccccaccatcagcaacggcgacttctacagcaacaacagaaccagcttccacaacggcaccgtggtgacctaccagtgccacaccggccccgacggcgagcagctgttcgagctggtgggcgagagaagcatctactgcaccagcaaggacgaccaggtgggcgtgtggagcagccccccccccagatgcatcagcaccaacaagtgcaccgcccccgaggtggagaacgccatcagagtgcccggcaacagaagcttcttcaccctgaccgagatcatcagattcagatgccagcccggcttcgtgatggtgggcagccacaccgtgcagtgccagaccaacggcagatggggccccaagctgccccactgcagcagagtgtgccagcccccccccgagatcctgcacggcgagcacaccctgagccaccaggacaacttcagccccggccaggaggtgttctacagctgcgagcccagctacgacctgagaggcgccgccagcctgcactgcaccccccagggcgactggagccccgaggcccccagatgcaccgtgaagagctgcgacgacttcctgggccagctgccccacggcagagtgctgctgcccctgaacctgcagctgggcgccaaggtgagcttcgtgtgcgacgagggcttcagactgaagggcagaagcgccagccactgcgtgctggccggcatgaaggccctgtggaacagcagcgtgcccgtgtgcgagcagatcttctgccccaacccccccgccatcctgaacggcagacacaccggcacccccttcggcgacatcccctacggcaaggagatcagctacgcctgcgacacccaccccgacagaggcatgaccttcaacctgatcggcgagagcagcatcagatgcaccagcgacccccagggcaacggcgtgtggagcagccccgcccccagatgcgagctgagcgtgcccgccgcctgcccccacccccccaagatccagaacggccactacatcggcggccacgtgagcctgtacctgcccggcatgaccatcagctacatctgcgaccccggctacctgctggtgggcaagggcttcatcttctgcaccgaccagggcatctggagccagctggaccactactgcaaggaggtgaactgcagcttccccctgttcatgaacggcatcagcaaggagctggagatgaagaaggtgtaccactacggcgactacgtgaccctgaagtgcgaggacggctacaccctggagggcagcccctggagccagtgccaggccgacgacagatgggacccccccctggccaagtgcaccagcagaacccacgacgccctgatcgtgggcaccctgagcggcaccatcttcttcatcctgctgatcatcttcctgagctggatcatcctgaagcacagaaagggcaacaacgcccacgagaaccccaaggaggtggccatccacctgcacagccagggcggcagcagcgtgcaccccagaaccctgcagaccaacgaggagaacagcagagtgctgccctag

SEQ ID NO: 77350 - DNA, 6120 bp, Artificial Sequence
  Description of Artificial Sequence: Synthetic coding sequence
atgggcgccagcagccccagaagccccgagcccgtgggcccccccgcccccggcctgcccttctgctgcggcggcagcctgctggccgtggtggtgctgctggccctgcccgtggcctggggccagtgcaacgcccccgagtggctgcccttcgccagacccaccaacctgaccgacgagttcgagttccccatcggcacctacctgaactacgagtgcagacccggctacagcggcagacccttcagcatcatctgcctgaagaacagcgtgtggaccggcgccaaggacagatgcagaagaaagagctgcagaaacccccccgaccccgtgaacggcatggtgcacgtgatcaagggcatccagttcggcagccagatcaagtacagctgcaccaagggctacagactgatcggcagcagcagcgccacctgcatcatcagcggcgacaccgtgatctgggacaacgagacccccatctgcgacagaatcccctgcggcctgccccccaccatcaccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaagaccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacgccgcccactggagcaccaagccccccatctgccagagaatcccctgcggcctgccccccaccatcgccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaaggccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacaccgcccactggagcaccaagccccccatctgccagagaatcccctgcggcctgccccccaccatcgccaacggcgacttcatcagcaccaacagagagaacttccactacggcagcgtggtgacctacagatgcaacctgggcagcagaggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgagatcctgcacggcgagcacacccccagccaccaggacaacttcagccccggccaggaggtgttctacagctgcgagcccggctacgacctgagaggcgccgccagcctgcactgcaccccccagggcgactggagccccgaggcccccagatgcgccgtgaagagctgcgacgacttcctgggccagctgccccacggcagagtgctgttccccctgaacctgcagctgggcgccaaggtgagcttcgtgtgcgacgagggcttcagactgaagggcagcagcgtgagccactgcgtgctggtgggcatgagaagcctgtggaacaacagcgtgcccgtgtgcgagcacatcttctgccccaacccccccgccatcctgaacggcagacacaccggcacccccagcggcgacatcccctacggcaaggagatcagctacacctgcgacccccaccccgacagaggcatgaccttcaacctgatcggcgagagcaccatcagatgcaccagcgacccccacggcaacggcgtgtggagcagccccgcccccagatgcgagctgagcgtgagagccggccactgcaagacccccgagcagttccccttcgccagccccaccatccccatcaacgacttcgagttccccgtgggcaccagcctgaactacgagtgcagacccggctacttcggcaagatgttcagcatcagctgcctggagaacctggtgtggagcagcgtggaggacaactgcagaagaaagagctgcggccccccccccgagcccttcaacggcatggtgcacatcaacaccgacacccagttcggcagcaccgtgaactacagctgcaacgagggcttcagactgatcggcagccccagcaccacctgcctggtgagcggcaacaacgtgacctgggacaagaaggcccccatctgcgagatcatcagctgcgagcccccccccaccatcagcaacggcgacttctacagcaacaacagaaccagcttccacaacggcaccgtggtgacctaccagtgccacaccggccccgacggcgagcagctgttcgagctggtgggcgagagaagcatctactgcaccagcaaggacgaccaggtgggcgtgtggagcagccccccccccagatgcatcagcaccaacaagtgcaccgcccccgaggtggagaacgccatcagagtgcccggcaacagaagcttcttcaccctgaccgagatcatcagattcagatgccagcccggcttcgtgatggtgggcagccacaccgtgcagtgccagaccaacggcagatggggccccaagctgccccactgcagcagagtgtgccagcccccccccgagatcctgcacggcgagcacaccctgagccaccaggacaacttcagccccggccaggaggtgttctacagctgcgagcccagctacgacctgagaggcgccgccagcctgcactgcaccccccagggcgactggagccccgaggcccccagatgcaccgtgaagagctgcgacgacttcctgggccagctgccccacggcagagtgctgctgcccctgaacctgcagctgggcgccaaggtgagcttcgtgtgcgacgagggcttcagactgaagggcagaagcgccagccactgcgtgctggccggcatgaaggccctgtggaacagcagcgtgcccgtgtgcgagcagatcttctgccccaacccccccgccatcctgaacggcagacacaccggcacccccttcggcgacatcccctacggcaaggagatcagctacgcctgcgacacccaccccgacagaggcatgaccttcaacctgatcggcgagagcagcatcagatgcaccagcgacccccagggcaacggcgtgtggagcagccccgcccccagatgcgagctgagcgtgcccgccgcctgcccccacccccccaagatccagaacggccactacatcggcggccacgtgagcctgtacctgcccggcatgaccatcagctacatctgcgaccccggctacctgctggtgggcaagggcttcatcttctgcaccgaccagggcatctggagccagctggaccactactgcaaggaggtgaactgcagcttccccctgttcatgaacggcatcagcaaggagctggagatgaagaaggtgtaccactacggcgactacgtgaccctgaagtgcgaggacggctacaccctggagggcagcccctggagccagtgccaggccgacgacagatgggacccccccctggccaagtgcaccagcagaacccacgacgccctgatcgtgggcaccctgagcggcaccatcttcttcatcctgctgatcatcttcctgagctggatcatcctgaagcacagaaagggcaacaacgcccacgagaaccccaaggaggtggccatccacctgcacagccagggcggcagcagcgtgcaccccagaaccctgcagaccaacgaggagaacagcagagtgctgccctag

SEQ ID NO: 77351 - DNA, 6120 bp, Artificial Sequence; identical to SEQ ID NO: 77350
  Description of Artificial Sequence: Synthetic coding sequence

SEQ ID NO: 77352 - DNA, 1755 bp, Artificial Sequence
  Description of Artificial Sequence: Synthetic coding sequence
ggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacgccgcccactggagcaccaagccccccatctgccagagaatcccctgcggcctgccccccaccatcgccaacggcgacttcatcagcaccaacagagagaacttccactacggcagcgtggtgacctacagatgcaaccccggcagcggcggcagaaaggtgttcgagctggtgggcgagcccagcatctactgcaccagcaacgacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcgtgatgaagggccccagaagagtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcgccgccagcatgagatgcaccccccagggcgactggagccccgccgcccccacctgcgaggtgaagagctgcgacgacttcatgggccagctgctgaacggcagagtgctgttccccgtgaacctgcagctgggcgccaaggtggacttcgtgtgcgacgagggcttccagctgaagggcagcagcgccagctactgcgtgctggccggcatggagagcctgtggaacagcagcgtgcccgtgtgcgagcagatcttctgccccagcccccccgtgatccccaacggcagacacaccggcaagcccctggaggtgttccccttcggcaagaccgtgaactacacctgcgacccccaccccgacagaggcaccagcttcgacctgatcggcgagagcaccatcagatgcaccagcgacccccagggcaacggcgtgtggagcagccccgcccccagatgcggcatcctgggccactgccaggcccccgaccacttcctgttcgccaagctgaagacccagaccaacgccagcgacttccccatcggcaccagcctgaagtacgagtgcagacccgagtactacggcagacccttcagcatcacctgcctggacaacctggtgtggagcagccccaaggacgtgtgcaagagaaagagctgcaagaccccccccgaccccgtgaacggcatggtgcacgtgatcaccgacatccaggtgggcagcagaatcaactacagctgcaccaccggccacagactgatcggccacagcagcgccgagtgcatcctgagcggcaacgccgcccactggagcaccaagccccccatctgccagagaagctgccacctgccctgcgagctgttcggcagatag

SEQ ID NO: 77353 - DNA, 1335 bp, Artificial Sequence
  Description of Artificial Sequence: Synthetic coding sequence
atggccccccccgtgagactggagagacccttccccagcagaagattccccggcctgctgctggccgccctggtgctgctgctgagcagcttcagcgaccagtgcaacgtgcccgagtggctgcccttcgccagacccaccaacctgaccgacgacttcgagttccccatcggcacctacctgaactacgagtgcagacccggctacagcggcagacccttcagcatcatctgcctgaagaacagcgtgtggaccagcgccaaggacaagtgcaagagaaagagctgcagaaacccccccgaccccgtgaacggcatggcccacgtgatcaaggacatccagttcagaagccagatcaagtacagctgccccaagggctacagactgatcggcagcagcagcgccacctgcatcatcagcggcaacaccgtgatctgggacaacaagacccccgtgtgcgacagaatcatctgcggcctgccccccaccatcgccaacggcgacttcaccagcatcagcagagagtacttccactacggcagcgtggtgacctaccactgcaacctgggcagcagaggcaagaaggtgttcgagctggtgggcgagcccagcatctactgcaccagcaaggacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcggcatgaagggccccagccacgtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcagcacctacctgcactgcaccccccagggcgactggagccccgccgcccccagatgcgaggtgaagagctgcgacgacttcctgggccagctgcccaacggccacgtgctgttccccctgaacctgcagctgggcgccaaggtggacttcgtgtgcgacgagggcttccagctgaagggcagcagcgccagctactgcgtgctggccggcatggagagcctgtggaacagcagcgtgcccgtgtgcgagagaaagagctgcgagaccccccccgtgcccgtgaacggcatggtgcacgtgatcaccgacatccacgtgggcagcagaatcaactacagctgcaccaccggcttctag

SEQ ID NO: 77354 - DNA, 1710 bp, Artificial Sequence
  Description of Artificial Sequence: Synthetic coding sequence
atggccccccccgtgagactggagagacccttccccagcagaagattccccggcctgctgctggccgccctggtgctgctgctgagcagcttcagcgaccagtgcaacgtgcccgagtggctgcccttcgccagacccaccaacctgaccgacgacttcgagttccccatcggcacctacctgaactacgagtgcagacccggctacagcggcagacccttcagcatcatctgcctgaagaacagcgtgtggaccagcgccaaggacaagtgcaagagaaagagctgcagaaacccccccgaccccgtgaacggcatggcccacgtgatcaaggacatccagttcagaagccagatcaagtacagctgccccaagggctacagactgatcggcagcagcagcgccacctgcatcatcagcggcaacaccgtgatctgggacaacaagacccccgtgtgcgacagaatcatctgcggcctgccccccaccatcgccaacggcgacttcaccagcatcagcagagagtacttccactacggcagcgtggtgacctaccactgcaacctgggcagcagaggcaagaaggtgttcgagctggtgggcgagcccagcatctactgcaccagcaaggacgaccaggtgggcatctggagcggccccgccccccagtgcatcatccccaacaagtgcaccccccccaacgtggagaacggcatcctggtgagcgacaacagaagcctgttcagcctgaacgaggtggtggagttcagatgccagcccggcttcggcatgaagggccccagccacgtgaagtgccaggccctgaacaagtgggagcccgagctgcccagctgcagcagagtgtgccagcccccccccgacgtgctgcacgccgagagaacccagagagacaaggacaacttcagccccggccaggaggtgttctacagctgcgagcccggctacgacctgagaggcagcacctacctgcactgcaccccccagggcgactggagccccgccgcccccagatgcgaggtgaagagctgcgacgacttcctgggccagctgcccaacggccacgtgctgttccccctgaacctgcagctgggcgccaaggtggacttcgtgtgcgacgagggcttccagctgaagggcagcagcgccagctactgcgtgctggccggcatggagagcctgtggaacagcagcgtgcccgtgtgcgagagaaagagctgcgagaccccccccgtgcccgtgaacggcatggtgcacgtgatcaccgacatccacgtgggcagcagaatcaactacagctgcaccaccggccacagactgatcggccacagcagcgccgagtgcatcctgagcggcaacaccgcccactggagcatgaagccccccatctgccagcagatcttctgccccaacccccccgccatcctgaacggcagacacaccggcacccccctgggcgacatcccctacggcaaggaggtgagctacacctgcgacccccaccccgacagaggcatgaccttcaacctgatcggcgagagcaccatcagaagaaccagcgagccccacggcaacggcgtgtggagcagccccgcccccagatgcgagctgcccgtgggcgccggcagccacgacgccctgatcgtgggcaagttctacgaggtgttcgccgaggagttctgccacctgtag

SEQ ID NO: 77355 - DNA, 3279 bp, Artificial Sequence
  Description of Artificial Sequence: Synthetic coding sequence
atgggcgccgccggcctgctgggcgtgttcctggccctggtggcccccggcgtgctgggcatcagctgcggcagccccccccccatcctgaacggcagaatcagctactacagcacccccatcgccgtgggcaccgtgatcagatacagctgcagcggcaccttcagactgatcggcgagaagagcctgctgtgcatcaccaaggacaaggtggacggcacctgggacaagcccgcccccaagtgcgagtacttcaacaagtacagcagctgccccgagcccatcgtgcccggcggctacaagatcagaggcagcaccccctacagacacggcgacagcgtgaccttcgcctgcaagaccaacttcagcatgaacggcaacaagagcgtgtggtgccaggccaacaacatgtggggccccaccagactgcccacctgcgtgagcgtgttccccctggagtgccccgccctgcccatgatccacaacggccaccacaccagcgagaacgtgggcagcatcgcccccggcctgagcgtgacctacagctgcgagagcggctacctgctggtgggcgagaagatcatcaactgcctgagcagcggcaagtggagcgccgtgccccccacctgcgaggaggccagatgcaagagcctgggcagattccccaacggcaaggtgaaggagccccccatcctgagagtgggcgtgaccgccaacttcttctgcgacgagggctacagactgcagggcccccccagcagcagatgcgtgatcgccggccagggcgtggcctggaccaagatgcccgtgtgcgaggagatcttctgccccagccccccccccatcctgaacggcagacacatcggcaacagcctggccaacgtgagctacggcagcatcgtgacctacacctgcgaccccgaccccgaggagggcgtgaacttcatcctgatcggcgagagcaccctgagatgcaccgtggacagccagaagaccggcacctggagcggccccgcccccagatgcgagctgagcaccagcgccgtgcagtgcccccacccccagatcctgagaggcagaatggtgagcggccagaaggacagatacacctacaacgacaccgtgatcttcgcctgcatgttcggcttcaccctgaagggcagcaagcagatcagatgcaacgcccagggcacctgggagcccagcgcccccgtgtgcgagaaggagtgccaggccccccccaacatcctgaacggccagaaggaggacagacacatggtgagattcgaccccggcaccagcatcaagtacagctgcaaccccggctacgtgctggtgggcgaggagagcatccagtgcaccagcgagggcgtgtggaccccccccgtgccccagtgcaaggtggccgcctgcgaggccaccggcagacagctgctgaccaagccccagcaccagttcgtgagacccgacgtgaacagcagctgcggcgagggctacaagctgagcggcagcgtgtaccaggagtgccagggcaccatcccctggttcatggagatcagactgtgcaaggagatcacctgcccccccccccccgtgatctacaacggcgcccacaccggcagcagcctggaggacttcccctacggcaccaccgtgacctacacctgcaaccccggccccgagagaggcgtggagttcagcctgatcggcgagagcaccatcagatgcaccagcaacgaccaggagagaggcacctggagcggccccgcccccctgtgcaagctgagcctgctggccgtgcagtgcagccacgtgcacatcgccaacggctacaagatcagcggcaaggaggccccctacttctacaacgacaccgtgaccttcaagtgctacagcggcttcaccctgaagggcagcagccagatcagatgcaaggccgacaacacctgggaccccgagatccccgtgtgcgagaagggctgccagagcccccccggcctgcaccacggcagacacaccggcggcaacaccgtgttcttcgtgagcggcatgaccgtggactacacctgcgaccccggctacctgctggtgggcaacaagagcatccactgcatgcccagcggcaactggagccccagcgcccccagatgcgaggagacctgccagcacgtgagacagagcctgcaggagctgcccgccggcagcagagtggagctggtgaacaccagctgccaggacggctaccagctgaccggccacgcctaccagatgtgccaggacgccgagaacggcatctggttcaagaagatccccctgtgcaaggtgatccactgccaccccccccccgtgatcgtgaacggcaagcacaccggcatgatggccgagaacttcctgtacggcaacgaggtgagctacgagtgcgaccagggcttctacctgctgggcgagaagaagctgcagtgcagaagcgacagcaagggccacggcagctggagcggccccagcccccagtgcctgagaagcccccccgtgaccagatgccccaaccccgaggtgaagcacggctacaagctgaacaagacccacagcgcctacagccacaacgacatcgtgtacgtggactgcaaccccggcttcatcatgaacggcagcagagtgatcagatgccacaccgacaacacctgggtgcccggcgtgcccacctgcatcaagaaggccttcatcggctgcccccccccccccaagacccccaacggcaaccacaccggcggcaacatcgccagattcagccccggcatgagcatcctgtacagctgcgaccagggctacctgctggtgggcgaggccctgctgctgtgcacccacgagggcacctggagccagcccgccccccactgcaaggaggtgaactgcagcagccccgccgacatggacggcatccagaagggcctggagcccagaaagatgtaccagtacggcgccgtggtgaccctggagtgcgaggacggctacatgctggagggcagcccccagagccagtgccagagcgaccaccagtggaacccccccctggccgtgtgcagaagcagaagcctggcccccgtgctgtgcggcatcgccgccggcctgatcctgctgaccttcctgatcgtgatcaccctgtacgtgatcagcaagcacagagccagaaactactacaccgacaccagccagaaggaggccttccacctggaggccagagaggtgtacagcgtggacccctacaaccccgccagctag

SEQ ID NO: 77356 - DNA, 3102 bp, Artificial Sequence
  Description of Artificial Sequence: Synthetic coding sequence
atgggcgccgccggcctgctgggcgtgttcctggccctggtggcccccggcgtgctgggcatcagctgcggcagccccccccccatcctgaacggcagaatcagctactacagcacccccatcgccgtgggcaccgtgatcagatacagctgcagcggcaccttcagactgatcggcgagaagagcctgctgtgcatcaccaaggacaaggtggacggcacctgggacaagcccgcccccaagtgcgagtacttcaacaagtacagcagctgccccgagcccatcgtgcccggcggctacaagatcagaggcagcaccccctacagacacggcgacagcgtgaccttcgcctgcaagaccaacttcagcatgaacggcaacaagagcgtgtggtgccaggccaacaacatgtggggccccaccagactgcccacctgcgtgagcgtgttccccctggagtgccccgccctgcccatgatccacaacggccaccacaccagcgagaacgtgggcagcatcgcccccggcctgagcgtgacctacagctgcgagagcggctacctgctggtgggcgagaagatcatcaactgcctgagcagcggcaagtggagcgccgtgccccccacctgcgaggaggccagatgcaagagcctgggcagattccccaacggcaaggtgaaggagccccccatcctgagagtgggcgtgaccgccaacttcttctgcgacgagggctacagactgcagggcccccccagcagcagatgcgtgatcgccggccagggcgtggcctggaccaagatgcccgtgtgcgaggagatcttctgccccagccccccccccatcctgaacggcagacacatcggcaacagcctggccaacgtgagctacggcagcatcgtgacctacacctgcgaccccgaccccgaggagggcgtgaacttcatcctgatcggcgagagcaccctgagatgcaccgtggacagccagaagaccggcacctggagcggccccgcccccagatgcgagctgagcaccagcgccgtgcagtgcccccacccccagatcctgagaggcagaatggtgagcggccagaaggacagatacacctacaacgacaccgtgatcttcgcctgcatgttcggcttcaccctgaagggcagcaagcagatcagatgcaacgcccagggcacctgggagcccagcgcccccgtgtgcgagaaggagtgccaggccccccccaacatcctgaacggccagaaggaggacagacacatggtgagattcgaccccggcaccagcatcaagtacagctgcaaccccggctacgtgctggtgggcgaggagagcatccagtgcaccagcgagggcgtgtggaccccccccgtgccccagtgcaaggtggccgcctgcgaggccaccggcagacagctgctgaccaagccccagcaccagttcgtgagacccgacgtgaacagcagctgcggcgagggctacaagctgagcggcagcgtgtaccaggagtgccagggcaccatcccctggttcatggagatcagactgtgcaaggagatcacctgcccccccccccccgtgatctacaacggcgcccacaccggcagcagcctggaggacttcccctacggcaccaccgtgacctacacctgcaaccccggccccgagagaggcgtggagttcagcctgatcggcgagagcaccatcagatgcaccagcaacgaccaggagagaggcacctggagcggccccgcccccctgtgcaagctgagcctgctggccgtgcagtgcagccacgtgcacatcgccaacggctacaagatcagcggcaaggaggccccctacttctacaacgacaccgtgaccttcaagtgctacagcggcttcaccctgaagggcagcagccagatcagatgcaaggccgacaacacctgggaccccgagatccccgtgtgcgagaaggagacctgccagcacgtgagacagagcctgcaggagctgcccgccggcagcagagtggagctggtgaacaccagctgccaggacggctaccagctgaccggccacgcctaccagatgtgccaggacgccgagaacggcatctggttcaagaagatccccctgtgcaaggtgatccactgccaccccccccccgtgatcgtgaacggcaagcacaccggcatgatggccgagaacttcctgtacggcaacgaggtgagctacgagtgcgaccagggcttctacctgctgggcgagaagaagctgcagtgcagaagcgacagcaagggccacggcagctggagcggccccagcccccagtgcctgagaagcccccccgtgaccagatgccccaaccccgaggtgaagcacggctacaagctgaacaagacccacagcgcctacagccacaacgacatcgtgtacgtggactgcaaccccggcttcatcatgaacggcagcagagtgatcagatgccacaccgacaacacctgggtgcccggcgtgcccacctgcatcaagaaggccttcatcggctgcccccccccccccaagacccccaacggcaaccacaccggcggcaacatcgccagattcagccccggcatgagcatcctgtacagctgcgaccagggctacctgctggtgggcgaggccctgctgctgtgcacccacgagggcacctggagccagcccgccccccactgcaaggaggtgaactgcagcagccccgccgacatggacggcatccagaagggcctggagcccagaaagatgtaccagtacggcgccgtggtgaccctggagtgcgaggacggctacatgctggagggcagcccccagagccagtgccagagcgaccaccagtggaacccccccctggccgtgtgcagaagcagaagcctggcccccgtgctgtgcggcatcgccgccggcctgatcctgctgaccttcctgatcgtgatcaccctgtacgtgatcagcaagcacagagccagaaactactacaccgacaccagccagaaggaggccttccacctggaggccagagaggtgtacagcgtggacccctacaaccccgccagctag

SEQ ID NO: 77357 - DNA, 2916 bp, Artificial Sequence
  Description of Artificial Sequence: Synthetic coding sequence
atgggcgccgccggcctgctgggcgtgttcctggccctggtggcccccggcgtgctgggcatcagctgcggcagccccccccccatcctgaacggcagaatcagctactacagcacccccatcgccgtgggcaccgtgatcagatacagctgcagcggcaccttcagactgatcggcgagaagagcctgctgtgcatcaccaaggacaaggtggacggcacctgggacaagcccgcccccaagtgcgagtacttcaacaagtacagcagctgccccgagcccatcgtgcccggcggctacaagatcagaggcagcaccccctacagacacggcgacagcgtgaccttcgcctgcaagaccaacttcagcatgaacggcaacaagagcgtgtggtgccaggccaacaacatgtggggccccaccagactgcccacctgcgtgagcgtgttccccctggagtgccccgccctgcccatgatccacaacggccaccacaccagcgagaacgtgggcagcatcgcccccggcctgagcgtgacctacagctgcgagagcggctacctgctggtgggcgagaagatcatcaactgcctgagcagcggcaagtggagcgccgtgccccccacctgcgaggaggccagatgcaagagcctgggcagattccccaacggcaaggtgaaggagccccccatcctgagagtgggcgtgaccgccaacttcttctgcgacgagggctacagactgcagggcccccccagcagcagatgcgtgatcgccggccagggcgtggcctggaccaagatgcccgtgtgcgaggagatcttctgccccagccccccccccatcctgaacggcagacacatcggcaacagcctggccaacgtgagctacggcagcatcgtgacctacacctgcgaccccgaccccgaggagggcgtgaacttcatcctgatcggcgagagcaccctgagatgcaccgtggacagccagaagaccggcacctggagcggccccgcccccagatgcgagctgagcaccagcgccgtgcagtgcccccacccccagatcctgagaggcagaatggtgagcggccagaaggacagatacacctacaacgacaccgtgatcttcgcctgcatgttcggcttcaccctgaagggcagcaagcagatcagatgcaacgcccagggcacctgggagcccagcgcccccgtgtgcgagaaggagtgccaggccccccccaacatcctgaacggccagaaggaggacagacacatggtgagattcgaccccggcaccagcatcaagtacagctgcaaccccggctacgtgctggtgggcgaggagagcatccagtgcaccagcgagggcgtgtggaccccccccgtgccccagtgcaaggtggccgcctgcgaggccaccggcagacagctgctgaccaagccccagcaccagttcgtgagacccgacgtgaacagcagctgcggcgagggctacaagctgagcggcagcgtgtaccaggagtgccagggcaccatcccctggttcatggagatcagactgtgcaaggagatcacctgcccccccccccccgtgatctacaacggcgcccacaccggcagcagcctggaggacttcccctacggcaccaccgtgacctacacctgcaaccccggccccgagagaggcgtggagttcagcctgatcggcgagagcaccatcagatgcaccagcaacgaccaggagagaggcacctggagcggccccgcccccctgtgcaagctgagcctgctggccgtgcagtgcagccacgtgcacatcgccaacggctacaagatcagcggcaaggaggccccctacttctacaacgacaccgtgaccttcaagtgctacagcggcttcaccctgaagggcagcagccagatcagatgcaaggccgacaacacctgggaccccgagatccccgtgtgcgagaaggagacctgccagcacgtgagacagagcctgcaggagctgcccgccggcagcagagtggagctggtgaacaccagctgccaggacggctaccagctgaccggccacgcctaccagatgtgccaggacgccgagaacggcatctggttcaagaagatccccctgtgcaaggtgatccactgccaccccccccccgtgatcgtgaacggcaagcacaccggcatgatggccgagaacttcctgtacggcaacgaggtgagctacgagtgcgaccagggcttctacctgctgggcgagaagaagctgcagtgcagaagcgacagcaagggccacggcagctggagcggccccagcccccagtgcctgagaagcccccccgtgaccagatgccccaaccccgaggtgaagcacggctacaagctgaacaagacccacagcgcctacagccacaacgacatcgtgtacgtggactgcaaccccggcttcatcatgaacggcagcagagtgatcagatgccacaccgacaacacctgggtgcccggcgtgcccacctgcatcaagaaggaggtgaactgcagcagccccgccgacatggacggcatccagaagggcctggagcccagaaagatgtaccagtacggcgccgtggtgaccctggagtgcgaggacggctacatgctggagggcagcccccagagccagtgccagagcgaccaccagtggaacccccccctggccgtgtgcagaagcagaagcctggcccccgtgctgtgcggcatcgccgccggcctgatcctgctgaccttcctgatcgtgatcaccctgtacgtgatcagcaagcacagagccagaaactactacaccgacaccagccagaaggaggccttccacctggaggccagagaggtgtacagcgtggacccctacaaccccgccagctag

SEQ ID NO: 77358 - DNA, 3021 bp, Artificial Sequence
  Description of Artificial Sequence: Synthetic coding sequence
atgggcgccgccggcctgctgggcgtgttcctggccctggtggcccccggcgtgctgggcatcagctgcggcagccccccccccatcctgaacggcagaatcagctactacagcacccccatcgccgtgggcaccgtgatcagatacagctgcagcggcaccttcagactgatcggcgagaagagcctgctgtgcatcaccaaggacaaggtggacggcacctgggacaagcccgcccccaagtgcgagtacttcaacaagtacagcagctgccccgagcccatcgtgcccggcggctacaagatcagaggcagcaccccctacagacacggcgacagcgtgaccttcgcctgcaagaccaacttcagcatgaacggcaacaagagcgtgtggtgccaggccaacaacatgtggggccccaccagactgcccacctgcgtgagcgtgttccccctggagtgccccgccctgcccatgatccacaacggccaccacaccagcgagaacgtgggcagcatcgcccccggcctgagcgtgacctacagctgcgagagcggctacctgctggtgggcgagaagatcatcaactgcctgagcagcggcaagtggagcgccgtgccccccacctgcgaggaggccagatgcaagagcctgggcagattccccaacggcaaggtgaaggagccccccatcctgagagtgggcgtgaccgccaacttcttctgcgacgagggctacagactgcagggcccccccagcagcagatgcgtgatcgccggccagggcgtggcctggaccaagatgcccgtgtgcgaggagatcttctgccccagccccccccccatcctgaacggcagacacatcggcaacagcctggccaacgtgagctacggcagcatcgtgacctacacctgcgaccccgaccccgaggagggcgtgaacttcatcctgatcggcgagagcaccctgagatgcaccgtggacagccagaagaccggcacctggagcggccccgcccccagatgcgagctgagcaccagcgccgtgcagtgcccccacccccagatcctgagaggcagaatggtgagcggccagaaggacagatacacctacaacgacaccgtgatcttcgcctgcatgttcggcttcaccctgaagggcagcaagcagatcagatgcaacgcccagggcacctgggagcccagcgcccccgtgtgcgagaaggagtgccaggccccccccaacatcctgaacggccagaaggaggacagacacatggtgagattcgaccccggcaccagcatcaagtacagctgcaaccccggctacgtgctggtgggcgaggagagcatccagtgcaccagcgagggcgtgtggaccccccccgtgccccagtgcaaggtggccgcctgcgaggccaccggcagacagctgctgaccaagccccagcaccagttcgtgagacccgacgtgaacagcagctgcggcgagggcaaccacctgcccaccaccccctgctacctgcagtggggcacccacagagagttcctgagaagattcagcatctggaaccacggccacctgcacatgcccggccccgagagaggcgtggagttcagcctgatcggcgagagcaccatcagatgcaccagcaacgaccaggagagaggcacctggagcggccccgcccccctgtgcaagctgagcctgctggccgtgcagtgcagccacgtgcacatcgccaacggctacaagatcagcggcaaggaggccccctacttctacaacgacaccgtgaccttcaagtgctacagcggcttcaccctgaagggcagcagccagatcagatgcaaggccgacaacacctgggaccccgagatccccgtgtgcgagaaggagacctgccagcacgtgagacagagcctgcaggagctgcccgccggcagcagagtggagctggtgaacaccagctgccaggacggctaccagctgaccggccacgcctaccagatgtgccaggacgccgagaacggcatctggttcaagaagatccccctgtgcaaggtgatccactgccaccccccccccgtgatcgtgaacggcaagcacaccggcatgatggccgagaacttcctgtacggcaacgaggtgagctacgagtgcgaccagggcttctacctgctgggcgagaagaagctgcagtgcagaagcgacagcaagggccacggcagctggagcggccccagcccccagtgcctgagaagcccccccgtgaccagatgccccaaccccgaggtgaagcacggctacaagctgaacaagacccacagcgcctacagccacaacgacatcgtgtacgtggactgcaaccccggcttcatcatgaacggcagcagagtgatcagatgccacaccgacaacacctgggtgcccggcgtgcccacctgcatcaagaaggccttcatcggctgcccccccccccccaagacccccaacggcaaccacaccggcggcaacatcgccagattcagccccggcatgagcatcctgtacagctgcgaccagggctacctgctggtgggcgaggccctgctgctgtgcacccacgagggcacctggagccagcccgccccccactgcaaggaggtgaactgcagcagccccgccgacatggacggcatccagaagggcctggagcccagaaagatgtaccagtacggcgccgtggtgaccctggagtgcgaggacggctacatgctggagggcagcccccagagccagtgccagagcgaccaccagtggaacccccccctggccgtgtgcagaagcagaagcctggcccccgtgctgtgcggcatcgccgccggcctgatcctgctgaccttcctgatcgtgatcaccctgtacgtgatcagcaagcacagagccagaaactactacaccgacaccagccagaaggaggccttccacctggaggccagagaggtgtacagcgtggacccctacaaccccgccagctag

SEQ ID NO: 77359 - DNA, 2226 bp, Artificial Sequence
  Description of Artificial Sequence: Synthetic coding sequence
atggccgccgccgagggccccgtgggcgacggcgagctgtggcagacctggctgcccaaccacgtggtgttcctgagactgagagagggcctgaagaaccagagccccaccgaggccgagaagcccgccagcagcagcctgcccagcagcccccccccccagctgctgaccagaaacgtggtgttcggcctgggcggcgagctgttcctgtgggacggcgaggacagcagcttcctggtggtgagactgagaggccccagcggcggcggcgaggagcccgccctgagccagtaccagagactgctgtgcatcaacccccccctgttcgagatctaccaggtgctgctgagccccacccagcaccacgtggccctgatcggcatcaagggcctgatggtgctggagctgcccaagagatggggcaagaacagcgagttcgagggcggcaagagcaccgtgaactgcagcaccacccccgtggccgagagattcttcaccagcagcaccagcctgaccctgaagcacgccgcctggtaccccagcgagatcctggacccccacgtggtgctgctgaccagcgacaacgtgatcagaatctacagcctgagagagccccagacccccaccaacgtgatcatcctgagcgaggccgaggaggagagcctggtgctgaacaagggcagagcctacaccgccagcctgggcgagaccgccgtggccttcgacttcggccccctggccgccgtgcccaagaccctgttcggccagaacggcaaggacgaggtggtggcctaccccctgtacatcctgtacgagaacggcgagaccttcctgacctacatcagcctgctgcacagccccggcaacatcggcaagctgctgggccccctgcccatgcaccccgccgccgaggacaactacggctacgacgcctgcgccgtgctgtgcctgccctgcgtgcccaacatcctggtgatcgccaccgagagcggcatgctgtaccactgcgtggtgctggagggcgaggaggaggacgaccacaccagcgagaagagctgggacagcagaatcgacctgatccccagcctgtacgtgttcgagtgcgtggagctggagctggccctgaagctggccagcggcgaggacgaccccttcgacagcgacttcagctgccccgtgaagctgcacagagaccccaagtgccccagcagataccactgcacccacgaggccggcgtgcacagcgtgggcctgacctggatccacaagctgcacaagttcctgggcagcgacgaggaggacaaggacagcctgcaggagctgagcaccgagcagaagtgcttcgtggagcacatcctgtgcaccaagcccctgccctgcagacagcccgcccccatcagaggcttctggatcgtgcccgacatcctgggccccaccatgatctgcatcaccagcacctacgagtgcctgatctggcccctgctgagcaccgtgcaccccgccagcccccccctgctgtgcaccagagaggacgtggaggtggccgagagccccctgagagtgctggccgagacccccgacagcttcgagaagcacatcagaagcatcctgcagagaagcgtggccaaccccgccttcctgaaggccagcgagaaggacatcgcccccccccccgaggagtgcctgcagctgctgagcagagccacccaggtgttcagagagcagtacatcctgaagcaggacctggccaaggaggagatccagagaagagtgaagctgctgtgcgaccagaagaagaagcagctggaggacctgagctactgcagagaggagagaaagagcctgagagagatggccgagagactggccgacaagtacgaggaggccaaggagaagcaggaggacatcatgaacagaatgaagaagctgctgcacagcttccacagcgagctgcccgtgctgagcgacagcgagagagacatgaagaaggagctgcagctgatccccgaccagctgagacacctgggcaacgccatcaagcaggtgaccatgaagaaggactaccagcagcagaagatggagaaggtgctgagcctgcccaagcccaccatcatcctgagcgcctaccagagaaagtgcatccagagcatcctgaaggaggagggcgagcacatcagagagatggtgaagcagatcaacgacatcagaaaccacgtgaacttctag

SEQ ID NO: 77360 - DNA, 762 bp, Artificial Sequence
  Description of Artificial Sequence: Synthetic coding sequence
atgatgatgaagatcccctggggcagcatccccgtgctgatgctgctgctgctgctgggcctgatcgacatcagccaggcccagctgagctgcaccggcccccccgccatccccggcatccccggcatccccggcacccccggccccgacggccagcccggcacccccggcatcaagggcgagaagggcctgcccggcctggccggcgaccacggcgagttcggcgagaagggcgaccccggcatccccggcaaccccggcaaggtgggccccaagggccccatgggccccaagggcggccccggcgcccccggcgcccccggccccaagggcgagagcggcgactacaaggccacccagaagatcgccttcagcgccaccagaaccatcaacgtgcccctgagaagagaccagaccatcagattcgaccacgtgatcaccaacatgaacaacaactacgagcccagaagcggcaagttcacctgcaaggtgcccggcctgtactacttcacctaccacgccagcagcagaggcaacctgtgcgtgaacctgatgagaggcagagagagagcccagaaggtggtgaccttctgcgactacgcctacaacaccttccaggtgaccaccggcggcatggtgctgaagctggagcagggcgagaacgtgttcctgcaggccaccgacaagaacagcctgctgggcatggagggcgccaacagcatcttcagcggcttcctgctgttccccgacatggaggcctag

SEQ ID NO: 77361 - DNA, 690 bp, Artificial Sequence
  Description of Artificial Sequence: Synthetic coding sequence
atgaagatcccctggggcagcatccccgtgctgatgctgctgctgctgctgggcctgatcgacatcagccaggcccagctgagctgcaccggcccccccgccatccccggcatccccggcatccccggcacccccggccccgacggccagcccggcacccccggcatcaagggcgagaagggcctgcccggcctggccggcgaccacggcgagttcggcgagaagggcgaccccggcatccccggcaaccccggcaaggtgggccccaagggccccatgggccccaagggcggccccggcgcccccggcgcccccggccccaagggcgagagcggcgactacaaggccacccagaagatcgccttcagcgccaccagaaccatcaacgtgcccctgagaagagaccagaccatcagattcgaccacgtgatcaccaacatgaacaacaactacgagcccagaagcggcaagttcacctgcaaggtgcccggcctgtactacttcacctaccacgccagcagcagaggcaacctgtgcgtgaacctgatgagaggcagagagagagcccagaaggtggtgaccttctgcgactacgcctacaacaccttccaggtgaccaccggcggcatggtgctgaagctggagcagggcgagaacgtgttcctgcaggccaccgacaagaacagctag

SEQ ID NO: 77362 - DNA, 756 bp, Artificial Sequence
  Description of Artificial Sequence: Synthetic coding sequence
atgaagatcccctggggcagcatccccgtgctgatgctgctgctgctgctgggcctgatcgacatcagccaggcccagctgagctgcaccggcccccccgccatccccggcatccccggcatccccggcacccccggccccgacggccagcccggcacccccggcatcaagggcgagaagggcctgcccggcctggccggcgaccacggcgagttcggcgagaagggcgaccccggcatccccggcaaccccggcaaggtgggccccaagggccccatgggccccaagggcggccccggcgcccccggcgcccccggccccaagggcgagagcggcgactacaaggccacccagaagatcgccttcagcgccaccagaaccatcaacgtgcccctgagaagagaccagaccatcagattcgaccacgtgatcaccaacatgaacaacaactacgagcccagaagcggcaagttcacctgcaaggtgcccggcctgtactacttcacctaccacgccagcagcagaggcaacctgtgcgtgaacctgatgagaggcagagagagagcccagaaggtggtgaccttctgcgactacgcctacaacaccttccaggtgaccaccggcggcatggtgctgaagctggagcagggcgagaacgtgttcctgcaggccaccgacaagaacagcctgctgggcatggagggcgccaacagcatcttcagcggcttcctgctgttccccgacatggaggcctag

SEQ ID NO: 77363 - DNA, 462 bp, Artificial Sequence
  Description of Artificial Sequence: Synthetic coding sequence
atgaagatcccctggggcagcatccccgtgctgatgctgctgctgctgctgggcctgatcgacatcagccaggcccagctgagctgcaccggcccccccgccatccccggcatccccggcatccccggcacccccggccccgacggccagcccggcacccccggcatcaagggcgagaagggcctgcccggcctggccggcgaccacggcgagttcggcgagaagggcgaccccggcatccccggcaaccccggcaaggtgggccccaagggccccatgggccccaagggcggccccggcgcccccggcgcccccggccccaagggcgagagcggcgactacaaggccacccagaagatcgccttcagcgccaccagaaccatcaacgtgcccctgagaagagaccagaccatcagattcgaccacgtgatcaccaacatgaacaacaactacgagccctag

SEQ ID NO: 77364 - DNA, 738 bp, Artificial Sequence
  Description of Artificial Sequence: Synthetic coding sequence
atggacgtgggccccagcagcctgccccacctgggcctgaagctgctgctgctgctgctgctgctgcccctgagaggccaggccaacaccggctgctacggcatccccggcatgcccggcctgcccggcgcccccggcaaggacggctacgacggcctgcccggccccaagggcgagcccggcatccccgccatccccggcatcagaggccccaagggccagaagggcgagcccggcctgcccggccaccccggcaagaacggccccatgggcccccccggcatgcccggcgtgcccggccccatgggcatccccggcgagcccggcgaggagggcagatacaagcagaagttccagagcgtgttcaccgtgaccagacagacccaccagccccccgcccccaacagcctgatcagattcaacgccgtgctgaccaacccccagggcgactacgacaccagcaccggcaagttcacctgcaaggtgcccggcctgtactacttcgtgtaccacgccagccacaccgccaacctgtgcgtgctgctgtacagaagcggcgtgaaggtggtgaccttctgcggccacaccagcaagaccaaccaggtgaacagcggcggcgtgctgctgagactgcaggtgggcgaggaggtgtggctggccgtgaacgactactacgacatggtgggcatccagggcagcgacagcgtgttcagcggcttcctgctgttccccgactag

SEQ ID NO: 77365 - DNA, 738 bp, Artificial Sequence; identical to SEQ ID NO: 77364
  Description of Artificial Sequence: Synthetic coding sequence

SEQ ID NO: 77366 - DNA, 738 bp, Artificial Sequence; identical to SEQ ID NO: 77364
  Description of Artificial Sequence: Synthetic coding sequence

SEQ ID NO: 77367 - DNA, 777 bp, Artificial Sequence
  Description of Artificial Sequence: Synthetic coding sequence
atgctgctggtgctggtggtgctgatccccgtgctggtgagcagcggcggccccgagggccactacgagatgctgggcacctgcagaatggtgtgcgacccctaccccgccagaggccccggcgccggcgccagaaccgacggcggcgacgccctgagcgagcagagcggcgcccccccccccagcaccctggtgcagggcccccagggcaagcccggcagaaccggcaagcccggcccccccggcccccccggcgaccccggcccccccggccccgtgggcccccccggcgagaagggcgagcccggcaagcccggcccccccggcctgcccggcgccggcggcagcggcgccatcagcaccgccacctacaccaccgtgcccagagtggccttctacgccggcctgaagaacccccacgagggctacgaggtgctgaagttcgacgacgtggtgaccaacctgggcaacaactacgacgccgccagcggcaagttcacctgcaacatccccggcacctacttcttcacctaccacgtgctgatgagaggcggcgacggcaccagcatgtgggccgacctgtgcaagaacggccaggtgagagccagcgccatcgcccaggacgccgaccagaactacgactacgccagcaacagcgtgatcctgcacctggacgccggcgacgaggtgttcatcaagctggacggcggcaaggcccacggcggcaacagcaacaagtacagcaccttcagcggcttcatcatctacagcgactag

SEQ ID NO: 77368 - DNA, 864 bp, Artificial Sequence
  Description of Artificial Sequence: Synthetic coding sequence
atggccctgggcctgctgatcgccgtgcccctgctgctgcaggccgcccccagaggcgccgcccactacgagatgatgggcacctgcagaatgatctgcgacccctacaccgccgcccccggcggcgagccccccggcgccaaggcccagccccccggccccagcaccgccgccctggaggtgatgcaggacctgagcgccaacccccccccccccttcatccagggccccaagggcgaccccggcagacccggcaagcccggccccagaggcccccccggcgagcccggcccccccggccccagaggcccccccggcgagaagggcgacagcggcagacccggcctgcccggcctgcagctgaccgccggcaccgccagcggcgtgggcgtggtgggcggcggcgccggcgtgggcggcgacagcgagggcgaggtgaccagcgccctgagcgccaccttcagcggccccaagatcgccttctacgtgggcctgaagagcccccacgagggctacgaggtgctgaagttcgacgacgtggtgaccaacctgggcaaccactacgaccccaccaccggcaagttcagctgccaggtgagaggcatctacttcttcacctaccacatcctgatgagaggcggcgacggcaccagcatgtgggccgacctgtgcaagaacggccaggtgagagccagcgccatcgcccaggacgccgaccagaactacgactacgccagcaacagcgtggtgctgcacctggacagcggcgacgaggtgtacgtgaagctggacggcggcaaggcccacggcggcaacaacaacaagtacagcaccttcagcggcttcctgctgtaccccgactag

SEQ ID NO: 77369 - DNA, 2007 bp, Artificial Sequence
  Description of Artificial Sequence: Synthetic coding sequence
atgagcgtgagattcagagtgggcagagaggagaacgcccagtggtggctgctgtacctgctggtgcccgccctgttctgcagagccggcggcagcatccccatcccccagaagctgttcggcgaggtgaccagccccctgttccccaagccctaccccaacaacttcgagaccaccaccgtgatcaccgtgcccaccggctacagagtgaagctggtgttccagcagttcgacctggagcccagcgagggctgcttctacgactacgtgaagatcagcgccgacaagaagagcctgggcagattctgcggccagctgggcagccccctgggcaacccccccggcaagaaggagttcatgagccagggcaacaagatgctgctgaccttccacaccgacttcagcaacgaggagaacggcaccatcatgttctacaagggcttcctggcctactaccaggccgtggacctggacgagtgcgccagcagaagcaagagcggcgaggaggacccccagccccagtgccagcacctgtgccacaactacgtgggcggctacttctgcagctgcagacccggctacgagctgcaggaggacagacacagctgccaggccgagtgcagcagcgagctgtacaccgaggccagcggctacatcagcagcctggagtaccccagaagctacccccccgacctgagatgcaactacagcatcagagtggagagaggcctgaccctgcacctgaagttcctggagcccttcgacatcgacgaccaccagcaggtgcactgcccctacgaccagctgcagatctacgccaacggcaagaacatcggcgagttctgcggcaagcagagaccccccgacctggacaccagcagcaacgccgtggacctgctgttcttcaccgacgagagcggcgacagcagaggctggaagctgagatacaccaccgagatcatcaagtgcccccagcccaagaccctggacgagttcaccatcatccagaacctgcagccccagtaccagttcagagactacttcatcgccacctgcaagcagggctaccagctgatcgagggcatccaggtggtggccggcgtggtggacgtgagcgccggcagagtgagctggagcaccagcagccagacctgctgcaccagagtgtacacctgcaccgcccagggcatctggaagaacgagcagaagggcgagaagatccccagatgcctgcccgtgtgcggcaagcccgtgaaccccgtggagcagagacagagaatcatcggcggccagaaggccaagatgggcaacttcccctggcaggtgttcaccaacatccacggcagaggcggcggcgccctgctgggcgacagatggatcctgaccgccgcccacaccctgtaccccaaggagcacgaggcccagagcaacgccagcctggacgtgttcctgggccacaccaacgtggaggagctgatgaagctgggcaaccaccccatcagaagagtgagcgtgcaccccgactacagacaggacgagagctacaacttcgagggcgacatcgccctgctggagctggagaacagcgtgaccctgggccccaacctgctgcccatctgcctgcccgacaacgacaccttctacgacctgggcctgatgggctacgtgagcggcttcggcgtgatggaggagaagatcgcccacgacctgagattcgtgagactgcccgtggccaacccccaggcctgcgagaactggctgagaggcaagaacagaatggacgtgttcagccagaacatgttctgcgccggccaccccagcctgaagcaggacgcctgccagggcgacagcggcggcgtgttcgccgtgagagaccccaacaccgacagatgggtggccaccggcatcgtgagctggggcatcggctgcagcagaggctacggcttctacaccaaggtgctgaactacgtggactggatcaagaaggagatggaggaggaggactag

SEQ ID NO: 77370 - DNA, 1131 bp, Artificial Sequence
  Description of Artificial Sequence: Synthetic coding sequence
atgtggctgctgtacctgctggtgcccgccctgttctgcagagccggcggcagcatccccatcccccagaagctgttcggcgaggtgaccagccccctgttccccaagccctaccccaacaacttcgagaccaccaccgtgatcaccgtgcccaccggctacagagtgaagctggtgttccagcagttcgacctggagcccagcgagggctgcttctacgactacgtgaagatcagcgccgacaagaagagcctgggcagattctgcggccagctgggcagccccctgggcaacccccccggcaagaaggagttcatgagccagggcaacaagatgctgctgaccttccacaccgacttcagcaacgaggagaacggcaccatcatgttctacaagggcttcctggcctactaccaggccgtggacctggacgagtgcgccagcagaagcaagagcggcgaggaggacccccagccccagtgccagcacctgtgccacaactacgtgggcggctacttctgcagctgcagacccggctacgagctgcaggaggacagacacagctgccaggccgagtgcagcagcgagctgtacaccgaggccagcggctacatcagcagcctggagtaccccagaagctacccccccgacctgagatgcaactacagcatcagagtggagagaggcctgaccctgcacctgaagttcctggagcccttcgacatcgacgaccaccagcaggtgcactgcccctacgaccagctgcagatctacgccaacggcaagaacatcggcgagttctgcggcaagcagagaccccccgacctggacaccagcagcaacgccgtggacctgctgttcttcaccgacgagagcggcgacagcagaggctggaagctgagatacaccaccgagatcatcaagtgcccccagcccaagaccctggacgagttcaccatcatccagaacctgcagccccagtaccagttcagagactacttcatcgccacctgcaagcagggctaccagctgatcgagggctgcacccccgcccagcacagagccttcggcagaatgaacagaagagagagaagattcctgggcgcctgccagtgcgtgggcagcccctag

SEQ ID NO: 77371 - DNA, 1962 bp, Artificial Sequence
  Description of Artificial Sequence: Synthetic coding sequence
tggctgctgtacctgctggtgcccgccctgttctgcagagccggcggcagcatccccatcccccagaagctgttcggcgaggtgaccagccccctgttccccaagccctaccccaacaacttcgagaccaccaccgtgatcaccgtgcccaccggctacagagtgaagctggtgttccagcagttcgacctggagcccagcgagggctgcttctacgactacgtgaagatcagcgccgacaagaagagcctgggcagattctgcggccagctgggcagccccctgggcaacccccccggcaagaaggagttcatgagccagggcaacaagatgctgctgaccttccacaccgacttcagcaacgaggagaacggcaccatcatgttctacaagggcttcctggcctactaccaggccgtggacctggacgagtgcgccagcagaagcaagagcggcgaggaggacccccagccccagtgccagcacctgtgccacaactacgtgggcggctacttctgcagctgcagacccggctacgagctgcaggaggacagacacagctgccaggccgagtgcagcagcgagctgtacaccgaggccagcggctacatcagcagcctggagtaccccagaagctacccccccgacctgagatgcaactacagcatcagagtggagagaggcctgaccctgcacctgaagttcctggagcccttcgacatcgacgaccaccagcaggtgcactgcccctacgaccagctgcagatctacgccaacggcaagaacatcggcgagttctgcggcaagcagagaccccccgacctggacaccagcagcaacgccgtggacctgctgttcttcaccgacgagagcggcgacagcagaggctggaagctgagatacaccaccgagatcatcaagtgcccccagcccaagaccctggacgagttcaccatcatccagaacctgcagccccagtaccagttcagagactacttcatcgccacctgcaagcagggctaccagctgatcgagggcatccaggtggtggccggcgtggtggacgtgagcgccggcagagtgagctggagcaccagcagccagacctgctgcaccagagtgtacacctgcaccgcccagggcatctggaagaacgagcagaagggcgagaagatccccagatgcctgcccgtgtgcggcaagcccgtgaaccccgtggagcagagacagagaatcatcggcggccagaaggccaagatgggcaacttcccctggcaggtgttcaccaacatccacggcagaggcggcggcgccctgctgggcgacagatggatcctgaccgccgcccacaccctgtaccccaaggagcacgaggcccagagcaacgccagcctggacgtgttcctgggccacaccaacgtggaggagctgatgaagctgggcaaccaccccatcagaagagtgagcgtgcaccccgactacagacaggacgagagctacaacttcgagggcgacatcgccctgctggagctggagaacagcgtgaccctgggccccaacctgctgcccatctgcctgcccgacaacgacaccttctacgacctgggcctgatgggctacgtgagcggcttcggcgtgatggaggagaagatcgcccacgacctgagattcgtgagactgcccgtggccaacccccaggcctgcgagaactggctgagaggcaagaacagaatggacgtgttcagccagaacatgttctgcgccggccaccccagcctgaagcaggacgcctgccagggcgacagcggcggcgtgttcgccgtgagagaccccaacaccgacagatgggtggccaccggcatcgtgagctggggcatcggctgcagcagaggctacggcttctacaccaaggtgctgaactacgtggactggatcaagaaggagatggaggaggaggactag

SEQ ID NO: 77372 - DNA, 1464 bp, Artificial Sequence
  Description of Artificial Sequence: Synthetic coding sequence
atgcccggccccagagtgtggggcaagtacctgtggagaagcccccacagcaagggctgccccggcgccatgtggtggctgctgctgtggggcgtgctgcaggcctgccccaccagaggcagcgtgctgctggcccaggagctgccccagcagctgaccagccccggctaccccgagccctacggcaagggccaggagagcagcaccgacatcaaggcccccgagggcttcgccgtgagactggtgttccaggacttcgacctggagcccagccaggactgcgccggcgacagcgtgaccatcagcttcgtgggcagcgaccccagccagttctgcggccagcagggcagccccctgggcagaccccccggccagagagagttcgtgagcagcggcagaagcctgagactgaccttcagaacccagcccagcagcgagaacaagaccgcccacctgcacaagggcttcctggccctgtaccagaccgtggccgtgaactacagccagcccatcagcgaggccagcagaggcagcgaggccatcaacgcccccggcgacaaccccgccaaggtgcagaaccactgccaggagccctactaccaggccgccgccgccggcgccctgacctgcgccacccccggcacctggaaggacagacaggacggcgaggaggtgctgcagtgcatgcccgtgtgcggcagacccgtgacccccatcgcccagaaccagaccaccctgggcagcagcagagccaagctgggcaacttcccctggcaggccttcaccagcatccacggcagaggcggcggcgccctgctgggcgacagatggatcctgaccgccgcccacaccatctaccccaaggacagcgtgagcctgagaaagaaccagagcgtgaacgtgttcctgggccacaccgccatcgacgagatgctgaagctgggcaaccaccccgtgcacagagtggtggtgcaccccgactacagacagaacgagagccacaacttcagcggcgacatcgccctgctggagctgcagcacagcatccccctgggccccaacgtgctgcccgtgtgcctgcccgacaacgagaccctgtacagaagcggcctgctgggctacgtgagcggcttcggcatggagatgggctggctgaccaccgagctgaagtacagcagactgcccgtggcccccagagaggcctgcaacgcctggctgcagaagagacagagacccgaggtgttcagcgacaacatgttctgcgtgggcgacgagacccagagacacagcgtgtgccagggcgacagcggcagcgtgtacgtggtgtgggacaaccacgcccaccactgggtggccaccggcatcgtgagctggggcatcggctgcggcgagggctacgacttctacaccaaggtgctgagctacgtggactggatcaagggcgtgatgaacggcaagaactag

SEQ ID NO: 77373 - DNA, 1317 bp, Artificial Sequence
  Description of Artificial Sequence: Synthetic coding sequence
atgcccggccccagagtgtggggcaagtacctgtggagaagcccccacagcaagggctgccccggcgccatgtggtggctgctgctgtggggcgtgctgcaggcctgccccaccagaggcagcgtgctgctggcccaggagctgccccagcagctgaccagccccggctaccccgagccctacggcaagggccaggagagcagcaccgacatcaaggcccccgagggcttcgccgtgagactggtgttccaggacttcgacctggagcccagccaggactgcgccggcgacagcgtgaccatcagcttcgtgggcagcgaccccagccagttctgcggccagcagggcagccccctgggcagaccccccggccagagagagttcgtgagcagcggcagaagcctgagactgaccttcagaacccagcccagcagcgagaacaagaccgcccacctgcacaagggcttcctggccctgtaccagaccgtggccgtgaactacagccagcccatcagcgaggccagcagaggcagcgaggccatcaacgcccccggcgacaaccccgccaaggtgcagaaccactgccaggagccctactaccaggccgccgccgccggcgccctgacctgcgccacccccggcacctggaaggacagacaggacggcgaggaggtgctgcagtgcatgcccgtgtgcggcagacccgtgacccccatcgcccagaaccagaccaccctgggcagcagcagagccaagctgggcaacttcccctggcaggccttcaccagcatccacggcagaggcggcggcgccctgctgggcgacagatggatcctgaccgccgcccacaccatctaccccaaggacagcgtgagcctgagaaagaaccagagcgtgaacgtgttcctgggccacaccgccatcgacgagatgctgaagctgggcaaccaccccgtgcacagagtggtggtgcaccccgactacagacagaacgagagccacaacttcagcggcgacatcgccctgctggagctgcagcacagcatccccctgggccccaacgtgctgcccgtgtgcctgcccgacaacgagaccctgtacagaagcggcctgctgggctacgtgagcggcttcggcatggagatgggctggctgaccaccgagctgaagtacagcagactgcccgtggcccccagagaggcctgcaacgcctggctgcagaagagacagagacccgaggtgttcagcgacaacatgttctgcgtgggcgacgaggccggcgagagcctggagcccggcagaagaagactgcagtag

SEQ ID NO: 77374 - DNA, 2067 bp, Artificial Sequence
  Description of Artificial Sequence: Synthetic coding sequence
atgtggtgcatcgtgctgttcagcctgctggcctgggtgtacgccgagcccaccatgtacggcgagatcctgagccccaactacccccaggcctaccccagcgaggtggagaagagctgggacatcgaggtgcccgagggctacggcatccacctgtacttcacccacctggacatcgagctgagcgagaactgcgcctacgacagcgtgcagatcatcagcggcgacaccgaggagggcagactgtgcggccagagaagcagcaacaacccccacagccccatcgtggaggagttccaggtgccctacaacaagctgcaggtgatcttcaagagcgacttcagcaacgaggagagattcaccggcttcgccgcctactacgtggccaccgacatcaacgagtgcaccgacttcgtggacgtgccctgcagccacttctgcaacaacttcatcggcggctacttctgcagctgcccccccgagtacttcctgcacgacgacatgaagaactgcggcgtgaactgcagcggcgacgtgttcaccgccctgatcggcgagatcgccagccccaactaccccaagccctaccccgagaacagcagatgcgagtaccagatcagactggagaagggcttccaggtggtggtgaccctgagaagagaggacttcgacgtggaggccgccgacagcgccggcaactgcctggacagcctggtgttcgtggccggcgacagacagttcggcccctactgcggccacggcttccccggccccctgaacatcgagaccaagagcaacgccctggacatcatcttccagaccgacctgaccggccagaagaagggctggaagctgagataccacggcgaccccatgccctgccccaaggaggacacccccaacagcgtgtgggagcccgccaaggccaagtacgtgttcagagacgtggtgcagatcacctgcctggacggcttcgaggtggtggagggcagagtgggcgccaccagcttctacagcacctgccagagcaacggcaagtggagcaacagcaagctgaagtgccagcccgtggactgcggcatccccgagagcatcgagaacggcaaggtggaggaccccgagagcaccctgttcggcagcgtgatcagatacacctgcgaggagccctactactacatggagaacggcggcggcggcgagtaccactgcgccggcaacggcagctgggtgaacgaggtgctgggccccgagctgcccaagtgcgtgcccgtgtgcggcgtgcccagagagcccttcgaggagaagcagagaatcatcggcggcagcgacgccgacatcaagaacttcccctggcaggtgttcttcgacaacccctgggccggcggcgccctgatcaacgagtactgggtgctgaccgccgcccacgtggtggagggcaacagagagcccaccatgtacgtgggcagcaccagcgtgcagaccagcagactggccaagagcaagatgctgacccccgagcacgtgttcatccaccccggctggaagctgctggaggtgcccgagggcagaaccaacttcgacaacgacatcgccctggtgagactgaaggaccccgtgaagatgggccccaccgtgagccccatctgcctgcccggcaccagcagcgactacaacctgatggacggcgacctgggcctgatcagcggctggggcagaaccgagaagagagacagagccgtgagactgaaggccgccagactgcccgtggcccccctgagaaagtgcaaggaggtgaaggtggagaagcccaccgccgacgccgaggcctacgtgttcacccccaacatgatctgcgccggcggcgagaagggcatggacagctgcaagggcgacagcggcggcgccttcgccgtgcaggaccccaacgacaagaccaagttctacgccgccggcctggtgagctggggcccccagtgcggcacctacggcctgtacaccagagtgaagaactacgtggactggatcatgaagaccatgcaggagaacagcacccccagagaggactag

SEQ ID NO: 77375 - DNA, 2067 bp, Artificial Sequence; identical to SEQ ID NO: 77374
  Description of Artificial Sequence: Synthetic coding sequence

SEQ ID NO: 77376 - DNA, 2049 bp, Artificial Sequence
  Description of Artificial Sequence: Synthetic coding sequence
atgtacggcgagatcctgagccccaactacccccaggcctaccccagcgaggtggagaagagctgggacatcgaggtgcccgagggctacggcatccacctgtacttcacccacctggacatcgagctgagcgagaactgcgcctacgacagcgtgcagatcatcagcggcgacaccgaggagggcagactgtgcggccagagaagcagcaacaacccccacagccccatcgtggaggagttccaggtgccctacaacaagctgcaggtgatcttcaagagcgacttcagcaacgaggagagattcaccggcttcgccgcctactacgtggccaccgacaaggacgagtgcagcggcagagcccagctgtggaaccacatgagcgacgtgccctgcagccacttctgcaacaacttcatcggcggctacttctgcagctgcccccccgagtacttcctgcacgacgacatgaagaactgcggcgtgaactgcagcggcgacgtgttcaccgccctgatcggcgagatcgccagccccaactaccccaagccctaccccgagaacagcagatgcgagtaccagatcagactggagaagggcttccaggtgcacctgagcctgctgctgaagctggagtgcagcggcgccatcaccgcccactgcagcctggacctgctgggcagcatcgccggcgacagacagttcggcccctactgcggccacggcttccccggccccctgaacatcgagaccaagagcaacgccctggacatcatcttccagaccgacctgaccggccagaagaagggctggaagctgagataccacggcgaccccatgccctgccccaaggaggacacccccaacagcgtgtgggagcccgccaaggccaagtacgtgttcagagacgtggtgcagatcacctgcctggacggcttcgaggtggtggagggcagagtgggcgccaccagcttctacagcacctgccagagcaacggcaagtggagcaacagcaagctgaagtgccagcccgtggactgcggcatccccgagagcatcgagaacggcaaggtggaggaccccgagagcaccctgttcggcagcgtgatcagatacacctgcgaggagccctactactacatggagaacggcggcggcggcgaggagagagagagaggcgagtaccactgcgccggcaacggcagctgggtgaacgaggtgctgggccccgagctgcccaagtgcgtgcccgtgtgcggcgtgcccagagagcccttcgaggagaagcagagaatcatcggcggcagcgacgccgacatcaagaacttcccctggcaggtgttcttcgacaacccctgggccggcggcgccctgatcaacgagtactgggtgctgaccgccgcccacgtggtggagggcaacagagagcccaccatgtacgtgggcagcaccagcgtgcagaccagcagactggccaagagcaagatgctgacccccgagcacgtgttcatccaccccggctggaagctgctggaggtgcccgagggcagaaccaacttcgacaacgacatcgccctggtgagactgaaggaccccgtgaagatgggccccaccgtgagccccatctgcctgcccggcaccagcagcgactacaacctgatggacggcgacctgggcctgatcagcggctggggcagaaccgagaagagagacagagccgtgagactgaaggccgccagactgcccgtggcccccctgagaaagtgcaaggaggtgaaggtggagaagcccaccgccgacgccgaggcctacgtgttcacccccaacatgatctgcgccggcggcgagaagggcatggacagctgcaagggcgacagcggcggcgccttcgccgtgcaggaccccaacgacaagaccaagttctacgccgccggcctggtgagctggggcccccagtgcggcacctacggcctgtacaccagagtgaagaactacgtggactggatcatgaagaccatgcaggagaacagcacccccagagaggactag

SEQ ID NO: 77377 - DNA, 507 bp, Artificial Sequence
  Description of Artificial Sequence: Synthetic coding sequence
atgtggtgcatcgtgctgttcagcctgctggcctgggtgtacgccgagcccaccatgtacggcgagatcctgagccccaactacccccaggcctaccccagcgaggtggagaagagctgggacatcgaggtgcccgagggctacggcatccacctgtacttcacccacctggacatcgagctgagcgagaactgcgcctacgacagcgtgcagatcatcagcggcgacaccgaggagggcagactgtgcggccagagaagcagcaacaacccccacagccccatcgtggaggagttccaggtgccctacaacaagctgcaggtgatcttcaagagcgacttcagcaacgaggagagattcaccggcttcgccgcctactacgtggccaccgacatcaacgagtgcaccgacttcgtggacgtgccctgcagccacttctgcaacaacttcatcggcggctacttctgcagctgcccccccgagtacttcctgcacgacgacatgtag

SEQ ID NO: 77378 - DNA, 2067 bp, Artificial Sequence; identical to SEQ ID NO: 77374
  Description of Artificial Sequence: Synthetic coding sequence

SEQ ID NO: 77379 - DNA, 312 bp, Artificial Sequence
  Description of Artificial Sequence: Synthetic coding sequence
atgtggtgcatcgtgctgttcagcctgctggcctgggtgtacgccgagcccaccatgtacggcgagatcctgagccccaactacccccaggcctaccccagcgaggtggagaagagctgggacatcgaggtgcccgagggctacggcatccacctgtacttcacccacctggacatcgagctgagcgagaactgcgcctacgacagcgtgcagatcatcagcggcgacaccgaggagggcagactgtgcggccagagaagcagcaacaacccccacagccccatcgtggaggagttccaggtgccctactag

SEQ ID NO: 77380 - DNA, 306 bp, Artificial Sequence
  Description of Artificial Sequence: Synthetic coding sequence
atgtggtgcatcgtgctgttcagcctgctggcctgggtgtacgccgagcccaccatgtacggcgagatcctgagccccaactacccccaggcctaccccagcgaggtggagaagagctgggacatcgaggtgcccgagggctacggcatccacctgtacttcacccacctggacatcgagctgagcgagaactgcgcctacgacagcgtgcagatcatcagcggcgacaccgaggagggcagactgtgcggccagagaagcagcaacaacccccacagccccatcgtggaggagttccaggtgtag

SEQ ID NO: 77381 - DNA, 2259 bp, Artificial Sequence
  Description of Artificial Sequence: Synthetic coding sequence
atgggccccctgatggtgctgttctgcctgctgttcctgtaccccggcctggccgacagcgcccccagctgcccccagaacgtgaacatcagcggcggcaccttcaccctgagccacggctgggcccccggcagcctgctgacctacagctgcccccagggcctgtaccccagccccgccagcagactgtgcaagagcagcggccagtggcagacccccggcgccaccagaagcctgagcaaggccgtgtgcaagcccgtgagatgccccgcccccgtgagcttcgagaacggcatctacacccccagactgggcagctaccccgtgggcggcaacgtgagcttcgagtgcgaggacggcttcatcctgagaggcagccccgtgagacagtgcagacccaacggcatgtgggacggcgagaccgccgtgtgcgacaacggcgccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggagagcctgggcagaaagatccagatccagagaagcggccacctgaacctgtacctgctgctggactgcagccagagcgtgagcgagaacgacttcctgatcttcaaggagagcgccagcctgatggtggacagaatcttcagcttcgagatcaacgtgagcgtggccatcatcaccttcgccagcgagcccaaggtgctgatgagcgtgctgaacgacaacagcagagacatgaccgaggtgatcagcagcctggagaacgccaactacaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcgagagcggcggcgccgtgttcctggagagaagattcagattcttccaggtgggcctggtgagctggggcctgtacaacccctgcctgggcagcgccgacaagaacagcagaaagagagcccccagaagcaaggtgcccccccccagagacttccacatcaacctgttcagaatgcagccctggctgagacagcacctgggcgacgtgctgaacttcctgcccctgtag

SEQ ID NO: 77382 - DNA, 1134 bp, Artificial Sequence
  Description of Artificial Sequence: Synthetic coding sequence
atgaccgaggtgatcagcagcctggagaacgccaactacaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcggcagcggcgagctgggcagcctgcagcccctgccctggctgtgctag

SEQ ID NO: 77383 - DNA, 2259 bp, Artificial Sequence; identical to SEQ ID NO: 77381
  Description of Artificial Sequence: Synthetic coding sequence

SEQ ID NO: 77384 - DNA, 1578 bp, Artificial Sequence
  Description of Artificial Sequence: Synthetic coding sequence
atggtgctgttctgcctgctgttcctgtaccccgccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcgagagcggcggcgccgtgttcctggagagaagattcagattcttccaggtgggcctggtgagctggggcctgtacaacccctgcctgggcagcgccgacaagaacagcagaaagagagcccccagaagcaaggtgcccccccccagagacttccacatcaacctgttcagaatgcagccctggctgagacagcacctgggcgacgtgctgaacttcctgcccctgtag

SEQ ID NO: 77385 - DNA, 2259 bp, Artificial Sequence; identical to SEQ ID NO: 77381
  Description of Artificial Sequence: Synthetic coding sequence

SEQ ID NO: 77386 - DNA, 1578 bp, Artificial Sequence; identical to SEQ ID NO: 77384
  Description of Artificial Sequence: Synthetic coding sequence

SEQ ID NO: 77387 - DNA, 2259 bp, Artificial Sequence; identical to SEQ ID NO: 77381
  Description of Artificial Sequence: Synthetic coding sequence

SEQ ID NO: 77388 - DNA, 420 bp, Artificial Sequence
  Description of Artificial Sequence: Synthetic coding sequence
atgggccccctgatggtgctgttctgcctgctgttcctgtaccccggcctggccgacagcgcccccagctgcccccagaacgtgaacatcagcggcggcaccttcaccctgagccacggctgggcccccggcagcctgctgacctacagctgcccccagggcctgtaccccagccccgccagcagactgtgcaagagcagcggccagtggcagacccccggcgccaccagaagcctgagcaaggccgtgtgcaagcccgtgagatgccccgcccccgtgagcttcgagaacggcatctacacccccagactgggcagctaccccgtgggcggcaacgtgagcttcgagtgcgaggacggcttcatcctgagaggcagccccgtgagacagtgcagacccaacggcatgtgggacggctag

SEQ ID NO: 77389 - DNA, 510 bp, Artificial Sequence
  Description of Artificial Sequence: Synthetic coding sequence
atgagagccctgtgcatcagagagacctgcagcagcgagctgggcttcagcagaaactggagcagaagaaaggccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggctag

SEQ ID NO: 77390 - DNA, 420 bp, Artificial Sequence; identical to SEQ ID NO: 77388
  Description of Artificial Sequence: Synthetic coding sequence

SEQ ID NO: 77391 - DNA, 2259 bp, Artificial Sequence; identical to SEQ ID NO: 77381
  Description of Artificial Sequence: Synthetic coding sequence

SEQ ID NO: 77392 - DNA, 378 bp, Artificial Sequence
  Description of Artificial Sequence: Synthetic coding sequence
atgggccccctgatggtgctgttctgcctgctgttcctgtaccccggcctggccgacagcgcccccagctgcccccagaacgtgaacatcagcggcggcaccttcaccctgagccacggctgggcccccggcagcctgctgacctacagctgcccccagggcctgtaccccagccccgccagcagactgtgcaagagcagcggccagtggcagacccccggcgccaccagaagcctgagcaaggccgtgtgcaagcccggccactgccccaaccccggcatcagcctgggcgccgtgagaaccggcttcagattcggccacggcgacaaggtgagatacagatgcagcagcaacctggtgctgaccggcagcagctag

SEQ ID NO: 77393 - DNA, 510 bp, Artificial Sequence; identical to SEQ ID NO: 77389
  Description of Artificial Sequence: Synthetic coding sequence

SEQ ID NO: 77394 - DNA, 1062 bp, Artificial Sequence
  Description of Artificial Sequence: Synthetic coding sequence
atgggccccctgatggtgctgttctgcctgctgttcctgtaccccgccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggagagcctgggcagaaagatccagatccagagaagcggccacctgaacctgtacctgctgctggactgcagccagagcgtgagcgagaacgacttcctgatcttcaaggagagcgccagcctgatggtggacagaatcttcagcttcgagatcaacgtgagcgtggccatcatcaccttcgccagcgagcccaaggtgctgatgagcgtgctgaacgacaacagcagagacatgaccgaggtgatcagcagcctggagaacgccaactacaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagtag

SEQ ID NO: 77395 - DNA, 2259 bp, Artificial Sequence; identical to SEQ ID NO: 77381
  Description of Artificial Sequence: Synthetic coding sequence

SEQ ID NO: 77396 - DNA, 1062 bp, Artificial Sequence; identical to SEQ ID NO: 77394
  Description of Artificial Sequence: Synthetic coding sequence

SEQ ID NO: 77397 - DNA, 1062 bp, Artificial Sequence; identical to SEQ ID NO: 77394
  Description of Artificial Sequence: Synthetic coding sequence

SEQ ID NO: 77398 - DNA, 510 bp, Artificial Sequence; identical to SEQ ID NO: 77389
  Description of Artificial Sequence: Synthetic coding sequence

SEQ ID NO: 77399 - DNA, 1578 bp, Artificial Sequence; identical to SEQ ID NO: 77384
  Description of Artificial Sequence: Synthetic coding sequence

SEQ ID NO: 77400 - DNA, 1062 bp, Artificial Sequence; identical to SEQ ID NO: 77394
  Description of Artificial Sequence: Synthetic coding sequence

SEQ ID NO: 77401 - DNA, 405 bp, Artificial Sequence
  Description of Artificial Sequence: Synthetic coding sequence
tgaggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggagagcctgggcagaaagatccagatccagagaagcggccacctgaacctgtacctgctgctggactgcagccagagcgtgagcgagaacgacttcctgatcttcaaggagagcgccagcctgatggtgtag

SEQ ID NO: 77402 - DNA, 1578 bp, Artificial Sequence; identical to SEQ ID NO: 77384
  Description of Artificial Sequence: Synthetic coding sequence

SEQ ID NO: 77403 - DNA, 1578 bp, Artificial Sequence; identical to SEQ ID NO: 77384
  Description of Artificial Sequence: Synthetic coding sequence

SEQ ID NO: 77404 - DNA, 1062 bp, Artificial Sequence; identical to SEQ ID NO: 77394
  Description of Artificial Sequence: Synthetic coding sequence

SEQ ID NO: 77405 - DNA, 477 bp, Artificial Sequence
  Description of Artificial Sequence: Synthetic coding sequence
atgagagccctgtgcatcagagagacctgcagcagcgagctgggcttcagcagaaactggagcagaagaaaggccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggagagcctgggcagaaagatccagatccagagaagcggccacctgaacctgtacctgctgctggactgcagccagagcgtgagcgagaacgacttcctgatcttcaaggagagcgccagcctgatggtgtag

SEQ ID NO: 77406 - DNA, 477 bp, Artificial Sequence; identical to SEQ ID NO: 77405
  Description of Artificial Sequence: Synthetic coding sequence

SEQ ID NO: 77407 - DNA, 978 bp, Artificial Sequence
  Description of Artificial Sequence: Synthetic coding sequence
atgggcaccagaagcgccatcgccgcccccagaatcctgtgcagcagaggcctgagaagcggcagcgccagagccaccggcagcggcgtggagagaagccccagcgccgccaaccccaccctgatgaccagcctgagaacctggcccctgccctgggccctgcccagccccacctgcctgggcccccccatcccccccagaagacagagaatcttcagcttcgagatcaacgtgagcgtggccatcatcaccttcgccagcgagcccaaggtgctgatgagcgtgctgaacgacaacagcagagacatgaccgaggtgatcagcagcctggagaacgccaactacaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggcctag

SEQ ID NO: 77408 - DNA, 477 bp, Artificial Sequence; identical to SEQ ID NO: 77405
  Description of Artificial Sequence: Synthetic coding sequence

SEQ ID NO: 77409 - DNA, 1062 bp, Artificial Sequence; identical to SEQ ID NO: 77394
  Description of Artificial Sequence: Synthetic coding sequence

SEQ ID NO: 77410 - DNA, 420 bp, Artificial Sequence; identical to SEQ ID NO: 77388
  Description of Artificial Sequence: Synthetic coding sequence

SEQ ID NO: 77411 - DNA, 438 bp, Artificial Sequence
  Description of Artificial Sequence: Synthetic coding sequence
tgaggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggctag

SEQ ID NO: 77412 - DNA, 378 bp, Artificial Sequence; identical to SEQ ID NO: 77392
  Description of Artificial Sequence: Synthetic coding sequence

SEQ ID NO: 77413 - DNA, 420 bp, Artificial Sequence; identical to SEQ ID NO: 77388
  Description of Artificial Sequence: Synthetic coding sequence

SEQ ID NO: 77414 - DNA, 477 bp, Artificial Sequence; identical to SEQ ID NO: 77405
  Description of Artificial Sequence: Synthetic coding sequence

SEQ ID NO: 77415 - DNA, 378 bp, Artificial Sequence; identical to SEQ ID NO: 77392
  Description of Artificial Sequence: Synthetic coding sequence

SEQ ID NO: 77416 - DNA, 1863 bp, Artificial Sequence
  Description of Artificial Sequence: Synthetic coding sequence
atgggccccctgatggtgctgttctgcctgctgttcctgtaccccgccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggagagcctgggcagaaagatccagatccagagaagcggccacctgaacctgtacctgctgctggactgcagccagagcgtgagcgagaacgacttcctgatcttcaaggagagcgccagcctgatggtggacagaatcttcagcttcgagatcaacgtgagcgtggccatcatcaccttcgccagcgagcccaaggtgctgatgagcgtgctgaacgacaacagcagagacatgaccgaggtgatcagcagcctggagaacgccaactacaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcgagagcggcggcgccgtgttcctggagagaagattcagattcttccaggtgggcctggtgagctggggcctgtacaacccctgcctgggcagcgccgacaagaacagcagaaagagagcccccagaagcaaggtgcccccccccagagacttccacatcaacctgttcagaatgcagccctggctgagacagcacctgggcgacgtgctgaacttcctgcccctgtag

SEQ ID NO: 77417 - DNA, 378 bp, Artificial Sequence; identical to SEQ ID NO: 77392
  Description of Artificial Sequence: Synthetic coding sequence

SEQ ID NO: 77418 - DNA, 420 bp, Artificial Sequence; identical to SEQ ID NO: 77388
  Description of Artificial Sequence: Synthetic coding sequence

SEQ ID NO: 77419 - DNA, 378 bp, Artificial Sequence; identical to SEQ ID NO: 77392
  Description of Artificial Sequence: Synthetic coding sequence

SEQ ID NO: 77420 - DNA, 2259 bp, Artificial Sequence; identical to SEQ ID NO: 77381
  Description of Artificial Sequence: Synthetic coding sequence

SEQ ID NO: 77421 - DNA, 378 bp, Artificial Sequence; identical to SEQ ID NO: 77392
  Description of Artificial Sequence: Synthetic coding sequence

SEQ ID NO: 77422 - DNA, 510 bp, Artificial Sequence; identical to SEQ ID NO: 77389
  Description of Artificial Sequence: Synthetic coding sequence

SEQ ID NO: 77423 - DNA, 1578 bp, Artificial Sequence; identical to SEQ ID NO: 77384
  Description of Artificial Sequence: Synthetic coding sequence

SEQ ID NO: 77424 - DNA, 438 bp, Artificial Sequence; identical to SEQ ID NO: 77411
  Description of Artificial Sequence: Synthetic coding sequence

SEQ ID NO: 77425 - DNA, 405 bp, Artificial Sequence; identical to SEQ ID NO: 77401
  Description of Artificial Sequence: Synthetic coding sequence

SEQ ID NO: 77426 - DNA, 420 bp, Artificial Sequence; identical to SEQ ID NO: 77388
  Description of Artificial Sequence: Synthetic coding sequence

SEQ ID NO: 77427 - DNA, 420 bp, Artificial Sequence; identical to SEQ ID NO: 77388
  Description of Artificial Sequence: Synthetic coding sequence

SEQ ID NO: 77428 - DNA, 1617 bp, Artificial Sequence
  Description of Artificial Sequence: Synthetic coding sequence
atgagagccctgtgcatcagagagacctgcagcagcgagctgggcttcagcagaaactggagcagaagaaaggccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcgagagcggcggcgccgtgttcctggagagaagattcagattcttccaggtgggcctggtgagctggggcctgtacaacccctgcctgggcagcgccgacaagaacagcagaaagagagcccccagaagcaaggtgcccccccccagagacttccacatcaacctgttcagaatgcagccctggctgagacagcacctgggcgacgtgctgaacttcctgcccctgtag

SEQ ID NO: 77429 - DNA, 1521 bp, Artificial Sequence
  Description of Artificial Sequence: Synthetic coding sequence
atgggcaccagaagcgccatcgccgcccccagaatcctgtgcagcagaggcctgagaagcggcagcgccagagccaccggcagcggcgtggagagaagccccagcgccgccatcttcagcttcgagatcaacgtgagcgtggccatcatcaccttcgccagcgagcccaaggtgctgatgagcgtgctgaacgacaacagcagagacatgaccgaggtgatcagcagcctggagaacgccaactacaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcgagagcggcggcgccgtgttcctggagagaagattcagattcttccaggtgggcctggtgagctggggcctgtacaacccctgcctgggcagcgccgacaagaacagcagaaagagagcccccagaagcaaggtgcccccccccagagacttccacatcaacctgttcagaatgcagccctggctgagacagcacctgggcgacgtgctgaacttcctgcccctgtag

SEQ ID NO: 77430 - DNA, 1521 bp, Artificial Sequence; identical to SEQ ID NO: 77429
  Description of Artificial Sequence: Synthetic coding sequence

SEQ ID NO: 77431 - DNA, 1521 bp, Artificial Sequence; identical to SEQ ID NO: 77429
  Description of Artificial Sequence: Synthetic coding sequence

SEQ ID NO: 77432 - DNA, 1134 bp, Artificial Sequence; identical to SEQ ID NO: 77382
  Description of Artificial Sequence: Synthetic coding sequence

SEQ ID NO: 77433 - DNA, 978 bp, Artificial Sequence; identical to SEQ ID NO: 77407
  Description of Artificial Sequence: Synthetic coding sequence

SEQ ID NO: 77434 - DNA, 1521 bp, Artificial Sequence; identical to SEQ ID NO: 77429
  Description of Artificial Sequence: Synthetic coding sequence

SEQ ID NO: 77435 - DNA, 1521 bp, Artificial Sequence; identical to SEQ ID NO: 77429
  Description of Artificial Sequence: Synthetic coding sequence

SEQ ID NO: 77436 - DNA, 1617 bp, Artificial Sequence; identical to SEQ ID NO: 77428
  Description of Artificial Sequence: Synthetic coding sequence

SEQ ID NO: 77437 - DNA, 1134 bp, Artificial Sequence; identical to SEQ ID NO: 77382
  Description of Artificial Sequence: Synthetic coding sequence

SEQ ID NO: 77438 - DNA, 1863 bp, Artificial Sequence; identical to SEQ ID NO: 77416
  Description of Artificial Sequence: Synthetic coding sequence

SEQ ID NO: 77439 - DNA, 1863 bp, Artificial Sequence; identical to SEQ ID NO: 77416
  Description of Artificial Sequence: Synthetic coding sequence

SEQ ID NO: 77440 - DNA, 978 bp, Artificial Sequence; identical to SEQ ID NO: 77407
  Description of Artificial Sequence: Synthetic coding sequence

SEQ ID NO: 77441 - DNA, 978 bp, Artificial Sequence; identical to SEQ ID NO: 77407
  Description of Artificial Sequence: Synthetic coding sequence

SEQ ID NO: 77442 - DNA, 1521 bp, Artificial Sequence; identical to SEQ ID NO: 77429
  Description of Artificial Sequence: Synthetic coding sequence

SEQ ID NO: 77443 - DNA, 978 bp, Artificial Sequence; identical to SEQ ID NO: 77407
  Description of Artificial Sequence: Synthetic coding sequence

SEQ ID NO: 77444 - DNA, 1863 bp, Artificial Sequence; identical to SEQ ID NO: 77416
  Description of Artificial Sequence: Synthetic coding sequence

SEQ ID NO: 77445 - DNA, 1134 bp, Artificial Sequence; identical to SEQ ID NO: 77382
  Description of Artificial Sequence: Synthetic coding sequence

SEQ ID NO: 77446 - DNA, 1134 bp, Artificial Sequence; identical to SEQ ID NO: 77382
  Description of Artificial Sequence: Synthetic coding sequence

SEQ ID NO: 77447 - DNA, 978 bp, Artificial Sequence; identical to SEQ ID NO: 77407
  Description of Artificial Sequence: Synthetic coding sequence

SEQ ID NO: 77448 - DNA, 1134 bp, Artificial Sequence; identical to SEQ ID NO: 77382
  Description of Artificial Sequence: Synthetic coding sequence

SEQ ID NO: 77449 - DNA, 1617 bp, Artificial Sequence; identical to SEQ ID NO: 77428
  Description of Artificial Sequence: Synthetic coding sequence

SEQ ID NO: 77450 - DNA, 1863 bp, Artificial Sequence; identical to SEQ ID NO: 77416
  Description of Artificial Sequence: Synthetic coding sequence

SEQ ID NO: 77451 - DNA, 1863 bp, Artificial Sequence; identical to SEQ ID NO: 77416
  Description of Artificial Sequence: Synthetic coding sequence

SEQ ID NO: 77452 - DNA, 1863 bp, Artificial Sequence; identical to SEQ ID NO: 77416
  Description of Artificial Sequence: Synthetic coding sequence

SEQ ID NO: 77453 - DNA, 978 bp, Artificial Sequence; identical to SEQ ID NO: 77407
  Description of Artificial Sequence: Synthetic coding sequence

SEQ ID NO: 77454 - DNA, 1134 bp, Artificial Sequence; identical to SEQ ID NO: 77382
  Description of Artificial Sequence: Synthetic coding sequence

SEQ ID NO: 77455 - DNA, 1617 bp, Artificial Sequence; identical to SEQ ID NO: 77428
  Description of Artificial Sequence: Synthetic coding sequence

SEQ ID NO: 77456 - DNA, 1617 bp, Artificial Sequence; identical to SEQ ID NO: 77428
  Description of Artificial Sequence: Synthetic coding sequence

SEQ ID NO: 77457 - DNA, 4992 bp, Artificial Sequence
  Description of Artificial Sequence: Synthetic coding sequence
atgggccccaccagcggccccagcctgctgctgctgctgctgacccacctgcccctggccctgggcagccccatgtacagcatcatcacccccaacatcctgagactggagagcgaggagaccatggtgctggaggcccacgacgcccagggcgacgtgcccgtgaccgtgaccgtgcacgacttccccggcaagaagctggtgctgagcagcgagaagaccgtgctgacccccgccaccaaccacatgggcaacgtgaccttcaccatccccgccaacagagagttcaagagcgagaagggcagaaacaagttcgtgaccgtgcaggccaccttcggcacccaggtggtggagaaggtggtgctggtgagcctgcagagcggctacctgttcatccagaccgacaagaccatctacacccccggcagcaccgtgctgtacagaatcttcaccgtgaaccacaagctgctgcccgtgggcagaaccgtgatggtgaacatcgagaaccccgagggcatccccgtgaagcaggacagcctgagcagccagaaccagctgggcgtgctgcccctgagctgggacatccccgagctggtgaacatgggccagtggaagatcagagcctactacgagaacagcccccagcaggtgttcagcaccgagttcgaggtgaaggagtacgtgctgcccagcttcgaggtgatcgtggagcccaccgagaagttctactacatctacaacgagaagggcctggaggtgaccatcaccgccagattcctgtacggcaagaaggtggagggcaccgccttcgtgatcttcggcatccaggacggcgagcagagaatcagcctgcccgagagcctgaagagaatccccatcgaggacggcagcggcgaggtggtgctgagcagaaaggtgctgctggacggcgtgcagaaccccagagccgaggacctggtgggcaagagcctgtacgtgagcgccaccgtgatcctgcacagcggcagcgacatggtgcaggccgagagaagcggcatccccatcgtgaccagcccctaccagatccacttcaccaagacccccaagtacttcaagcccggcatgcccttcgacctgatggtgttcgtgaccaaccccgacggcagccccgcctacagagtgcccgtggccgtgcagggcgaggacaccgtgcagagcctgacccagggcgacggcgtggccaagctgagcatcaacacccaccccagccagaagcccctgagcatcaccgtgagaaccaagaagcaggagctgagcgaggccgagcaggccaccagaaccatgcaggccctgccctacagcaccgtgggcaacagcaacaactacctgcacctgagcgtgctgagaaccgagctgagacccggcgagaccctgaacgtgaacttcctgctgagaatggacagagcccacgaggccaagatcagatactacacctacctgatcatgaacaagggcagactgctgaaggccggcagacaggtgagagagcccggccaggacctggtggtgctgcccctgagcatcaccaccgacttcatccccagcttcagactggtggcctactacaccctgatcggcgccagcggccagagagaggtggtggccgacagcgtgtgggtggacgtgaaggacagctgcgtgggcagcctggtggtgaagagcggccagagcgaggacagacagcccgtgcccggccagcagatgaccctgaagatcgagggcgaccacggcgccagagtggtgctggtggccgtggacaagggcgtgttcgtgctgaacaagaagaacaagctgacccagagcaagatctgggacgtggtggagaaggccgacatcggctgcacccccggcagcggcaaggactacgccggcgtgttcagcgacgccggcctgaccttcaccagcagcagcggccagcagaccgcccagagagccgagctgcagtgcccccagcccgccgccagaagaagaagaagcgtgcagctgaccgagaagagaatggacaaggtgggcaagtaccccaaggagctgagaaagtgctgcgaggacggcatgagagagaaccccatgagattcagctgccagagaagaaccagattcatcagcctgggcgaggcctgcaagaaggtgttcctggactgctgcaactacatcaccgagctgagaagacagcacgccagagccagccacctgggcctggccagaagcaacctggacgaggacatcatcgccgaggagaacatcgtgagcagaagcgagttccccgagagctggctgtggaacgtggaggacctgaaggagccccccaagaacggcatcagcaccaagctgatgaacatcttcctgaaggacagcatcaccacctgggagatcctggccgtgagcatgagcgacaagaagggcatctgcgtggccgaccccttcgaggtgaccgtgatgcaggacttcttcatcgacctgagactgccctacagcgtggtgagaaacgagcaggtggagatcagagccgtgctgtacaactacagacagaaccaggagctgaaggtgagagtggagctgctgcacaaccccgccttctgcagcctggccaccaccaagagaagacaccagcagaccgtgaccatcccccccaagagcagcctgagcgtgccctacgtgatcgtgcccctgaagaccggcctgcaggaggtggaggtgaaggccgccgtgtaccaccacttcatcagcgacggcgtgagaaagagcctgaaggtggtgcccgagggcatcagaatgaacaagaccgtggccgtgagaaccctggaccccgagagactgggcagagagggcgtgcagaaggaggacatcccccccgccgacctgagcgaccaggtgcccgacaccgagagcgagaccagaatcctgctgcagggcacccccgtggcccagatgaccgaggacgccgtggacgccgagagactgaagcacctgatcgtgacccccagcggctgcggcgagcagaacatgatcggcatgacccccaccgtgatcgccgtgcactacctggacgagaccgagcagtgggagaagttcggcctggagaagagacagggcgccctggagctgatcaagaagggctacacccagcagctggccttcagacagcccagcagcgccttcgccgccttcgtgaagagagcccccagcacctggctgaccgcctacgtggtgaaggtgttcagcctggccgtgaacctgatcgccatcgacagccaggtgctgtgcggcgccgtgaagtggctgatcctggagaagcagaagcccgacggcgtgttccaggaggacgcccccgtgatccaccaggagatgatcggcggcctgagaaacaacaacgagaaggacatggccctgaccgccttcgtgctgatcagcctgcaggaggccaaggacatctgcgaggagcaggtgaacagcctgcccggcagcatcaccaaggccggcgacttcctggaggccaactacatgaacctgcagagaagctacaccgtggccatcgccggctacgccctggcccagatgggcagactgaagggccccctgctgaacaagttcctgaccaccgccaaggacaagaacagatgggaggaccccggcaagcagctgtacaacgtggaggccaccagctacgccctgctggccctgctgcagctgaaggacttcgacttcgtgccccccgtggtgagatggctgaacgagcagagatactacggcggcggctacggcagcacccaggccaccttcatggtgttccaggccctggcccagtaccagaaggacgcccccgaccaccaggagctgaacctggacgtgagcctgcagctgcccagcagaagcagcaagatcacccacagaatccactgggagagcgccagcctgctgagaagcgaggagaccaaggagaacgagggcttcaccgtgaccgccgagggcaagggccagggcaccctgagcgtggtgaccatgtaccacgccaaggccaaggaccagctgacctgcaacaagttcgacctgaaggtgaccatcaagcccgcccccgagaccgagaagagaccccaggacgccaagaacaccatgatcctggagatctgcaccagatacagaggcgaccaggacgccaccatgagcatcctggacatcagcatgatgaccggcttcgcccccgacaccgacgacctgaagcagctggccaacggcgtggacagatacatcagcaagtacgagctggacaaggccttcagcgacagaaacaccctgatcatctacctggacaaggtgagccacagcgaggacgactgcctggccttcaaggtgcaccagtacttcaacgtggagctgatccagcccggcgccgtgaaggtgtacgcctactacaacctggaggagagctgcaccagattctaccaccccgagaaggaggacggcaagctgaacaagctgtgcagagacgagctgtgcagatgcgccgaggagaactgcttcatccagaagagcgacgacaaggtgaccctggaggagagactggacaaggcctgcgagcccggcgtggactacgtgtacaagaccagactggtgaaggtgcagctgagcaacgacttcgacgagtacatcatggccatcgagcagaccatcaagagcggcagcgacgaggtgcaggtgggccagcagagaaccttcatcagccccatcaagtgcagagaggccctgaagctggaggagaagaagcactacctgatgtggggcctgagcagcgacttctggggcgagaagcccaacctgagctacatcatcggcaaggacacctgggtggagcactggcccgaggaggacgagtgccaggacgaggagaaccagaagcagtgccaggacctgggcgccttcaccgagagcatggtggtgttcggctgccccaactag

SEQ ID NO: 77458 - DNA, 1794 bp, Artificial Sequence
  Description of Artificial Sequence: Synthetic coding sequence
atgcacccccccaagacccccagcggcgccctgcacagaaagagaaagatggccgcctggcccttcagcagactgtggaaggtgagcgaccccatcctgttccagatgaccctgatcgccgccctgctgcccgccgtgctgggcaactgcggccccccccccaccctgagcttcgccgcccccatggacatcaccctgaccgagaccagattcaagaccggcaccaccctgaagtacacctgcctgcccggctacgtgagaagccacagcacccagaccctgacctgcaacagcgacggcgagtgggtgtacaacaccttctgcatctacaagagatgcagacaccccggcgagctgagaaacggccaggtggagatcaagaccgacctgagcttcggcagccagatcgagttcagctgcagcgagggcttcttcctgatcggcagcaccaccagcagatgcgaggtgcaggacagaggcgtgggctggagccaccccctgccccagtgcgagatcgtgaagtgcaagcccccccccgacatcagaaacggcagacacagcggcgaggagaacttctacgcctacggcttcagcgtgacctacagctgcgaccccagattcagcctgctgggccacgccagcatcagctgcaccgtggagaacgagaccatcggcgtgtggagacccagcccccccacctgcgagaagatcacctgcagaaagcccgacgtgagccacggcgagatggtgagcggcttcggccccatctacaactacaaggacaccatcgtgttcaagtgccagaagggcttcgtgctgagaggcagcagcgtgatccactgcgacgccgacagcaagtggaaccccagcccccccgcctgcgagcccaacagctgcatcaacctgcccgacatcccccacgccagctgggagacctaccccagacccaccaaggaggacgtgtacgtggtgggcaccgtgctgagatacagatgccaccccggctacaagcccaccaccgacgagcccaccaccgtgatctgccagaagaacctgagatggaccccctaccagggctgcgaggccctgtgctgccccgagcccaagctgaacaacggcgagatcacccagcacagaaagagcagacccgccaaccactgcgtgtacttctacggcgacgagatcagcttcagctgccacgagaccagcagattcagcgccatctgccagggcgacggcacctggagccccagaacccccagctgcggcgacatctgcaacttcccccccaagatcgcccacggccactacaagcagagcagcagctacagcttcttcaaggaggagatcatctacgagtgcgacaagggctacatcctggtgggccaggccaagctgagctgcagctacagccactggagcgcccccgccccccagtgcaaggccctgtgcagaaagcccgagctggtgaacggcagactgagcgtggacaaggaccagtacgtggagcccgagaacgtgaccatccagtgcgacagcggctacggcgtggtgggcccccagagcatcacctgcagcggcaacagaacctggtaccccgaggtgcccaagtgcgagtgggagacccccgagggctgcgagcaggtgctgaccggcaagagactgatgcagtgcctgcccaaccccgaggacgtgaagatggccctggaggtgtacaagctgagcctggagatcgagcagctggagctgcagagagacagcgccagacagagcaccctggacaaggagctgtag

SEQ ID NO: 77459 - DNA, 459 bp, Artificial Sequence
  Description of Artificial Sequence: Synthetic coding sequence
atgcacccccccaagacccccagcggcgccctgcacagaaagagaaagatggccgcctggcccttcagcagactgtggaaggtgagcgaccccatcctgttccagatgaccctgatcgccgccctgctgcccgccgtgctgggcaactgcggccccccccccaccctgagcttcgccgcccccatggacatcaccctgaccgagaccagattcaagaccggcaccaccctgaagtacacctgcctgcccggctacgtgagaagccacagcacccagaccctgacctgcaacagcgacggcgagtgggtgtacaacaccttctgcatctacaagagatgcagacaccccggcgagctgagaaacggccaggtggagatcaagaccgacctgagcttcggcagccagatcgagttcagctgcagcgagggcttcttcctgatcggcagcaccaccagctag

SEQ ID NO: 77460 - DNA, 759 bp, Artificial Sequence
  Description of Artificial Sequence: Synthetic coding sequence
atgttcttctggtgcgcctgctgcctgatggtggcctggagagtgagcgccagcgacgccgagcactgccccgagctgccccccgtggacaacagcatcttcgtggccaaggaggtggagggccagatcctgggcacctacgtgtgcatcaagggctaccacctggtgggcaagaagaccctgttctgcaacgccagcaaggagtgggacaacaccaccaccgagtgcagactgggccactgccccgaccccgtgctggtgaacggcgagttcagcagcagcggccccgtgaacgtgagcgacaagatcaccttcatgtgcaacgaccactacatcctgaagggcagcaacagaagccagtgcctggaggaccacacctgggccccccccttccccatctgcaagagcagagactgcgacccccccggcaaccccgtgcacggctacttcgagggcaacaacttcaccctgggcagcaccatcagctactactgcgaggacagatactacctggtgggcgtgcaggagcagcagtgcgtggacggcgagtggagcagcgccctgcccgtgtgcaagctgatccaggaggcccccaagcccgagtgcgagaaggccctgctggccttccaggagagcaagaacctgtgcgaggccatggagaacttcatgcagcagctgaaggagagcggcatgaccatggaggagctgaagtacagcctggagctgaagaaggccgagctgaaggccaagctgctgtag

SEQ ID NO: 77461 - DNA, 756 bp, Artificial Sequence
  Description of Artificial Sequence: Synthetic coding sequence
atgttcttctggtgcgcctgctgcctgatggtggcctggagagtgagcgccagcgacgagcactgccccgagctgccccccgtggacaacagcatcttcgtggccaaggaggtggagggccagatcctgggcacctacgtgtgcatcaagggctaccacctggtgggcaagaagaccctgttctgcaacgccagcaaggagtgggacaacaccaccaccgagtgcagactgggccactgccccgaccccgtgctggtgaacggcgagttcagcagcagcggccccgtgaacgtgagcgacaagatcaccttcatgtgcaacgaccactacatcctgaagggcagcaacagaagccagtgcctggaggaccacacctgggccccccccttccccatctgcaagagcagagactgcgacccccccggcaaccccgtgcacggctacttcgagggcaacaacttcaccctgggcagcaccatcagctactactgcgaggacagatactacctggtgggcgtgcaggagcagcagtgcgtggacggcgagtggagcagcgccctgcccgtgtgcaagctgatccaggaggcccccaagcccgagtgcgagaaggccctgctggccttccaggagagcaagaacctgtgcgaggccatggagaacttcatgcagcagctgaaggagagcggcatgaccatggaggagctgaagtacagcctggagctgaagaaggccgagctgaaggccaagctgctgtag

SEQ ID NO: 77462 - DNA, 759 bp, Artificial Sequence; identical to SEQ ID NO: 77460
  Description of Artificial Sequence: Synthetic coding sequence

SEQ ID NO: 77463 - DNA, 759 bp, Artificial Sequence; identical to SEQ ID NO: 77460
  Description of Artificial Sequence: Synthetic coding sequence

SEQ ID NO: 77464 - DNA, 657 bp, Artificial Sequence
  Description of Artificial Sequence: Synthetic coding sequence
atggtggcctggagagtgagcgccagcgacgagcactgccccgagctgccccccgtggacaacagcatcttcgtggccaaggaggtggagggccagatcctgggcacctacgtgtgcatcaagggctaccacctggtgggcaagaagaccctgttctgcaacgccagcaaggagtgggacaacaccaccaccgagtgcagactgggccactgccccgaccccgtgctggtgaacggcgagttcagcagcagcggccccgtgaacgtgagcgacaagatcaccttcatgtgcaacgaccactacatcctgaagggcagcaacagaagccagtgcctggaggaccacacctgggccccccccttccccatctgcaagagcatcccccagaccagacccctgcccttccagccctgcagccccctgttcctgttcctgctgagacagagcctggccctgttccccagactggagtgcagcggcagaatcctggcccactgcaacctgcacctgcccggcagcagcagcagccacgccagcgccagccaggtggccggcatcaccggcgcccaccccagatgggccaacttctgcatcttcagcagagactgggtgagcccctgctggcccggctggagccagatccccgacctgagatag

SEQ ID NO: 77465 - DNA, 546 bp, Artificial Sequence
  Description of Artificial Sequence: Synthetic coding sequence
atgttcttctggtgcgcctgctgcctgatggtggcctggagagtgagcgccagcgacgccgagcactgccccgagctgccccccgtggacaacagcatcttcgtggccaaggaggtggagggccagatcctgggcacctacgtgtgcatcaagggctaccacctggtgggcaagaagaccctgttctgcaacgccagcaaggagtgggacaacaccaccaccgagtgcagactgggccactgccccgaccccgtgctggtgaacggcgagttcagcagcagcggccccgtgaacgtgagcgacaagatcaccttcatgtgcaacgaccactacatcctgaagggcagcaacagaagccagtgcctggaggaccacacctgggccccccccttccccatctgcaagagcagagactgcgacccccccggcaaccccgtgcacggctacttcgagggcaacaacttcaccctgggcagcaccatcagctactactgcgaggacagatactacctggtgggcgtgcaggagcagcagtgcgtggactag

SEQ ID NO: 77466 - DNA, 5235 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagtaccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagtggcccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77467 - DNA, 5235 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccagcagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77468 - DNA, 5235 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagtaccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77469 - DNA, 5235 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccagcgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77470 - DNA, 5097 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccagcgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77471 - DNA, 813 bp, Artificial Sequence
  Description of Artificial Sequence: Synthetic coding sequence
atgtgccccgaggacagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggctag

SEQ ID NO: 77472 - DNA, 5097 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagtaccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagtggcccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77473 - DNA, 1536 bp, Artificial Sequence
  Description of Artificial Sequence: Synthetic coding sequence
atggccaagggcctgagcgtgcagaacgacaagcaccccggctaccagcccgccctgctgctgagccccggcgcccccctgttcgccgacggccccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77474 - DNA, 5097 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccagcagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77475 - DNA, 5097 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagtaccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagagacagcagcacctggctgaccgccttcgtgctgaaggtgctgagcctggcccaggagcaggtgggcggcagccccgagaagctgcaggagaccagcaactggctgctgagccagcagcaggccgacggcagcttccaggacccctgccccgtgctggacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgtggacctgctgggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77476 - DNA, 1536 bp, Artificial Sequence; identical to SEQ ID NO: 77473
  Description of Artificial Sequence: Synthetic coding sequence

SEQ ID NO: 77477 - DNA, 813 bp, Artificial Sequence
  Description of Artificial Sequence: Synthetic coding sequence
atgtgccccgaggacagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagtaccccggcggctag

SEQ ID NO: 77478 - DNA, 5235 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccaccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagaggcagcagcacctggctgaccgccttcgtgctgaaggtgctgagcctggcccaggagcaggtgggcggcagccccgagaagctgcaggagaccagcaactggctgctgagccagcagcaggccgacggcagcttccaggacctgagccccgtgatccacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccagcagcttcctgggcgagaaggccagcgccggcctgctgggcgcccacgccgccgccatcaccgcctacgccctgaccctgaccaaggcccccgccgacctgagaggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77479 - DNA, 5097 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccaccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagaggcagcagcacctggctgaccgccttcgtgctgaaggtgctgagcctggcccaggagcaggtgggcggcagccccgagaagctgcaggagaccagcaactggctgctgagccagcagcaggccgacggcagcttccaggacctgagccccgtgatccacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccagcagcttcctgggcgagaaggccagcgccggcctgctgggcgcccacgccgccgccatcaccgcctacgccctgaccctgaccaaggcccccgccgacctgagaggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77480 - DNA, 5235 bp, Artificial Sequence; identical to SEQ ID NO: 77478
  Description of Artificial Sequence: Synthetic coding sequence

SEQ ID NO: 77481 - DNA, 5235 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagaggcagcagcacctggctgaccgccttcgtgctgaaggtgctgagcctggcccaggagcaggtgggcggcagccccgagaagctgcaggagaccagcaactggctgctgagccagcagcaggccgacggcagcttccaggacctgagccccgtgatccacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgccgacctgagaggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77482 - DNA, 807 bp, Artificial Sequence
  Description of Artificial Sequence: Synthetic coding sequence
atgtgccccgaggacagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagcccctag

SEQ ID NO: 77483 - DNA, 5097 bp, Artificial Sequence
  Description of Artificial Sequence: Synthetic coding sequence
atgagactgctgtggggcctgatctgggccagcagcttcttcaccctgagcctgcagaagcccagactgctgctgttcagccccagcgtggtgcacctgggcgtgcccctgagcgtgggcgtgcagctgcaggacgtgcccagaggccaggtggtgaagggcagcgtgttcctgagaaaccccagcagaaacaacgtgccctgcagccccaaggtggacttcaccctgagcagcgagagagacttcgccctgctgagcctgcaggtgcccctgaaggacgccaagagctgcggcctgcaccagctgctgagaggccccgaggtgcagctggtggcccacagcccctggctgaaggacagcctgagcagaaccaccaacatccagggcatcaacctgctgttcagcagcagaagaggccacctgttcctgcagaccgaccagcccatctacaaccccggccagagagtgagatacagagtgttcgccctggaccagaagatgagacccagcaccgacaccatcaccgtgatggtggagaacagccacggcctgagagtgagaaagaaggaggtgtacatgcccagcagcatcttccaggacgacttcgtgatccccgacatcagcgagcccggcacctggaagatcagcgccagattcagcgacggcctggagagcaacagcagcacccagttcgaggtgaagaagtacgtgctgcccaacttcgaggtgaagatcacccccggcaagccctacatcctgaccgtgcccggccacctggacgagatgcagctggacatccaggccagatacatctacggcaagcccgtgcagggcgtggcctacgtgagattcggcctgctggacgaggacggcaagaagaccttcttcagaggcctggagagccagaccaagctggtgaacggccagagccacatcagcctgagcaaggccgagttccaggacgccctggagaagctgaacatgggcatcaccgacctgcagggcctgagactgtacgtggccgccgccatcatcgagagccccggcggcgagatggaggaggccgagctgaccagctggtacttcgtgagcagccccttcagcctggacctgagcaagaccaagagacacctggtgcccggcgcccccttcctgctgcaggccctggtgagagagatgagcggcagccccgccagcggcatccccgtgaaggtgagcgccaccgtgagcagccccggcagcgtgcccgaggtgcaggacatccagcagaacaccgacggcagcggccaggtgagcatccccatcatcatcccccagaccatcagcgagctgcagctgagcgtgagcgccggcagcccccaccccgccatcgccagactgaccgtggccgccccccccagcggcggccccggcttcctgagcatcgagagacccgacagcagaccccccagagtgggcgacaccctgaacctgaacctgagagccgtgggcagcggcgccaccttcagccactactactacatgatcctgagcagaggccagatcgtgttcatgaacagagagcccaagagaaccctgaccagcgtgagcgtgttcgtggaccaccacctggcccccagcttctacttcgtggccttctactaccacggcgaccaccccgtggccaacagcctgagagtggacgtgcaggccggcgcctgcgagggcaagctggagctgagcgtggacggcgccaagcagtacagaaacggcgagagcgtgaagctgcacctggagaccgacagcctggccctggtggccctgggcgccctggacaccgccctgtacgccgccggcagcaagagccacaagcccctgaacatgggcaaggtgttcgaggccatgaacagctacgacctgggctgcggccccggcggcggcgacagcgccctgcaggtgttccaggccgccggcctggccttcagcgacggcgaccagtggaccctgagcagaaagagactgagctgccccaaggagaagaccaccagaaagaagagaaacgtgaacttccagaaggccatcaacgagaagctgggccagtacgccagccccaccgccaagagatgctgccaggacggcgtgaccagactgcccatgatgagaagctgcgagcagagagccgccagagtgcagcagcccgactgcagagagcccttcctgagctgctgccagttcgccgagagcctgagaaagaagagcagagacaagggccaggccggcctgcagagagccctggagatcctgcaggaggaggacctgatcgacgaggacgacatccccgtgagaagcttcttccccgagaactggctgtggagagtggagaccgtggacagattccagatcctgaccctgtggctgcccgacagcctgaccacctgggagatccacggcctgagcctgagcaagaccaagggcctgtgcgtggccacccccgtgcagctgagagtgttcagagagttccacctgcacctgagactgcccatgagcgtgagaagattcgagcagctggagctgagacccgtgctgtacaactacctggacaagaacctgaccgtgagcgtgcacgtgagccccgtggagggcctgtgcctggccggcggcggcggcctggcccagcaggtgctggtgcccgccggcagcgccagacccgtggccttcagcgtggtgcccaccgccgccgccgccgtgagcctgaaggtggtggccagaggcagcttcgagttccccgtgggcgacgccgtgagcaaggtgctgcagatcgagaaggagggcgccatccacagagaggagctggtgtacgagctgaaccccctggaccacagaggcagaaccctggagatccccggcaacagcgaccccaacatgatccccgacggcgacttcaacagctacgtgagagtgaccgccagcgaccccctggacaccctgggcagcgagggcgccctgagccccggcggcgtggccagcctgctgagactgcccagaggctgcggcgagcagaccatgatctacctggcccccaccctggccgccagcagatacctggacaagaccgagcagtggagcaccctgccccccgagaccaaggaccacgccgtggacctgatccagaagggctacatgagaatccagcagttcagaaaggccgacggcagctacgccgcctggctgagcagaggcagcagcacctggctgaccgccttcgtgctgaaggtgctgagcctggcccaggagcaggtgggcggcagccccgagaagctgcaggagaccagcaactggctgctgagccagcagcaggccgacggcagcttccaggacctgagccccgtgatccacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccaacagcttcctgggcgagaaggccagcgccggcctgctgggcgcccacgccgccgccatcaccgcctacgccctgaccctgaccaaggcccccgccgacctgagaggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77484 - DNA, 813 bp, Artificial Sequence; identical to SEQ ID NO: 77471
  Description of Artificial Sequence: Synthetic coding sequence

SEQ ID NO: 77485 - DNA, 5097 bp, Artificial Sequence; identical to SEQ ID NO: 77479
  Description of Artificial Sequence: Synthetic coding sequence

SEQ ID NO: 77486 - DNA, 1536 bp, Artificial Sequence; identical to SEQ ID NO: 77473
  Description of Artificial Sequence: Synthetic coding sequence

SEQ ID NO: 77487 - DNA, 1953 bp, Artificial Sequence
  Description of Artificial Sequence: Synthetic coding sequence
atgggcagccagtgcagaggctggcacatgtgcgccctgggcagccagcagcaggccgacggcagcttccaggacctgagccccgtgatccacagaagcatgcagggcggcctggtgggcaacgacgagaccgtggccctgaccgccttcgtgaccatcgccctgcaccacggcctggccgtgttccaggacgagggcgccgagcccctgaagcagagagtggaggccagcatcagcaaggccagcagcttcctgggcgagaaggccagcgccggcctgctgggcgcccacgccgccgccatcaccgcctacgccctgaccctgaccaaggcccccgccgacctgagaggcgtggcccacaacaacctgatggccatggcccaggagaccggcgacaacctgtactggggcagcgtgaccggcagccagagcaacgccgtgagccccacccccgcccccagaaaccccagcgaccccatgccccaggcccccgccctgtggatcgagaccaccgcctacgccctgctgcacctgctgctgcacgagggcaaggccgagatggccgaccaggccgccgcctggctgaccagacagggcagcttccagggcggcttcagaagcacccaggacaccgtgatcgccctggacgccctgagcgcctactggatcgccagccacaccaccgaggagagaggcctgaacgtgaccctgagcagcaccggcagaaacggcttcaagagccacgccctgcagctgaacaacagacagatcagaggcctggaggaggagctgcagttcagcctgggcagcaagatcaacgtgaaggtgggcggcaacagcaagggcaccctgaaggtgctgagaacctacaacgtgctggacatgaagaacaccacctgccaggacctgcagatcgaggtgaccgtgaagggccacgtggagtacaccatggaggccaacgaggactacgaggactacgagtacgacgagctgcccgccaaggacgaccccgacgcccccctgcagcccgtgacccccctgcagctgttcgagggcagaagaaacagaagaagaagagaggcccccaaggtggtggaggagcaggagagcagagtgcactacaccgtgtgcatctggagaaacggcaaggtgggcctgagcggcatggccatcgccgacgtgaccctgctgagcggcttccacgccctgagagccgacctggagaagctgaccagcctgagcgacagatacgtgagccacttcgagaccgagggcccccacgtgctgctgtacttcgacagcgtgcccaccagcagagagtgcgtgggcttcgaggccgtgcaggaggtgcccgtgggcctggtgcagcccgccagcgccaccctgtacgactactacaaccccgagagaagatgcagcgtgttctacggcgcccccagcaagagcagactgctggccaccctgtgcagcgccgaggtgtgccagtgcgccgagggcaagtgccccagacagagaagagccctggagagaggcctgcaggacgaggacggctacagaatgaagttcgcctgctactaccccagagtggagtacggcttccaggtgaaggtgctgagagaggacagcagagccgccttcagactgttcgagaccaagatcacccaggtgctgcacttcaccaaggacgtgaaggccgccgccaaccagatgagaaacttcctggtgagagccagctgcagactgagactggagcccggcaaggagtacctgatcatgggcctggacggcgccacctacgacctggagggccacccccagtacctgctggacagcaacagctggatcgaggagatgcccagcgagagactgtgcagaagcaccagacagagagccgcctgcgcccagctgaacgacttcctgcaggagtacggcacccagggctgccaggtgtag

SEQ ID NO: 77488 - DNA, 291 bp, Artificial Sequence
  Description of Artificial Sequence: Synthetic coding sequence
atgcccggccccacccccagcggcaccaacgtgggcagcagcggcagaagccccagcaaggccgtggccgccagagccgccggcagcaccgtgagacagagaaagaacgccagctgcggcaccagaagcgccggcagaaccaccagcgccggcaccggcggcatgtggagattctacaccgaggacagccccggcctgaaggtgggccccgtgcccgtgctggtgatgagcctgctgttcatcgccagcgtgttcatgctgcacatctggggcaagtacaccagaagctag

SEQ ID NO: 77489 - DNA, 3318 bp, Artificial Sequence
  Description of Artificial Sequence: Synthetic coding sequence
ggcagagccggcgaggtgagagccctgagcagcggcgcccagagaagaggcagccacttcgtggtgctgtgcagactgcccagaggcagagccagagtggtgggcgccagcctgagccacgcccccctgcccctgagatactgctggaagggcagaggcggcgtgagcagactgttctgcagccagagagccagaatgcccggcagcctgggcagagaggccagcggcagagccggccccaccggctgcggcgccttcgccttcggcctgagatgcagatacgtgatcagcgcccccaagatcttcagagtgggcgccagcgagaacatcgtgatccaggtgtacggctacaccgaggccttcgacgccaccatcagcatcaagagctaccccgacaagaagttcagctacagcagcggccacgtgcacctgagcagcgagaacaagttccagaacagcgccatcctgaccatccagcccaagcagctgcccggcggccagaaccccgtgagctacgtgtacctggaggtggtgagcaagcacttcagcaagagcaagagaatgcccatcacctacgacaacggcttcctgttcatccacaccgacaagcccgtgtacacccccgaccagagcgtgaaggtgagagtgtacagcctgaacgacgacctgaagcccgccaagagagagaccgtgctgaccttcatcgaccccgagggcagcgaggtggacatggtggaggagatcgaccacatcggcatcatcagcttccccgacttcaagatccccagcaaccccagatacggcatgtggaccatcaaggccaagtacaaggaggacttcagcaccaccggcaccgcctacttcgaggtgaaggagtacgtgctgccccacttcagcgtgagcatcgagcccgagtacaacttcatcggctacaagaacttcaagaacttcgagatcaccatcaaggccagatacttctacaacaaggtggtgaccgaggccgacgtgtacatcaccttcggcatcagagaggacctgaaggacgaccagaaggagatgatgcagaccgccatgcagaacaccatgctgatcaacggcatcgcccaggtgaccttcgacagcgagaccgccgtgaaggagctgagctactacagcctggaggacctgaacaacaagtacctgtacatcgccgtgaccgtgatcgagagcaccggcggcttcagcgaggaggccgagatccccggcatcaagtacgtgctgagcccctacaagctgaacctggtggccacccccctgttcctgaagcccggcatcccctaccccatcaaggtgcaggtgaaggacagcctggaccagctggtgggcggcgtgcccgtgaccctgaacgcccagaccatcgacgtgaaccaggagaccagcgacctggaccccagcaagagcgtgaccagagtggacgacggcgtggccagcttcgtgctgaacctgcccagcggcgtgaccgtgctggagttcaacgtgaagaccgacgcccccgacctgcccgaggagaaccaggccagagagggctacagagccatcgcctacagcagcctgagccagagctacctgtacatcgactggaccgacaaccacaaggccctgctggtgggcgagcacctgaacatcatcgtgacccccaagagcccctacatcgacaagatcacccactacaactacctgatcctgagcaagggcaagatcatccacttcggcaccagagagaagttcagcgacgccagctaccagagcatcaacatccccgtgacccagaacatggtgcccagcagcagactgctggtgtactacatcgtgaccggcgagcagaccgccgagctggtgagcgacagcgtgtggctgaacatcgaggagaagtgcggcaaccagctgcaggtgcacctgagccccgacgccgacgcctacagccccggccagaccgtgagcctgaacatggccaccggcatggacagctgggtggccctggccgccgtggacagcgccgtgtacggcgtgcagagaggcgccaagaagcccctggagagagtgttccagttcctggagaagagcgacctgggctgcggcgccggcggcggcctgaacaacgccaacgtgttccacctggccggcctgaccttcctgaccaacgccaacgccgacgacagccaggagaacgacgagccctgcaaggagatcctgagacccagaagaaccctgcagaagaagatcgaggagatcgccgccaagtacaagcacagcgtggtgaagaagtgctgctacgacggcgcctgcgtgaacaacgacgagacctgcgagcagagagccgccagaatcagcctgggccccagatgcatcaaggccttcaccgagtgctgcgtggtggccagccagctgagagccaacatcagccacaaggacatgcagctgggcagactgcacatgaagaccctgctgcccgtgagcaagcccgagatcagaagctacttccccgagagctggctgtgggaggtgcacctggtgcccagaagaaagcagctgcagttcgccctgcccgacagcctgaccacctgggagatccagggcgtgggcatcagcaacaccggcatctgcgtggccgacaccgtgaaggccaaggtgttcaaggacgtgttcctggagatgaacatcccctacagcgtggtgagaggcgagcagatccagctgaagggcaccgtgtacaactacagaaccagcggcatgcagttctgcgtgaagatgagcgccgtggagggcatctgcaccagcgagagccccgtgatcgaccaccagggcaccaagagcagcaagtgcgtgagacagaaggtggagggcagcagcagccacctggtgaccttcaccgtgctgcccctggagatcggcctgcacaacatcaacttcagcctggagacctggttcggcaaggagatcctggtgaagaccctgagagtggtgcccgagggcgtgaagagagagagctacagcggcgtgaccctggaccccagaggcatctacggcaccatcagcagaagaaaggagttcccctacagaatccccctggacctggtgcccaagaccgagatcaagagaatcctgagcgtgaagggcctgctggtgggcgagatcctgagcgccgtgctgagccaggagggcatcaacatcctgacccacctgcccaagggcagcgccgaggccgagctgatgagcgtggtgcccgtgttctacgtgttccccggcaacagaaagagcctggagcacttcagcttctag

SEQ ID NO: 77490 - DNA, 2805 bp, Artificial Sequence
  Description of Artificial Sequence: Synthetic coding sequence
atggccagaagaagcgtgctgtacttcatcctgctgaacgccctgatcaacaagggccaggcctgcttctgcgaccactacgcctggacccagtggaccagctgcagcaagacctgcaacagcggcacccagagcagacacagacagatcgtggtggacaagtactaccaggagaacttctgcgagcagatctgcagcaagcaggagaccagagagtgcaactggcagagatgccccatcaactgcctgctgggcgacttcggcccctggagcgactgcgacccctgcatcgagaagcagagcaaggtgagaagcgtgctgagacccagccagttcggcggccagccctgcaccgcccccctggtggccttccagccctgcatccccagcaagctgtgcaagatcgaggaggccgactgcaagaacaagttcagatgcgacagcggcagatgcatcgccagaaagctggagtgcaacggcgagaacgactgcggcgacaacagcgacgagagagactgcggcagaaccaaggccgtgtgcaccagaaagtacaaccccatccccagcgtgcagctgatgggcaacggcttccacttcctggccggcgagcccagaggcgaggtgctggacaacagcttcaccggcggcatctgcaagaccgtgaagagcagcagaaccagcaacccctacagagtgcccgccaacctggagaacgtgggcttcgaggtgcagaccgccgaggacgacctgaagaccgacttctacaaggacctgaccagcctgggccacaacgagaaccagcagggcagcttcagcagccagggcggcagcagcttcagcgtgcccatcttctacagcagcaagagaagcgagaacatcaaccacaacagcgccttcaagcaggccatccaggccagccacaagaaggacagcagcttcatcagaatccacaaggtgatgaaggtgctgaacttcaccaccaaggccaaggacctgcacctgagcgacgtgttcctgaaggccctgaaccacctgcccctggagtacaacagcgccctgtacagcagaatcttcgacgacttcggcacccactacttcaccagcggcagcctgggcggcgtgtacgacctgctgtaccagttcagcagcgaggagctgaagaacagcggcctgaccgaggaggaggccaagcactgcgtgagaatcgagaccaagaagagagtgctgttcgccaagaagaccaaggtggagcacagatgcaccaccaacaagctgagcgagaagcacgagggcagcttcatccagggcgccgagaagagcatcagcctgatcagaggcggcagaagcgagtacggcgccgccctggcctgggagaagggcagcagcggcctggaggagaagaccttcagcgagtggctggagagcgtgaaggagaaccccgccgtgatcgacttcgagctggcccccatcgtggacctggtgagaaacatcccctgcgccgtgaccaagagaaacaacctgagaaaggccctgcaggagtacgccgccaagttcgacccctgccagtgcgccccctgccccaacaacggcagacccaccctgagcggcaccgagtgcctgtgcgtgtgccagagcggcacctacggcgagaactgcgagaagcagagccccgactacaagagcaacgccgtggacggccagtggggctgctggagcagctggagcacctgcgacgccacctacaagagaagcagaaccagagagtgcaacaaccccgccccccagagaggcggcaagagatgcgagggcgagaagagacaggaggaggactgcaccttcagcatcatggagaacaacggccagccctgcatcaacgacgacgaggagatgaaggaggtggacctgcccgagatcgaggccgacagcggctgcccccagcccgtgccccccgagaacggcttcatcagaaacgagaagcagctgtacctggtgggcgaggacgtggagatcagctgcctgaccggcttcgagaccgtgggctaccagtacttcagatgcctgcccgacggcacctggagacagggcgacgtggagtgccagagaaccgagtgcatcaagcccgtggtgcaggaggtgctgaccatcacccccttccagagactgtacagaatcggcgagagcatcgagctgacctgccccaagggcttcgtggtggccggccccagcagatacacctgccagggcaacagctggaccccccccatcagcaacagcctgacctgcgagaaggacaccctgaccaagctgaagggccactgccagctgggccagaagcagagcggcagcgagtgcatctgcatgagccccgaggaggactgcagccaccacagcgaggacctgtgcgtgttcgacaccgacagcaacgactacttcaccagccccgcctgcaagttcctggccgagaagtgcctgaacaaccagcagctgcacttcctgcacatcggcagctgccaggacggcagacagctggagtggggcctggagagaaccagactgagcagcaacagcaccaagaaggagagctgcggctacgacacctgctacgactgggagaagtgcagcgccagcaccagcaagtgcgtgtgcctgctgcccccccagtgcttcaagggcggcaaccagctgtactgcgtgaagatgggcagcagcaccagcgagaagaccctgaacatctgcgaggtgggcaccatcagatgcgccaacagaaagatggagatcctgcaccccggcaagtgcctggcctag

SEQ ID NO: 77491 - DNA, 2805 bp, Artificial Sequence; identical to SEQ ID NO: 77490
  Description of Artificial Sequence: Synthetic coding sequence

SEQ ID NO: 77492 - DNA, 2532 bp, Artificial Sequence
  Description of Artificial Sequence: Synthetic coding sequence
atgaaggtgatcagcctgttcatcctggtgggcttcatcggcgagttccagagcttcagcagcgccagcagccccgtgaactgccagtgggacttctacgccccctggagcgagtgcaacggctgcaccaagacccagaccagaagaagaagcgtggccgtgtacggccagtacggcggccagccctgcgtgggcaacgccttcgagacccagagctgcgagcccaccagaggctgccccaccgaggagggctgcggcgagagattcagatgcttcagcggccagtgcatcagcaagagcctggtgtgcaacggcgacagcgactgcgacgaggacagcgccgacgaggacagatgcgaggacagcgagagaagacccagctgcgacatcgacaagcccccccccaacatcgagctgaccggcaacggctacaacgagctgaccggccagttcagaaacagagtgatcaacaccaagagcttcggcggccagtgcagaaaggtgttcagcggcgacggcaaggacttctacagactgagcggcaacgtgctgagctacaccttccaggtgaagatcaacaacgacttcaactacgagttctacaacagcacctggagctacgtgaagcacaccagcaccgagcacaccagcagcagcagaaagagaagcttcttcagaagcagcagcagcagcagcagaagctacaccagccacaccaacgagatccacaagggcaagagctaccagctgctggtggtggagaacaccgtggaggtggcccagttcatcaacaacaaccccgagttcctgcagctggccgagcccttctggaaggagctgagccacctgcccagcctgtacgactacagcgcctacagaagactgatcgaccagtacggcacccactacctgcagagcggcagcctgggcggcgagtacagagtgctgttctacgtggacagcgagaagctgaagcagaacgacttcaacagcgtggaggagaagaagtgcaagagcagcggctggcacttcgtggtgaagttcagcagccacggctgcaaggagctggagaacgccctgaaggccgccagcggcacccagaacaacgtgctgagaggcgagcccttcatcagaggcggcggcgccggcttcatcagcggcctgagctacctggagctggacaaccccgccggcaacaagagaagatacagcgcctgggccgagagcgtgaccaacctgccccaggtgatcaagcagaagctgacccccctgtacgagctggtgaaggaggtgccctgcgccagcgtgaagaagctgtacctgaagtgggccctggaggagtacctggacgagttcgacccctgccactgcagaccctgccagaacggcggcctggccaccgtggagggcacccactgcctgtgccactgcaagccctacaccttcggcgccgcctgcgagcagggcgtgctggtgggcaaccaggccggcggcgtggacggcggctggagctgctggagcagctggagcccctgcgtgcagggcaagaagaccagaagcagagagtgcaacaaccccccccccagcggcggcggcagaagctgcgtgggcgagaccaccgagagcacccagtgcgaggacgaggagctggagcacctgagactgctggagccccactgcttccccctgagcctggtgcccaccgagttctgccccagcccccccgccctgaaggacggcttcgtgcaggacgagggcaccatgttccccgtgggcaagaacgtggtgtacacctgcaacgagggctacagcctgatcggcaaccccgtggccagatgcggcgaggacctgagatggctggtgggcgagatgcactgccagaagatcgcctgcgtgctgcccgtgctgatggacggcatccagagccacccccagaagcccttctacaccgtgggcgagaaggtgaccgtgagctgcagcggcggcatgagcctggagggccccagcgccttcctgtgcggcagcagcctgaagtggagccccgagatgaagaacgccagatgcgtgcagaaggagaaccccctgacccaggccgtgcccaagtgccagagatgggagaagctgcagaacagcagatgcgtgtgcaagatgccctacgagtgcggccccagcctggacgtgtgcgcccaggacgagagaagcaagagaatcctgcccctgaccgtgtgcaagatgcacgtgctgcactgccagggcagaaactacaccctgaccggcagagacagctgcaccctgcccgccagcgccgagaaggcctgcggcgcctgccccctgtggggcaagtgcgacgccgagagcagcaagtgcgtgtgcagagaggccagcgagtgcgaggaggagggcttcagcatctgcgtggaggtgaacggcaaggagcagaccatgagcgagtgcgaggccggcgccctgagatgcagaggccagagcatcagcgtgaccagcatcagaccctgcgccgccgagacccagtag

SEQ ID NO: 77493 - DNA, 1461 bp, Artificial Sequence
  Description of Artificial Sequence: Synthetic coding sequence
atgaaggtgatcagcctgttcatcctggtgggcttcatcggcgagttccagagcttcagcagcgccagcagccccgtgaactgccagtgggacttctacgccccctggagcgagtgcaacggctgcaccaagacccagaccagaagaagaagcgtggccgtgtacggccagtacggcggccagccctgcgtgggcaacgccttcgagacccagagctgcgagcccaccagaggctgccccaccgaggagggctgcggcgagagattcagatgcttcagcggccagtgcatcagcaagagcctggtgtgcaacggcgacagcgactgcgacgaggacagcgccgacgaggacagatgcgaggacagcgagagaagacccagctgcgacatcgacaagcccccccccaacatcgagctgaccggcaacggctacaacgagctgaccggccagttcagaaacagagtgctgttctacgtggacagcgagaagctgaagcagaacgacttcaacagcgtggaggagaagaagtgcaagagcagcggctggcacttcgtggtgaagttcagcagccacggctgcaaggagctggagaacgccctgaaggccgccagcggcacccagaacaacgtgctgagaggcgagcccttcatcagaggcggcggcgccggcttcatcagcggcctgagctacctggagctggacaaccccgccggcaacaagagaagatacagcgcctgggccgagagcgtgaccaacctgccccaggtgatcaagcagaagctgacccccctgtacgagctggtgaaggaggtgccctgcgccagcgtgaagaagctgtacctgaagtgggccctggaggagtacctggacgagttcgacccctgccactgcagaccctgccagaacggcggcctggccaccgtggagggcacccactgcctgtgccactgcaagccctacaccttcggcgccgcctgcgagcagggcgtgctggtgggcaaccaggccggcggcgtggacggcggctggagctgctggagcagctggagcccctgcgtgcagggcaagaagaccagaagcagagagtgcaacaaccccccccccagcggcggcggcagaagctgcgtgggcgagaccaccgagagcacccagtgcgaggacgaggagctggagcacctgagactgctggagccccactgcttccccctgagcctggtgcccaccgagttctgccccagcccccccgccctgaaggacggcttcgtgcaggacgagggcaccatgttccccgtgggcaagaacgtggtgtacacctgcaacgagggctacagcctgatcggcaaccccgtggccagatgcggcgaggacctgagatggctggtgggcgagatgcactgccagaacggcaagatcagcaactggatgaaggtgaacgagaccctgctggtggagcaccactag

SEQ ID NO: 77494 - DNA, 1032 bp, Artificial Sequence
  Description of Artificial Sequence: Synthetic coding sequence
atgaaggtgatcagcctgttcatcctggtgggcttcatcggcgagttccagagcttcagcagcgccagcagccccgtgaactgccagtgggacttctacgccccctggagcgagtgcaacggctgcaccaagacccagaccagaagaagaagcgtggccgtgtacggccagtacggcggccagccctgcgtgggcaacgccttcgagacccagagctgcgagcccaccagaggctgccccaccgaggagggctgcggcgagagattcagatgcttcagcggccagtgcatcagcaagagcctggtgtgcaacggcgacagcgactgcgacgaggacagcgccgacgaggacagatgcgaggacagcgagagaagacccagctgcgacatcgacaagcccccccccaacatcgagctgaccggcaacggctacaacgagctgaccggccagttcagaaacagagtgatcaacaccaagagcttcggcggccagtgcagaaaggtgttcagcggcgacggcaaggacttctacagactgagcggcaacgtgctgagctacaccttccaggtgaagatcaacaacgacttcaactacgagttctacaacagcacctggagctacgtgaagcacaccagcaccgagcacaccagcagcagcagaaagagaagcttcttcagaagcagcagcagcagcagcagaagctacaccagccacaccaacgagatccacaagggcaagagctaccagctgctggtggtggagaacaccgtggaggtggcccagttcatcaacaacaaccccgagttcctgcagctggccgagcccttctggaaggagctgagccacctgcccagcctgtacgactacagcgcctacagaagactgatcgaccagtacggcacccactacctgcagagcggcagcctgggcggcgagtacagagtgctgttctacgtggacagcgagaagctgaagcagaacgacttcaacagcgtggagaagaagaagaagaagaagaagaagaagaagtag

SEQ ID NO: 77495 - DNA, 1755 bp, Artificial Sequence
  Description of Artificial Sequence: Synthetic coding sequence
atgttcgccgtggtgttcttcatcctgagcctgatgacctgccagcccggcgtgaccgcccaggagaaggtgaaccagagagtgagaagagccgccacccccgccgccgtgacctgccagctgagcaactggagcgagtggaccgactgcttcccctgccaggacaagaagtacagacacagaagcctgctgcagcccaacaagttcggcggcaccatctgcagcggcgacatctgggaccaggccagctgcagcagcagcaccacctgcgtgagacaggcccagtgcggccaggacttccagtgcaaggagaccggcagatgcctgaagagacacctggtgtgcaacggcgaccaggactgcctggacggcagcgacgaggacgactgcgaggacgtgagagccatcgacgaggactgcagccagtacgagcccatccccggcagccagaaggccgccctgggctacaacatcctgacccaggaggacgcccagagcgtgtacgacgccagctactacggcggccagtgcgagaccgtgtacaacggcgagtggagagagctgagatacgacagcacctgcgagagactgtactacggcgacgacgagaagtacttcagaaagccctacaacttcctgaagtaccacttcgaggccctggccgacaccggcatcagcagcgagttctacgacaacgccaacgacctgctgagcaaggtgaagaaggacaagagcgacagcttcggcgtgaccatcggcatcggccccgccggcagccccctgctggtgggcgtgggcgtgagccacagccaggacaccagcttcctgaacgagctgaacaagtacaacgagaagaagttcatcttcaccagaatcttcaccaaggtgcagaccgcccacttcaagatgagaaaggacgacatcatgctggacgagggcatgctgcagagcctgatggagctgcccgaccagtacaactacggcatgtacgccaagttcatcaacgactacggcacccactacatcaccagcggcagcatgggcggcatctacgagtacatcctggtgatcgacaaggccaagatggagagcctgggcatcaccagcagagacatcaccacctgcttcggcggcagcctgggcatccagtacgaggacaagatcaacgtgggcggcggcctgagcggcgaccactgcaagaagttcggcggcggcaagaccgagagagccagaaaggccatggccgtggaggacatcatcagcagagtgagaggcggcagcagcggctggagcggcggcctggcccagaacagaagcaccatcacctacagaagctggggcagaagcctgaagtacaaccccgtggtgatcgacttcgagatgcagcccatccacgaggtgctgagacacaccagcctgggccccctggaggccaagagacagaacctgagaagagccctggaccagtacctgatggagttcaacgcctgcagatgcggcccctgcttcaacaacggcgtgcccatcctggagggcaccagctgcagatgccagtgcagactgggcagcctgggcgccgcctgcgagcagacccagaccgagggcgccaaggccgacggcagctggagctgctggagcagctggagcgtgtgcagagccggcatccaggagagaagaagagagtgcgacaaccccgccccccagaacggcggcgccagctgccccggcagaaaggtgcagacccaggcctgctag

SEQ ID NO: 77496 - DNA, 1776 bp, Artificial Sequence
  Description of Artificial Sequence: Synthetic coding sequence
atgaagaacagcagaacctgggcctggagagcccccgtggagctgttcctgctgtgcgccgccctgggctgcctgagcctgcccggcagcagaggcgagagaccccacagcttcggcagcaacgccgtgaacaagagcttcgccaagagcagacagatgagaagcgtggacgtgaccctgatgcccatcgactgcgagctgagcagctggagcagctggaccacctgcgacccctgccagaagaagagatacagatacgcctacctgctgcagcccagccagttccacggcgagccctgcaacttcagcgacaaggaggtggaggactgcgtgaccaacagaccctgcggcagccaggtgagatgcgagggcttcgtgtgcgcccagaccggcagatgcgtgaacagaagactgctgtgcaacggcgacaacgactgcggcgaccagagcgacgaggccaactgcagaagaatctacaagaagtgccagcacgagatggaccagtactggggcatcggcagcctggccagcggcatcaacctgttcaccaacagcttcgagggccccgtgctggaccacagatactacgccggcggctgcagcccccactacatcctgaacaccagattcagaaagccctacaacgtggagagctacaccccccagacccagggcaagtacgagttcatcctgaaggagtacgagagctacagcgacttcgagagaaacgtgaccgagaagatggccagcaagagcggcttcagcttcggcttcaagatccccggcatcttcgagctgggcatcagcagccagagcgacagaggcaagcactacatcagaagaaccaagagattcagccacaccaagagcgtgttcctgcacgccagaagcgacctggaggtggcccactacaagctgaagcccagaagcctgatgctgcactacgagttcctgcagagagtgaagagactgcccctggagtacagctacggcgagtacagagacctgttcagagacttcggcacccactacatcaccgaggccgtgctgggcggcatctacgagtacaccctggtgatgaacaaggaggccatggagagaggcgactacaccctgaacaacgtgcacgcctgcgccaagaacgacttcaagatcggcggcgccatcgaggaggtgtacgtgagcctgggcgtgagcgtgggcaagtgcagaggcatcctgaacgagatcaaggacagaaacaagagagacaccatggtggaggacctggtggtgctggtgagaggcggcgccagcgagcacatcaccaccctggcctaccaggagctgcccaccgccgacctgatgcaggagtggggcgacgccgtgcagtacaaccccgccatcatcaaggtgaaggtggagcccctgtacgagctggtgaccgccaccgacttcgcctacagcagcaccgtgagacagaacatgaagcaggccctggaggagttccagaaggaggtgagcagctgccactgcgccccctgccagggcaacggcgtgcccgtgctgaagggcagcagatgcgactgcatctgccccgtgggcagccagggcctggcctgcgaggtgagctacagaaagaacacccccatcgacggcaagtggaactgctggagcaactggagcagctgcagcggcagaagaaagaccagacagagacagtgcaacaacccccccccccagaacggcggcagcccctgcagcggccccgccagcgagaccctggactgcagctag

SEQ ID NO: 77497 - DNA, 1590 bp, Artificial Sequence
  Description of Artificial Sequence: Synthetic coding sequence
atggacacctgcatgaccctggccttcaccctgagcggcagattcttcatgctgctgagccagtacagatacgcctacctgctgcagcccagccagttccacggcgagccctgcaacttcagcgacaaggaggtggaggactgcgtgaccaacagaccctgcggcagccaggtgagatgcgagggcttcgtgtgcgcccagaccggcagatgcgtgaacagaagactgctgtgcaacggcgacaacgactgcggcgaccagagcgacgaggccaactgcagaagaatctacaagaagtgccagcacgagatggaccagtactggggcatcggcagcctggccagcggcatcaacctgttcaccaacagcttcgagggccccgtgctggaccacagatactacgccggcggctgcagcccccactacatcctgaacaccagattcagaaagccctacaacgtggagagctacaccccccagacccagggcaagtacgagttcatcctgaaggagtacgagagctacagcgacttcgagagaaacgtgaccgagaagatggccagcaagagcggcttcagcttcggcttcaagatccccggcatcttcgagctgggcatcagcagccagagcgacagaggcaagcactacatcagaagaaccaagagattcagccacaccaagagcgtgttcctgcacgccagaagcgacctggaggtggcccactacaagctgaagcccagaagcctgatgctgcactacgagttcctgcagagagtgaagagactgcccctggagtacagctacggcgagtacagagacctgttcagagacttcggcacccactacatcaccgaggccgtgctgggcggcatctacgagtacaccctggtgatgaacaaggaggccatggagagaggcgactacaccctgaacaacgtgcacgcctgcgccaagaacgacttcaagatcggcggcgccatcgaggaggtgtacgtgagcctgggcgtgagcgtgggcaagtgcagaggcatcctgaacgagatcaaggacagaaacaagagagacaccatggtggaggacctggtggtgctggtgagaggcggcgccagcgagcacatcaccaccctggcctaccaggagctgcccaccgccgacctgatgcaggagtggggcgacgccgtgcagtacaaccccgccatcatcaaggtgaaggtggagcccctgtacgagctggtgaccgccaccgacttcgcctacagcagcaccgtgagacagaacatgaagcaggccctggaggagttccagaaggaggtgagcagctgccactgcgccccctgccagggcaacggcgtgcccgtgctgaagggcagcagatgcgactgcatctgccccgtgggcagccagggcctggcctgcgaggtgagctacagaaagaacacccccatcgacggcaagtggaactgctggagcaactggagcagctgcagcggcagaagaaagaccagacagagacagtgcaacaacccccccccccagaacggcggcagcccctgcagcggccccgccagcgagaccctggactgcagctag

SEQ ID NO: 77498 - DNA, 1620 bp, Artificial Sequence
  Description of Artificial Sequence: Synthetic coding sequence
atgagaagcgtggacgtgaccctgatgcccatcgactgcgagctgagcagctggagcagctggaccacctgcgacccctgccagaagaagagatacagatacgcctacctgctgcagcccagccagttccacggcgagccctgcaacttcagcgacaaggaggtggaggactgcgtgaccaacagaccctgcggcagccaggtgagatgcgagggcttcgtgtgcgcccagaccggcagatgcgtgaacagaagactgctgtgcaacggcgacaacgactgcggcgaccagagcgacgaggccaactgcagaagaatctacaagaagtgccagcacgagatggaccagtactggggcatcggcagcctggccagcggcatcaacctgttcaccaacagcttcgagggccccgtgctggaccacagatactacgccggcggctgcagcccccactacatcctgaacaccagattcagaaagccctacaacgtggagagctacaccccccagacccagggcaagtacgagttcatcctgaaggagtacgagagctacagcgacttcgagagaaacgtgaccgagaagatggccagcaagagcggcttcagcttcggcttcaagatccccggcatcttcgagctgggcatcagcagccagagcgacagaggcaagcactacatcagaagaaccaagagattcagccacaccaagagcgtgttcctgcacgccagaagcgacctggaggtggcccactacaagctgaagcccagaagcctgatgctgcactacgagttcctgcagagagtgaagagactgcccctggagtacagctacggcgagtacagagacctgttcagagacttcggcacccactacatcaccgaggccgtgctgggcggcatctacgagtacaccctggtgatgaacaaggaggccatggagagaggcgactacaccctgaacaacgtgcacgcctgcgccaagaacgacttcaagatcggcggcgccatcgaggaggtgtacgtgagcctgggcgtgagcgtgggcaagtgcagaggcatcctgaacgagatcaaggacagaaacaagagagacaccatggtggaggacctggtggtgctggtgagaggcggcgccagcgagcacatcaccaccctggcctaccaggagctgcccaccgccgacctgatgcaggagtggggcgacgccgtgcagtacaaccccgccatcatcaaggtgaaggtggagcccctgtacgagctggtgaccgccaccgacttcgcctacagcagcaccgtgagacagaacatgaagcaggccctggaggagttccagaaggaggtgagcagctgccactgcgccccctgccagggcaacggcgtgcccgtgctgaagggcagcagatgcgactgcatctgccccgtgggcagccagggcctggcctgcgaggtgagctacagaaagaacacccccatcgacggcaagtggaactgctggagcaactggagcagctgcagcggcagaagaaagaccagacagagacagtgcaacaacccccccccccagaacggcggcagcccctgcagcggccccgccagcgagaccctggactgcagctag

SEQ ID NO: 77499 - DNA, 675 bp, Artificial Sequence
  Description of Artificial Sequence: Synthetic coding sequence
atggccacccaccacaccctgtggatgggcctggccctgctgggcgtgctgggcgacctgcaggccgcccccgaggcccaggtgagcgtgcagcccaacttccagcaggacaagttcctgggcagatggttcagcgccggcctggccagcaacagcagctggctgagagagaagaaggccgccctgagcatgtgcaagagcgtggtggcccccgccaccgacggcggcctgaacctgaccagcaccttcctgagaaagaaccagtgcgagaccagaaccatgctgctgcagcccgccggcagcctgggcagctacagctacagaagccccagagagtggggcctgcacagaccccccggccccagcctgggcgccaccctggccggcaccaccctgggccagccccccgccgccgagatccacggcgtgggcgactggggcagcacctacagcgtgagcgtggtggagaccgactacgaccagtacgccctgctgtacagccagggcagcaagggccccggcgaggacttcagaatggccaccctgtacagcagaacccagacccccagagccgagctgaaggagaagttcaccgccttctgcaaggcccagggcttcaccgaggacaccatcgtgttcctgccccagaccgacaagtgcatgaccgagcagtag

SEQ ID NO: 77500 - DNA, 495 bp, Artificial Sequence
  Description of Artificial Sequence: Synthetic coding sequence
atgctgccccccggcaccgccaccctgctgaccctgctgctggccgccggcagcctgggccagaagccccagagacccagaagacccgccagccccatcagcaccatccagcccaaggccaacttcgacgcccagcagttcgccggcacctggctgctggtggccgtgggcagcgcctgcagattcctgcaggagcagggccacagagccgaggccaccaccctgcacgtggccccccagggcaccgccatggccgtgagcaccttcagaaagctggacggcatctgctggcaggtgagacagctgtacggcgacaccggcgtgctgggcagattcctgctgcaggccagagacgccagaggcgccgtgcacgtggtggtggccgagaccgactaccagagcttcgccgtgctgtacctggagagagccggccagctgagcgtgaagctgtacggcgcccagggcgtggtgaccgacagacccggcgtgggctag

SEQ ID NO: 77501 - DNA, 1680 bp, Artificial Sequence
  Description of Artificial Sequence: Synthetic coding sequence
atgagcgcctgcagaagcttcgccgtggccatctgcatcctggagatcagcatcctgaccgcccagtacaccaccagctacgaccccgagctgaccgagagcagcggcagcgccagccacatcgactgcagaatgagcccctggagcgagtggagccagtgcgacccctgcctgagacagatgttcagaagcagaagcatcgaggtgttcggccagttcaacggcaagagatgcaccgacgccgtgggcgacagaagacagtgcgtgcccaccgagccctgcgaggacgccgaggacgactgcggcaacgacttccagtgcagcaccggcagatgcatcaagatgagactgagatgcaacggcgacaacgactgcggcgacttcagcgacgaggacgactgcgagagcgagcccagacccccctgcagagacagagtggtggaggagagcgagctggccagaaccgccggctacggcatcaacatcctgggcatggaccccctgagcacccccttcgacaacgagttctacaacggcctgtgcaacagagacagagacggcaacaccctgacctactacagaagaccctggaacgtggccagcctgatctacgagaccaagggcgagaagaacttcagaaccgagcactacgaggagcagatcgaggccttcaagagcatcatccaggagaagaccagcaacttcaacgccgccatcagcctgaagttcacccccaccgagaccaacaaggccgagcagtgctgcgaggagaccgccagcagcatcagcctgcacggcaagggcagcttcagattcagctacagcaagaacgagacctaccagctgttcctgagctacagcagcaagaaggagaagatgttcctgcacgtgaagggcgagatccacctgggcagattcgtgatgagaaacagagacgtggtgctgaccaccaccttcgtggacgacatcaaggccctgcccaccacctacgagaagggcgagtacttcgccttcctggagacctacggcacccactacagcagcagcggcagcctgggcggcctgtacgagctgatctacgtgctggacaaggccagcatgaagagaaagggcgtggagctgaaggacatcaagagatgcctgggctaccacctggacgtgagcctggccttcagcgagatcagcgtgggcgccgagttcaacaaggacgactgcgtgaagagaggcgagggcagagccgtgaacatcaccagcgagaacctgatcgacgacgtggtgagcctgatcagaggcggcaccagaaagtacgccttcgagctgaaggagaagctgctgagaggcaccgtgatcgacgtgaccgacttcgtgaactgggccagcagcatcaacgacgcccccgtgctgatcagccagaagctgagccccatctacaacctggtgcccgtgaagatgaagaacgcccacctgaagaagcagaacctggagagagccatcgaggactacatcaacgagttcagcgtgagaaagtgccacacctgccagaacggcggcaccgtgatcctgatggacggcaagtgcctgtgcgcctgccccttcaagttcgagggcatcgcctgcgagatcagcaagcagaagatcagcgagggcctgcccgccctggagttccccaacgagaagtag

SEQ ID NO: 77502 - DNA, 1770 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggcccagccccagggcagctgcagcctggagggcgtggagatcaagggcggcagcttcagactgctgcaggagggccaggccctggagtacgtgtgccccagcggcttctacccctaccccgtgcagaccagaacctgcagaagcaccggcagctggagcaccctgaagacccaggaccagaagaccgtgagaaaggccgagtgcagagccatccactgccccagaccccacgacttcgagaacggcgagtactggcccagaagcccctactacaacgtgagcgacgagatcagcttccactgctacgacggctacaccctgagaggcagcgccaacagaacctgccaggtgaacggcagatggagcggccagaccgccatctgcgacaacggcgccggctactgcagcaaccccggcatccccatcggcaccagaaaggtgggcagccagtacagactggaggacagcgtgacctaccactgcagcagaggcctgaccctgagaggcagccagagaagaacctgccaggagggcggcagctggagcggcaccgagcccagctgccaggacagcttcatgtacgacaccccccaggaggtggccgaggccttcctgagcagcctgaccgagaccatcgagggcgtggacgccgaggacggccacggccccggcgagcagcagaagagaaagatcgtgctggaccccagcggcagcatgaacatctacctggtgctggacggcagcgacagcatcggcgccagcaacttcaccggcgccaagaagtgcctggtgaacctgatcgagaaggtggccagctacggcgtgaagcccagatacggcctggtgacctacgccacctaccccaagatctgggtgaaggtgagcgaggccgacagcagcaacgccgactgggtgaccaagcagctgaacgagatcaactacgaggaccacaagctgaagagcggcaccaacaccaagaaggccctgcaggccgtgtacagcatgatgagctggcccgacgacgtgccccccgagggctggaacagaaccagacacgtgatcatcctgatgaccgacggcctgcacaacatgggcggcgaccccatcaccgtgatcgacgagatcagagacctgctgtacatcggcaaggacagaaagaaccccagagaggactacctggacgtgtacgtgttcggcgtgggccccctggtgaaccaggtgaacatcaacgccctggccagcaagaaggacaacgagcagcacgtgttcaaggtgaaggacatggagaacctggaggacgtgttctaccagatgatcgacgagagccagagcctgagcctgtgcggcatggtgtgggagcacagaaagggcaccgactaccacaagcagccctggcaggccaagatcagcgtgatcagacccagcaagggccacgagagctgcatgggcgccgtggtgagcgagtacttcgtgctgaccgccgcccactgcttcaccgtggacgacaaggagcacagcatcaaggtgagcgtgggcggcgagaagagagacctggagatcgaggtggtgctgttccaccccaactacaacatcaacggcaagaaggaggccggcatccccgagttctacgactacgacgtggccctgatcaagctgaagaacaagctgaagtacggctag

SEQ ID NO: 77503 - DNA, 1770 bp, Artificial Sequence; identical to SEQ ID NO: 77502
  Description of Artificial Sequence: Synthetic coding sequence

SEQ ID NO: 77504 - DNA, 2295 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggccagaccccagggcagctgcagcctggagggcgtggagatcaagggcggcagcttcagactgctgcaggagggccaggccctggagtacgtgtgccccagcggcttctacccctaccccgtgcagaccagaacctgcagaagcaccggcagctggagcaccctgaagacccaggaccagaagaccgtgagaaaggccgagtgcagagccatccactgccccagaccccacgacttcgagaacggcgagtactggcccagaagcccctactacaacgtgagcgacgagatcagcttccactgctacgacggctacaccctgagaggcagcgccaacagaacctgccaggtgaacggcagatggagcggccagaccgccatctgcgacaacggcgccggctactgcagcaaccccggcatccccatcggcaccagaaaggtgggcagccagtacagactggaggacagcgtgacctaccactgcagcagaggcctgaccctgagaggcagccagagaagaacctgccaggagggcggcagctggagcggcaccgagcccagctgccaggacagcttcatgtacgacaccccccaggaggtggccgaggccttcctgagcagcctgaccgagaccatcgagggcgtggacgccgaggacggccacggccccggcgagcagcagaagagaaagatcgtgctggaccccagcggcagcatgaacatctacctggtgctggacggcagcgacagcatcggcgccagcaacttcaccggcgccaagaagtgcctggtgaacctgatcgagaaggtggccagctacggcgtgaagcccagatacggcctggtgacctacgccacctaccccaagatctgggtgaaggtgagcgaggccgacagcagcaacgccgactgggtgaccaagcagctgaacgagatcaactacgaggaccacaagctgaagagcggcaccaacaccaagaaggccctgcaggccgtgtacagcatgatgagctggcccgacgacgtgccccccgagggctggaacagaaccagacacgtgatcatcctgatgaccgacggcctgcacaacatgggcggcgaccccatcaccgtgatcgacgagatcagagacctgctgtacatcggcaaggacagaaagaaccccagagaggactacctggacgtgtacgtgttcggcgtgggccccctggtgaaccaggtgaacatcaacgccctggccagcaagaaggacaacgagcagcacgtgttcaaggtgaaggacatggagaacctggaggacgtgttctaccagatgatcgacgagagccagagcctgagcctgtgcggcatggtgtgggagcacagaaagggcaccgactaccacaagcagccctggcaggccaagatcagcgtgatcagacccagcaagggccacgagagctgcatgggcgccgtggtgagcgagtacttcgtgctgaccgccgcccactgcttcaccgtggacgacaaggagcacagcatcaaggtgagcgtgggcggcgagaagagagacctggagatcgaggtggtgctgttccaccccaactacaacatcaacggcaaggaggaggccggcatccccgagttctacgactacgacgtggccctgatcaagctgaagaacaagctgaagtacggccagaccatcagacccatctgcctgccctgcaccgagggcaccaccagagccctgagactgccccccaccaccacctgccagcagcagaaggaggagctgctgcccgcccaggacatcaaggccctgttcgtgagcgaggaggagaagaagctgaccagaaaggaggtgtacatcaagaacggcgacaagaagggcagctgcgagagagacgcccagtacgcccccggctacgacaaggtgaaggacatcagcgaggtggtgacccccagattcctgtgcaccggcggcgtgagcccctacgccgaccccaacacctgcagaggcgacagcggcggccccctgatcgtgcacaagagaagcagattcatccaggtgggcgtgatcagctggggcgtggtggacgtgtgcaagaaccagaagagacagaagcaggtgcccgcccacgccagagacttccacatcaacctgttccaggtgctgccctggctgaaggagaagctgcaggacgaggacctgggcttcctgtag

SEQ ID NO: 77505 - DNA, 2295 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggccagaccccagggcagctgcagcctggagggcgtggagatcaagggcggcagcttcagactgctgcaggagggccaggccctggagtacgtgtgccccagcggcttctacccctaccccgtgcagaccagaacctgcagaagcaccggcagctggagcaccctgaagacccaggaccagaagaccgtgagaaaggccgagtgcagagccatccactgccccagaccccacgacttcgagaacggcgagtactggcccagaagcccctactacaacgtgagcgacgagatcagcttccactgctacgacggctacaccctgagaggcagcgccaacagaacctgccaggtgaacggcagatggagcggccagaccgccatctgcgacaacggcgccggctactgcagcaaccccggcatccccatcggcaccagaaaggtgggcagccagtacagactggaggacagcgtgacctaccactgcagcagaggcctgaccctgagaggcagccagagaagaacctgccaggagggcggcagctggagcggcaccgagcccagctgccaggacagcttcatgtacgacaccccccaggaggtggccgaggccttcctgagcagcctgaccgagaccatcgagggcgtggacgccgaggacggccacggccccggcgagcagcagaagagaaagatcgtgctggaccccagcggcagcatgaacatctacctggtgctggacggcagcgacagcatcggcgccagcaacttcaccggcgccaagaagtgcctggtgaacctgatcgagaaggtggccagctacggcgtgaagcccagatacggcctggtgacctacgccacctaccccaagatctgggtgaaggtgagcgaggccgacagcagcaacgccgactgggtgaccaagcagctgaacgagatcaactacgaggaccacaagctgaagagcggcaccaacaccaagaaggccctgcaggccgtgtacagcatgatgagctggcccgacgacgtgccccccgagggctggaacagaaccagacacgtgatcatcctgatgaccgacggcctgcacaacatgggcggcgaccccatcaccgtgatcgacgagatcagagacctgctgtacatcggcaaggacagaaagaaccccagagaggactacctggacgtgtacgtgttcggcgtgggccccctggtgaaccaggtgaacatcaacgccctggccagcaagaaggacaacgagcagcacgtgttcaaggtgaaggacatggagaacctggaggacgtgttctaccagatgatcgacgagagccagagcctgagcctgtgcggcatggtgtgggagcacagaaagggcaccgactaccacaagcagccctggcaggccaagatcagcgtgatcagacccagcaagggccacgagagctgcatgggcgccgtggtgagcgagtacttcgtgctgaccgccgcccactgcttcaccgtggacgacaaggagcacagcatcaaggtgagcgtgggcggcgagaagagagacctggagatcgaggtggtgctgttccaccccaactacaacatcaacggcaagaaggaggccggcatccccgagttctacgactacgacgtggccctgatcaagctgaagaacaagctgaagtacggccagaccatcagacccatctgcctgccctgcaccgagggcaccaccagagccctgagactgccccccaccaccacctgccagcagcagaaggaggagctgctgcccgcccaggacatcaaggccctgttcgtgagcgaggaggagaagaagctgaccagaaaggaggtgtacatcaagaacggcgacaagaagggcagctgcgagagagacgcccagtacgcccccggctacgacaaggtgaaggacatcagcgaggtggtgacccccagattcctgtgcaccggcggcgtgagcccctacgccgaccccaacacctgcagaggcgacagcggcggccccctgatcgtgcacaagagaagcagattcatccaggtgggcgtgatcagctggggcgtggtggacgtgtgcaagaaccagaagagacagaagcaggtgcccgcccacgccagagacttccacatcaacctgttccaggtgctgccctggctgaaggagaagctgcaggacgaggacctgggcttcctgtag

SEQ ID NO: 77506 - DNA, 2295 bp, Artificial Sequence; identical to SEQ ID NO: 77505
  Description of Artificial Sequence: Synthetic coding sequence

SEQ ID NO: 77507 - DNA, 2295 bp, Artificial Sequence; identical to SEQ ID NO: 77504
  Description of Artificial Sequence: Synthetic coding sequence

SEQ ID NO: 77508 - DNA, 2295 bp, Artificial Sequence; identical to SEQ ID NO: 77505
  Description of Artificial Sequence: Synthetic coding sequence

SEQ ID NO: 77509 - DNA, 2295 bp, Artificial Sequence; identical to SEQ ID NO: 77505
  Description of Artificial Sequence: Synthetic coding sequence

SEQ ID NO: 77510 - DNA, 2295 bp, Artificial Sequence; identical to SEQ ID NO: 77505
  Description of Artificial Sequence: Synthetic coding sequence

SEQ ID NO: 77511 - DNA, 2295 bp, Artificial Sequence; identical to SEQ ID NO: 77505
  Description of Artificial Sequence: Synthetic coding sequence

SEQ ID NO: 77512 - DNA, 2295 bp, Artificial Sequence; identical to SEQ ID NO: 77505
  Description of Artificial Sequence: Synthetic coding sequence

SEQ ID NO: 77513 - DNA, 2295 bp, Artificial Sequence; identical to SEQ ID NO: 77505
  Description of Artificial Sequence: Synthetic coding sequence

SEQ ID NO: 77514 - DNA, 2295 bp, Artificial Sequence; identical to SEQ ID NO: 77505
  Description of Artificial Sequence: Synthetic coding sequence

SEQ ID NO: 77515 - DNA, 435 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggccagaccccagggcagctgcagcctggagggcgtggagatcaagggcggcagcttcagactgctgcaggagggccaggccctggagtacgtgtgccccagcggcttctacccctaccccgtgcagaccagaacctgcagaagcaccggcagctggagcaccctgaagacccaggaccagaagaccgtgagaaaggccgagtgcagagccatccactgccccagaccccacgacttcgagaacggcgagtactggcccagaagcccctactacaacgtgagcgacgagatcagcttccactgctacgacggctacaccctgagaggcagcgccaacagaacctag

SEQ ID NO: 77516 - DNA, 3801 bp, Artificial Sequence
  Description of Artificial Sequence: Synthetic coding sequence
atgggccccctgatggtgctgttctgcctgctgttcctgtaccccggcctggccgacagcgcccccagctgcccccagaacgtgaacatcagcggcggcaccttcaccctgagccacggctgggcccccggcagcctgctgacctacagctgcccccagggcctgtaccccagccccgccagcagactgtgcaagagcagcggccagtggcagacccccggcgccaccagaagcctgagcaaggccgtgtgcaagcccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcgtgaccaccaccccctggagcctggccagaccccagggcagctgcagcctggagggcgtggagatcaagggcggcagcttcagactgctgcaggagggccaggccctggagtacgtgtgccccagcggcttctacccctaccccgtgcagaccagaacctgcagaagcaccggcagctggagcaccctgaagacccaggaccagaagaccgtgagaaaggccgagtgcagagccatccactgccccagaccccacgacttcgagaacggcgagtactggcccagaagcccctactacaacgtgagcgacgagatcagcttccactgctacgacggctacaccctgagaggcagcgccaacagaacctgccaggtgaacggcagatggagcggccagaccgccatctgcgacaacggcgccggctactgcagcaaccccggcatccccatcggcaccagaaaggtgggcagccagtacagactggaggacagcgtgacctaccactgcagcagaggcctgaccctgagaggcagccagagaagaacctgccaggagggcggcagctggagcggcaccgagcccagctgccaggacagcttcatgtacgacaccccccaggaggtggccgaggccttcctgagcagcctgaccgagaccatcgagggcgtggacgccgaggacggccacggccccggcgagcagcagaagagaaagatcgtgctggaccccagcggcagcatgaacatctacctggtgctggacggcagcgacagcatcggcgccagcaacttcaccggcgccaagaagtgcctggtgaacctgatcgagaaggtggccagctacggcgtgaagcccagatacggcctggtgacctacgccacctaccccaagatctgggtgaaggtgagcgaggccgacagcagcaacgccgactgggtgaccaagcagctgaacgagatcaactacgaggaccacaagctgaagagcggcaccaacaccaagaaggccctgcaggccgtgtacagcatgatgagctggcccgacgacgtgccccccgagggctggaacagaaccagacacgtgatcatcctgatgaccgacggcctgcacaacatgggcggcgaccccatcaccgtgatcgacgagatcagagacctgctgtacatcggcaaggacagaaagaaccccagagaggactacctggacgtgtacgtgttcggcgtgggccccctggtgaaccaggtgaacatcaacgccctggccagcaagaaggacaacgagcagcacgtgttcaaggtgaaggacatggagaacctggaggacgtgttctaccagatgatcgacgagagccagagcctgagcctgtgcggcatggtgtgggagcacagaaagggcaccgactaccacaagcagccctggcaggccaagatcagcgtgatcagacccagcaagggccacgagagctgcatgggcgccgtggtgagcgagtacttcgtgctgaccgccgcccactgcttcaccgtggacgacaaggagcacagcatcaaggtgagcgtgggcggcgagaagagagacctggagatcgaggtggtgctgttccaccccaactacaacatcaacggcaagaaggaggccggcatccccgagttctacgactacgacgtggccctgatcaagctgaagaacaagctgaagtacggccagaccatcagacccatctgcctgccctgcaccgagggcaccaccagagccctgagactgccccccaccaccacctgccagcagcagaaggaggagctgctgcccgcccaggacatcaaggccctgttcgtgagcgaggaggagaagaagctgaccagaaaggaggtgtacatcaagaacggcgacaagaagggcagctgcgagagagacgcccagtacgcccccggctacgacaaggtgaaggacatcagcgaggtggtgacccccagattcctgtgcaccggcggcgtgagcccctacgccgaccccaacacctgcagaggcgacagcggcggccccctgatcgtgcacaagagaagcagattcatccaggtgggcgtgatcagctggggcgtggtggacgtgtgcaagaaccagaagagacagaagcaggtgcccgcccacgccagagacttccacatcaacctgttccaggtgctgccctggctgaaggagaagctgcaggacgaggacctgggcttcctgtag

SEQ ID NO: 77517 - DNA, 3801 bp, Artificial Sequence
  Description of Artificial Sequence: Synthetic coding sequence
atgggccccctgatggtgctgttctgcctgctgttcctgtaccccggcctggccgacagcgcccccagctgcccccagaacgtgaacatcagcggcggcaccttcaccctgagccacggctgggcccccggcagcctgctgacctacagctgcccccagggcctgtaccccagccccgccagcagactgtgcaagagcagcggccagtggcagacccccggcgccaccagaagcctgagcaaggccgtgtgcaagcccggccactgccccaaccccggcatcagcctgggcgccgtgagaaccggcttcagattcggccacggcgacaaggtgagatacagatgcagcagcaacctggtgctgaccggcagcagcgagagagagtgccagggcaacggcgtgtggagcggcaccgagcccatctgcagacagccctacagctacgacttccccgaggacgtggcccccgccctgggcaccagcttcagccacatgctgggcgccaccaaccccacccagaagaccaaggaccacgagaacggcaccggcaccaacacctacgccgccctgaacagcgtgtacctgatgatgaacaaccagatgagactgctgggcatggagaccatggcctggcaggagatcagacacgccatcatcctgctgaccgacggcaagagcaacatgggcggcagccccaagaccgccgtggaccacatcagagagatcctgaacatcaaccagaagagaaacgactacctggacatctacgccatcggcgtgggcaagctggacgtggactggagagagctgaacgagctgggcagcaagaaggacggcgagagacacgccttcatcctgcaggacaccaaggccctgcaccaggtgttcgagcacatgctggacgtgagcaagctgaccgacaccatctgcggcgtgggcaacatgagcgccaacgccagcgaccaggagagaaccccctggcacgtgaccatcaagcccaagagccaggagacctgcagaggcgccctgatcagcgaccagtgggtgctgaccgccgcccactgcttcagagacggcaacgaccacagcctgtggagagtgaacgtgggcgaccccaagagccagtggggcaaggagttcctgatcgagaaggccgtgatcagccccggcttcgacgtgttcgccaagaagaaccagggcatcctggagttctacggcgacgacatcgccctgctgaagctggcccagaaggtgaagatgagcacccacgccagacccatctgcctgccctgcaccatggaggccaacctggccctgagaagaccccagggcagcacctgcagagaccacgagaacgagctgctgaacaagcagagcgtgcccgcccacttcgtggccctgaacggcagcaagctgaacatcaacctgaagatgggcgtggagtggaccagctgcgccgaggtggtgagccaggagaagaccatgttccccaacctgaccgacgtgagagaggtggtgaccgaccagttcctgtgcagcggcacccaggaggacgagagcccctgcaagggcgtgaccaccaccccctggagcctggccagaccccagggcagctgcagcctggagggcgtggagatcaagggcggcagcttcagactgctgcaggagggccaggccctggagtacgtgtgccccagcggcttctacccctaccccgtgcagaccagaacctgcagaagcaccggcagctggagcaccctgaagacccaggaccagaagaccgtgagaaaggccgagtgcagagccatccactgccccagaccccacgacttcgagaacggcgagtactggcccagaagcccctactacaacgtgagcgacgagatcagcttccactgctacgacggctacaccctgagaggcagcgccaacagaacctgccaggtgaacggcagatggagcggccagaccgccatctgcgacaacggcgccggctactgcagcaaccccggcatccccatcggcaccagaaaggtgggcagccagtacagactggaggacagcgtgacctaccactgcagcagaggcctgaccctgagaggcagccagagaagaacctgccaggagggcggcagctggagcggcaccgagcccagctgccaggacagcttcatgtacgacaccccccaggaggtggccgaggccttcctgagcagcctgaccgagaccatcgagggcgtggacgccgaggacggccacggccccggcgagcagcagaagagaaagatcgtgctggaccccagcggcagcatgaacatctacctggtgctggacggcagcgacagcatcggcgccagcaacttcaccggcgccaagaagtgcctggtgaacctgatcgagaaggtggccagctacggcgtgaagcccagatacggcctggtgacctacgccacctaccccaagatctgggtgaaggtgagcgaggccgacagcagcaacgccgactgggtgaccaagcagctgaacgagatcaactacgaggaccacaagctgaagagcggcaccaacaccaagaaggccctgcaggccgtgtacagcatgatgagctggcccgacgacgtgccccccgagggctggaacagaaccagacacgtgatcatcctgatgaccgacggcctgcacaacatgggcggcgaccccatcaccgtgatcgacgagatcagagacctgctgtacatcggcaaggacagaaagaaccccagagaggactacctggacgtgtacgtgttcggcgtgggccccctggtgaaccaggtgaacatcaacgccctggccagcaagaaggacaacgagcagcacgtgttcaaggtgaaggacatggagaacctggaggacgtgttctaccagatgatcgacgagagccagagcctgagcctgtgcggcatggtgtgggagcacagaaagggcaccgactaccacaagcagccctggcaggccaagatcagcgtgatcagacccagcaagggccacgagagctgcatgggcgccgtggtgagcgagtacttcgtgctgaccgccgcccactgcttcaccgtggacgacaaggagcacagcatcaaggtgagcgtgggcggcgagaagagagacctggagatcgaggtggtgctgttccaccccaactacaacatcaacggcaaggaggaggccggcatccccgagttctacgactacgacgtggccctgatcaagctgaagaacaagctgaagtacggccagaccatcagacccatctgcctgccctgcaccgagggcaccaccagagccctgagactgccccccaccaccacctgccagcagcagaaggaggagctgctgcccgcccaggacatcaaggccctgttcgtgagcgaggaggagaagaagctgaccagaaaggaggtgtacatcaagaacggcgacaagaagggcagctgcgagagagacgcccagtacgcccccggctacgacaaggtgaaggacatcagcgaggtggtgacccccagattcctgtgcaccggcggcgtgagcccctacgccgaccccaacacctgcagaggcgacagcggcggccccctgatcgtgcacaagagaagcagattcatccaggtgggcgtgatcagctggggcgtggtggacgtgtgcaagaaccagaagagacagaagcaggtgcccgcccacgccagagacttccacatcaacctgttccaggtgctgccctggctgaaggagaagctgcaggacgaggacctgggcttcctgtag

SEQ ID NO: 77518 - DNA, 3801 bp, Artificial Sequence; identical to SEQ ID NO: 77516
  Description of Artificial Sequence: Synthetic coding sequence

SEQ ID NO: 77519 - DNA, 3801 bp, Artificial Sequence; identical to SEQ ID NO: 77516
  Description of Artificial Sequence: Synthetic coding sequence

SEQ ID NO: 77520 - DNA, 3801 bp, Artificial Sequence; identical to SEQ ID NO: 77516
  Description of Artificial Sequence: Synthetic coding sequence

SEQ ID NO: 77521 - DNA, 3801 bp, Artificial Sequence; identical to SEQ ID NO: 77516
  Description of Artificial Sequence: Synthetic coding sequence

SEQ ID NO: 77522 - DNA, 762 bp, Artificial Sequence
  Description of Artificial Sequence: Synthetic coding sequence
atgcacagctgggagagactggccgtgctggtgctgctgggcgccgccgcctgcgccgccccccccagaggcagaatcctgggcggcagagaggccgaggcccacgccagaccctacatggccagcgtgcagctgaacggcgcccacctgtgcggcggcgtgctggtggccgagcagtgggtgctgagcgccgcccactgcctggaggacgccgccgacggcaaggtgcaggtgctgctgggcgcccacagcctgagccagcccgagcccagcaagagactgtacgacgtgctgagagccgtgccccaccccgacagccagcccgacaccatcgaccacgacctgctgctgctgcagctgagcgagaaggccaccctgggccccgccgtgagacccctgccctggcagagagtggacagagacgtggcccccggcaccctgtgcgacgtggccggctggggcatcgtgaaccacgccggcagaagacccgacagcctgcagcacgtgctgctgcccgtgctggacagagccacctgcaacagaagaacccaccacgacggcgccatcaccgagagactgatgtgcgccgagagcaacagaagagacagctgcaagggcgacagcggcggccccctggtgtgcggcggcgtgctggagggcgtggtgaccagcggcagcagagtgtgcggcaacagaaagaagcccggcatctacaccagagtggccagctacgccgcctggatcgacagcgtgctggcctag

SEQ ID NO: 77523 - DNA, 993 bp, Artificial Sequence
  Description of Artificial Sequence: Synthetic coding sequence
atgtggctgctggtgagcgtgatcctgatcagcagaatcagcagcgtgggcggcgaggccaccttctgcgacttccccaagatcaaccacggcatcctgtacgacgaggagaagtacaagcccttcagccaggtgcccaccggcgaggtgttctactacagctgcgagtacaacttcgtgagccccagcaagagcttctggaccagaatcacctgcaccgaggagggctggagccccacccccaagtgcctgagactgtgcttcttccccttcgtggagaacggccacagcgagagcagcggccagacccacctggagggcgacaccgtgcagatcatctgcaacaccggctacagactgcagaacaacgagaacaacatcagctgcgtggagagaggctggagcaccccccccaagtgcagaagcaccgacaccagctgcgtgaacccccccaccgtgcagaacgcccacatcctgagcagacagatgagcaagtaccccagcggcgagagagtgagatacgagtgcagaagcccctacgagatgttcggcgacgaggaggtgatgtgcctgaacggcaactggaccgagcccccccagtgcaaggacagcaccggcaagtgcggcccccccccccccatcgacaacggcgacatcaccagcttccccctgagcgtgtacgcccccgccagcagcgtggagtaccagtgccagaacctgtaccagctggagggcaacaagagaatcacctgcagaaacggccagtggagcgagccccccaagtgcctgcacccctgcgtgatcagcagagagatcatggagaactacaacatcgccctgagatggaccgccaagcagaagctgtacctgagaaccggcgagagcgccgagttcgtgtgcaagagaggctacagactgagcagcagaagccacaccctgagaaccacctgctgggacggcaagctggagtaccccacctgcgccaagagatag

SEQ ID NO: 77524 - DNA, 813 bp, Artificial Sequence
  Description of Artificial Sequence: Synthetic coding sequence
atgtggctgctggtgagcgtgatcctgatcagcagaatcagcagcgtgggcggcgaggccatgttctgcgacttccccaagatcaaccacggcatcctgtacgacgaggagaagtacaagcccttcagccaggtgcccaccggcgaggtgttctactacagctgcgagtacaacttcgtgagccccagcaagagcttctggaccagaatcacctgcgccgaggagggctggagccccacccccaagtgcctgagactgtgcttcttccccttcgtggagaacggccacagcgagagcagcggccagacccacctggagggcgacaccgtgcagatcatctgcaacaccggctacagactgcagaacaacgagaacaacatcagctgcgtggagagaggctggagcaccccccccaagtgcagaagcaccatcagcgccgagaagtgcggcccccccccccccatcgacaacggcgacatcaccagcttcctgctgagcgtgtacgcccccggcagcagcgtggagtaccagtgccagaacctgtaccagctggagggcaacaaccagatcacctgcagaaacggccagtggagcgagccccccaagtgcctggacccctgcgtgatcagccaggagatcatggagaagtacaacatcaagctgaagtggaccaaccagcagaagctgtacagcagaaccggcgacatcgtggagttcgtgtgcaagagcggctaccaccccaccaagagccacagcttcagagccatgtgccagaacggcaagctggtgtaccccagctgcgaggagaagtag

SEQ ID NO: 77525 - DNA, 813 bp, Artificial Sequence; identical to SEQ ID NO: 77524
  Description of Artificial Sequence: Synthetic coding sequence

SEQ ID NO: 77526 - DNA, 993 bp, Artificial Sequence
  Description of Artificial Sequence: Synthetic coding sequence
atgctgctgctgatcaacgtgatcctgaccctgtgggtgagctgcgccaacggccaggtgaagccctgcgacttccccgacatcaagcacggcggcctgttccacgagaacatgagaagaccctacttccccgtggccgtgggcaagtactacagctactactgcgacgagcacttcgagacccccagcggcagctactgggactacatccactgcacccagaacggctggagccccgccgtgccctgcctgagaaagtgctacttcccctacctggagaacggctacaaccagaactacggcagaaagttcgtgcagggcaacagcaccgaggtggcctgccaccccggctacggcctgcccaaggcccagaccaccgtgacctgcaccgagaagggctggagccccacccccagatgcatcagagtgagaacctgcagcaagagcgacatcgagatcgagaacggcttcatcagcgagagcagcagcatctacatcctgaacaaggagatccagtacaagtgcaagcccggctacgccaccgccgacggcaacagcagcggcagcatcacctgcctgcagaacggctggagcgcccagcccatctgcatcaacagcagcgagaagtgcggcccccccccccccatcagcaacggcgacaccaccagcttcctgctgaaggtgtacgtgccccagagcagagtggagtaccagtgccagccctactacgagctgcagggcagcaactacgtgacctgcagcaacggcgagtggagcgagccccccagatgcatccacccctgcatcatcaccgaggagaacatgaacaagaacaacatcaagctgaagggcagaagcgacagaaagtactacgccaagaccggcgacaccatcgagttcatgtgcaagctgggctacaacgccaacaccagcatcctgagcttccaggccgtgtgcagagagggcatcgtggagtaccccagatgcgagtag

SEQ ID NO: 77527 - DNA, 588 bp, Artificial Sequence
  Description of Artificial Sequence: Synthetic coding sequence
atgctgctgctgatcaacgtgatcctgaccctgtgggtgagctgcgccaacggccaggtgaagccctgcgacttccccgacatcaagcacggcggcctgttccacgagaacatgagaagaccctacttccccgtggccgtgggcaagtactacagctactactgcgacgagcacttcgagacccccagcggcagctactgggactacatccactgcacccagaacggctggagccccgccgtgccctgcctgagaaagtgctacttcccctacctggagaacggctacaaccagaactacggcagaaagttcgtgcagggcaacagcaccgaggtggcctgccaccccggctacggcctgcccaaggcccagaccaccgtgacctgcaccgagaagggctggagccccacccccagatgcatcagagtgagaacctgcagcaagagcgacatcgagatcgagaacggcttcatcagcgagagcagcagcatctacatcctgaacaaggagatccagtacaagtgcaagcccggctacgccaccgccgacggcaacagcagcgacatggtgttctgcatcagctactag

SEQ ID NO: 77528 - DNA, 810 bp, Artificial Sequence
  Description of Artificial Sequence: Synthetic coding sequence
atgctgctgctgatcaacgtgatcctgaccctgtgggtgagctgcgccaacggccaggtgaagccctgcgacttccccgacatcaagcacggcggcctgttccacgagaacatgagaagaccctacttccccgtggccgtgggcaagtactacagctactactgcgacgagcacttcgagacccccagcggcagctactgggactacatccactgcacccagaacggctggagccccgccgtgccctgcctgagaaagtgctacttcccctacctggagaacggctacaaccagaactacggcagaaagttcgtgcagggcaacagcaccgaggtggcctgccaccccggctacggcctgcccaaggcccagaccaccgtgacctgcaccgagaagggctggagccccacccccagatgcatcagagtgaacagcagcgagaagtgcggcccccccccccccatcagcaacggcgacaccaccagcttcctgctgaaggtgtacgtgccccagagcagagtggagtaccagtgccagccctactacgagctgcagggcagcaactacgtgacctgcagcaacggcgagtggagcgagccccccagatgcatccacccctgcatcatcaccgaggagaacatgaacaagaacaacatcaagctgaagggcagaagcgacagaaagtactacgccaagaccggcgacaccatcgagttcatgtgcaagctgggctacaacgccaacaccagcatcctgagcttccaggccgtgtgcagagagggcatcgtggagtaccccagatgcgagtag

SEQ ID NO: 77529 - DNA, 996 bp, Artificial Sequence
  Description of Artificial Sequence: Synthetic coding sequence
atgctgctgctgatcaacgtgatcctgaccctgtgggtgagctgcgccaacggccaggaggtgaagccctgcgacttccccgagatccagcacggcggcctgtactacaagagcctgagaagactgtacttccccgccgccgccggccagagctacagctactactgcgaccagaacttcgtgacccccagcggcagctactgggactacatccactgcacccaggacggctggagccccaccgtgccctgcctgagaacctgcagcaagagcgacatcgagatcgagaacggcttcatcagcgagagcagcagcatctacatcctgaacaaggagatccagtacaagtgcaagcccggctacgccaccgccgacggcaacagcagcggcagcatcacctgcctgcagaacggctggagcgcccagcccatctgcatcaagttctgcgacatgcccgtgttcgagaacagcagagccaagagcaacggcatgagattcaagctgcacgacaccctggactacgagtgctacgacggctacgagatcagctacggcaacaccaccggcagcatcgtgtgcggcgaggacggctggagccacttccccacctgctacaacagcagcgagaagtgcggcccccccccccccatcagcaacggcgacaccaccagcttcctgctgaaggtgtacgtgccccagagcagagtggagtaccagtgccagagctactacgagctgcagggcagcaactacgtgacctgcagcaacggcgagtggagcgagccccccagatgcatccacccctgcatcatcaccgaggagaacatgaacaagaacaacatccagctgaagggcaagagcgacatcaagtactacgccaagaccggcgacaccatcgagttcatgtgcaagctgggctacaacgccaacaccagcgtgctgagcttccaggccgtgtgcagagagggcatcgtggagtaccccagatgcgagtag

SEQ ID NO: 77530 - DNA, 1734 bp, Artificial Sequence
  Description of Artificial Sequence: Synthetic coding sequence
atgctgctgctgatcaacgtgatcctgaccctgtgggtgagctgcgccaacggccaggtgaagccctgcgacttccccgagatccagcacggcggcctgtactacaagagcctgagaagactgtacttccccgccgccgccggccagagctacagctactactgcgaccagaacttcgtgacccccagcggcagctactgggactacatccactgcacccaggacggctggagccccaccgtgccctgcctgagaacctgcagcaagagcgacgtggagatcgagaacggcttcatcagcgagagcagcagcatctacatcctgaacgaggagacccagtacaactgcaagcccggctacgccaccgccgagggcaacagcagcggcagcatcacctgcctgcagaacggctggagcacccagcccatctgcatcaagttctgcgacatgcccgtgttcgagaacagcagagccaagagcaacggcatgtggttcaagctgcacgacaccctggactacgagtgctacgacggctacgagagcagctacggcaacaccaccgacagcatcgtgtgcggcgaggacggctggagccacctgcccacctgctacaacagcagcgagaactgcggcccccccccccccatcagcaacggcgacaccaccagcttcccccagaaggtgtacctgccctggagcagagtggagtaccagtgccagagctactacgagctgcagggcagcaagtacgtgacctgcagcaacggcgactggagcgagccccccagatgcatcagcatgaagccctgcgagttccccgagatccagcacggccacctgtactacgagaacaccagaagaccctacttccccgtggccaccggccagagctacagctactactgcgaccagaacttcgtgacccccagcggcagctactgggactacatccactgcacccaggacggctggctgcccaccgtgccctgcctgagaacctgcagcaagagcgacatcgagatcgagaacggcttcatcagcgagagcagcagcatctacatcctgaacaaggagatccagtacaagtgcaagcccggctacgccaccgccgacggcaacagcagcggcagcatcacctgcctgcagaacggctggagcgcccagcccatctgcatcaagttctgcgacatgcccgtgttcgagaacagcagagccaagagcaacggcatgagattcaagctgcacgacaccctggactacgagtgctacgacggctacgagatcagctacggcaacaccaccggcagcatcgtgtgcggcgaggacggctggagccacttccccacctgctacaacagcagcgagaagtgcggcccccccccccccatcagcaacggcgacaccaccagcttcctgctgaaggtgtacgtgccccagagcagagtggagtaccagtgccagagctactacgagctgcagggcagcaactacgtgacctgcagcaacggcgagtggagcgagccccccagatgcatccacccctgcatcatcaccgaggagaacatgaacaagaacaacatccagctgaagggcaagagcgacatcaagtactacgccaagaccggcgacaccatcgagttcatgtgcaagctgggctacaacgccaacaccagcgtgctgagcttccaggccgtgtgcagagagggcatcgtggagtaccccagatgcgagtag

SEQ ID NO: 77531 - DNA, 996 bp, Artificial Sequence
  Description of Artificial Sequence: Synthetic coding sequence
atgctgctgctgatcaacgtgatcctgaccctgtgggtgagctgcgccaacggccaggccatgaagccctgcgagttccccgagatccagcacggccacctgtactacgagaacaccagaagaccctacttccccgtggccaccggccagagctacagctactactgcgaccagaacttcgtgacccccagcggcagctactgggactacatccactgcacccaggacggctggctgcccaccgtgccctgcctgagaacctgcagcaagagcgacatcgagatcgagaacggcttcatcagcgagagcagcagcatctacatcctgaacaaggagatccagtacaagtgcaagcccggctacgccaccgccgacggcaacagcagcggcagcatcacctgcctgcagaacggctggagcgcccagcccatctgcatcaagttctgcgacatgcccgtgttcgagaacagcagagccaagagcaacggcatgagattcaagctgcacgacaccctggactacgagtgctacgacggctacgagatcagctacggcaacaccaccggcagcatcgtgtgcggcgaggacggctggagccacttccccacctgctacaacagcagcgagaagtgcggcccccccccccccatcagcaacggcgacaccaccagcttcctgctgaaggtgtacgtgccccagagcagagtggagtaccagtgccagagctactacgagctgcagggcagcaactacgtgacctgcagcaacggcgagtggagcgagccccccagatgcatccacccctgcatcatcaccgaggagaacatgaacaagaacaacatccagctgaagggcaagagcgacatcaagtactacgccaagaccggcgacaccatcgagttcatgtgcaagctgggctacaacgccaacaccagcgtgctgagcttccaggccgtgtgcagagagggcatcgtggagtaccccagatgcgagtag

SEQ ID NO: 77532 - DNA, 996 bp, Artificial Sequence
  Description of Artificial Sequence: Synthetic coding sequence
atgctgctgctgatcaacgtgatcctgaccctgtgggtgagctgcgccaacggccaggaggtgaagccctgcgacttccccgagatccagcacggcggcctgtactacaagagcctgagaagactgtacttccccgccgccgccggccagagctacagctactactgcgaccagaacttcgtgacccccagcggcagctactgggactacatccactgcacccaggacggctggctgcccaccgtgccctgcctgagaacctgcagcaagagcgacatcgagatcgagaacggcttcatcagcgagagcagcagcatctacatcctgaacaaggagatccagtacaagtgcaagcccggctacgccaccgccgacggcaacagcagcggcagcatcacctgcctgcagaacggctggagcgcccagcccatctgcatcaagttctgcgacatgcccgtgttcgagaacagcagagccaagagcaacggcatgagattcaagctgcacgacaccctggactacgagtgctacgacggctacgagatcagctacggcaacaccaccggcagcatcgtgtgcggcgaggacggctggagccacttccccacctgctacaacagcagcgagaagtgcggcccccccccccccatcagcaacggcgacaccaccagcttcctgctgaaggtgtacgtgccccagagcagagtggagtaccagtgccagagctactacgagctgcagggcagcaactacgtgacctgcagcaacggcgagtggagcgagccccccagatgcatccacccctgcatcatcaccgaggagaacatgaacaagaacaacatccagctgaagggcaagagcgacatcaagtactacgccaagaccggcgacaccatcgagttcatgtgcaagctgggctacaacgccaacaccagcgtgctgagcttccaggccgtgtgcagagagggcatcgtggagtaccccagatgcgagtag

SEQ ID NO: 77533 - DNA, 1752 bp, Artificial Sequence
  Description of Artificial Sequence: Synthetic coding sequence
atgaagctgctgcacgtgttcctgctgttcctgtgcttccacctgagattctgcaaggtgacctacaccagccaggaggacctggtggagaagaagtgcctggccaagaagtacacccacctgagctgcgacaaggtgttctgccagccctggcagagatgcatcgagggcacctgcgtgtgcaagctgccctaccagtgccccaagaacggcaccgccgtgtgcgccaccaacagaagaagcttccccacctactgccagcagaagagcctggagtgcctgcaccccggcaccaagttcctgaacaacggcacctgcaccgccgagggcaagttcagcgtgagcctgaagcacggcaacaccgacagcgagggcatcgtggaggtgaagctggtggaccaggacaagaccatgttcatctgcaagagcagctggagcatgagagaggccaacgtggcctgcctggacctgggcttccagcagggcgccgacacccagagaagattcaagctgagcgacctgagcatcaacagcaccgagtgcctgcacgtgcactgcagaggcctggagaccagcctggccgagtgcaccttcaccaagagaagaaccatgggctaccaggacttcgccgacgtggtgtgctacacccagaaggccgacagccccatggacgacttcttccagtgcgtgaacggcaagtacatcagccagatgaaggcctgcgacggcatcaacgactgcggcgaccagagcgacgagctgtgctgcaaggcctgccagggcaagggcttccactgcaagagcggcgtgtgcatccccagccagtaccagtgcaacggcgaggtggactgcatcaccggcgaggacgaggtgggctgcgccggcttcgccagcgtgacccaggaggagaccgagatcctgaccgccgacatggacgccgagagaagaagaatcaagagcctgctgcccaagctgagctgcggcgtgaagaacagaatgcacatcagaagaaagagaatcgtgggcggcaagagagcccagctgggcgacctgccctggcaggtggccatcaaggacgccagcggcatcacctgcggcggcatctacatcggcggctgctggatcctgaccgccgcccactgcctgagagccagcaagacccacagataccagatctggaccaccgtggtggactggatccaccccgacctgaagagaatcgtgatcgagtacgtggacagaatcatcttccacgagaactacaacgccggcacctaccagaacgacatcgccctgatcgagatgaagaaggacggcaacaagaaggactgcgagctgcccagaagcatccccgcctgcgtgccctggagcccctacctgttccagcccaacgacacctgcatcgtgagcggctggggcagagagaaggacaacgagagagtgttcagcctgcagtggggcgaggtgaagctgatcagcaactgcagcaagttctacggcaacagattctacgagaaggagatggagtgcgccggcacctacgacggcagcatcgacgcctgcaagggcgacagcggcggccccctggtgtgcatggacgccaacaacgtgacctacgtgtggggcgtggtgagctggggcgagaactgcggcaagcccgagttccccggcgtgtacaccaaggtggccaactacttcgactggatcagctaccacgtgggcagacccttcatcagccagtacaacgtgtag

SEQ ID NO: 77534 - DNA, 1776 bp, Artificial Sequence
  Description of Artificial Sequence: Synthetic coding sequence
atgaagctgctgcacgtgttcctgctgttcctgtgcttccacctgagattctgcaaggtgacctacaccagccaggaggacctggtggagaagaagtgcctggccaagaagtacacccacctgagctgcgacaaggtgttctgccagccctggcagagatgcatcgagggcacctgcgtgtgcaagctgccctaccagtgccccaagaacggcaccgccgtgtgcgccaccaacagaagaagcttccccacctactgccagcagaagagcctggagtgcctgcaccccggcaccaagttcctgaacaacggcacctgcaccgccgagggcaagttcagcgtgagcctgaagcacggcaacaccgacagcgagggcatcgtggaggtgaagctggtggaccaggacaagaccatgttcatctgcaagagcagctggagcatgagagaggccaacgtggcctgcctggacctgggcttccagcagggcgccgacacccagagaagattcaagctgagcgacctgagcatcaacagcaccgagtgcctgcacgtgcactgcagaggcctggagaccagcctggccgagtgcaccttcaccaagagaagaaccatgggctaccaggacttcgccgacgtggtgtgctacacccagaaggccgacagccccatggacgacttcttccagtgcgtgaacggcaagtacatcagccagatgaaggcctgcgacggcatcaacgactgcggcgaccagagcgacgagctgtgctgcaaggcctgccagggcaagggcttccactgcaagagcggcgtgtgcatccccagccagtaccagtgcaacggcgaggtggactgcatcaccggcgaggacgaggtgggctgcgccgccgccagacaccccaccatccagggcttcgccagcgtgacccaggaggagaccgagatcctgaccgccgacatggacgccgagagaagaagaatcaagagcctgctgcccaagctgagctgcggcgtgaagaacagaatgcacatcagaagaaagagaatcgtgggcggcaagagagcccagctgggcgacctgccctggcaggtggccatcaaggacgccagcggcatcacctgcggcggcatctacatcggcggctgctggatcctgaccgccgcccactgcctgagagccagcaagacccacagataccagatctggaccaccgtggtggactggatccaccccgacctgaagagaatcgtgatcgagtacgtggacagaatcatcttccacgagaactacaacgccggcacctaccagaacgacatcgccctgatcgagatgaagaaggacggcaacaagaaggactgcgagctgcccagaagcatccccgcctgcgtgccctggagcccctacctgttccagcccaacgacacctgcatcgtgagcggctggggcagagagaaggacaacgagagagtgttcagcctgcagtggggcgaggtgaagctgatcagcaactgcagcaagttctacggcaacagattctacgagaaggagatggagtgcgccggcacctacgacggcagcatcgacgcctgcaagggcgacagcggcggccccctggtgtgcatggacgccaacaacgtgacctacgtgtggggcgtggtgagctggggcgagaactgcggcaagcccgagttccccggcgtgtacaccaaggtggccaactacttcgactggatcagctaccacgtgggcagacccttcatcagccagtacaacgtgtag

SEQ ID NO: 77535 - DNA, 1731 bp, Artificial Sequence
  Description of Artificial Sequence: Synthetic coding sequence
atgaagctgctgcacgtgttcctgctgttcctgtgcttccacctgagattctgcaaggtgacctacaccagccaggaggacctggtggagaagaagtgcctggccaagaagtacacccacctgagctgcgacaaggtgttctgccagccctggcagagatgcatcgagggcacctgcgtgtgcaagctgccctaccagtgccccaagaacggcaccgccgtgtgcgccaccaacagaagaagcttccccacctactgccagcagaagagcctggagtgcctgcaccccggcaccaagttcctgaacaacggcacctgcaccgccgagggcaagttcagcgtgagcctgaagcacggcaacaccgacagcgagggcatcgtggaggtgaagctggtggaccaggacaagaccatgttcatctgcaagagcagctggagcatgagagaggccaacgtggcctgcctggacctgggcttccagcagggcgccgacacccagagaagattcaagctgagcgacctgagcatcaacagcaccgagtgcctgcacgtgcactgcagaggcctggagaccagcctggccgagtgcaccttcaccaagagaagaaccatgggctaccaggacttcgccgacgtggtgtgctacacccagaaggccgacagccccatggacgacttcttccagtgcgtgaacggcaagtacatcagccagatgaaggcctgcgacggcatcaacgactgcggcgaccagagcgacgagctgtgctgcaaggcctgccagggcaagggcttccactgcaagagcggcgtgtgcatccccagccagtaccagtgcaacggcgaggtggactgcatcaccggcgaggacgaggtgggctgcgccgaggagaccgagatcctgaccgccgacatggacgccgagagaagaagaatcaagagcctgctgcccaagctgagctgcggcgtgaagaacagaatgcacatcagaagaaagagaatcgtgggcggcaagagagcccagctgggcgacctgccctggcaggtggccatcaaggacgccagcggcatcacctgcggcggcatctacatcggcggctgctggatcctgaccgccgcccactgcctgagagccagcaagacccacagataccagatctggaccaccgtggtggactggatccaccccgacctgaagagaatcgtgatcgagtacgtggacagaatcatcttccacgagaactacaacgccggcacctaccagaacgacatcgccctgatcgagatgaagaaggacggcaacaagaaggactgcgagctgcccagaagcatccccgcctgcgtgccctggagcccctacctgttccagcccaacgacacctgcatcgtgagcggctggggcagagagaaggacaacgagagagtgttcagcctgcagtggggcgaggtgaagctgatcagcaactgcagcaagttctacggcaacagattctacgagaaggagatggagtgcgccggcacctacgacggcagcatcgacgcctgcaagggcgacagcggcggccccctggtgtgcatggacgccaacaacgtgacctacgtgtggggcgtggtgagctggggcgagaactgcggcaagcccgagttccccggcgtgtacaccaaggtggccaactacttcgactggatcagctaccacgtgggcagacccttcatcagccagtacaacgtgtag

SEQ ID NO: 77536 - DNA, 966 bp, Artificial Sequence
  Description of Artificial Sequence: Synthetic coding sequence
caggtgacctacaccagccaggaggacctggtggagaagaagtgcctggccaagaagtacacccacctgagctgcgacaaggtgttctgccagccctggcagagatgcatcgagggcacctgcgtgtgcaagctgccctaccagtgccccaagaacggcaccgccgtgtgcgccaccaacagaagaagcttccccacctactgccagcagaagagcctggagtgcctgcaccccggcaccaagttcctgaacaacggcacctgcaccgccgagggcaagttcagcgtgagcctgaagcacggcaacaccgacagcgagggcatcgtggaggtgaagctggtggaccaggacaagaccatgttcatctgcaagagcagctggagcatgagagaggccaacgtggcctgcctggacctgggcttccagcagggcgccgacacccagagaagattcaagctgagcgacctgagcatcaacagcaccgagtgcctgcacgtgcactgcagaggcctggagaccagcctggccgagtgcaccttcaccaagagaagaaccatgggctaccaggacttcgccgacgtggtgtgctacacccagaaggccgacagccccatggacgacttcttccagtgcgtgaacggcaagtacatcagccagatgaaggcctgcgacggcatcaacgactgcggcgaccagagcgacgagctgtgctgcaaggcctgccagggcaagggcttccactgcaagagcggcgtgtgcatccccagccagtaccagtgcaacggcgaggtggactgcatcaccggcgaggacgaggtgggctgcgccgccttcgccgagctgtgcatcgaggagaccgagatcctgaccgccgacatggacgccgagagaagaagaatcaagagcctgctgcccaagctgagctgcggcgtgaagaacagaatgcacatcagaagaaagagatag

SEQ ID NO: 77537 - DNA, 1134 bp, Artificial Sequence
  Description of Artificial Sequence: Synthetic coding sequence
atgaagctgctgcacgtgttcctgctgttcctgtgcttccacctgagattctgcaaggtgacctacaccagccaggaggacctggtggagaagaagtgcctggccaagaagtacacccacctgagctgcgacaaggtgttctgccagccctggcagagatgcatcgagggcacctgcgtgtgcaagctgccctaccagtgccccaagaacggcaccgccgtgtgcgccaccaacagaagaagcttccccacctactgccagcagaagagcctggagtgcctgcaccccggcaccaagttcctgaacaacggcacctgcaccgccgagggcaagttcagcgtgagcctgaagcacggcaacaccgacagcgagggcatcgtggaggtgaagctggtggaccaggacaagaccatgttcatctgcaagagcagctggagcatgagagaggccaacgtggcctgcctggacctgggcttccagcagggcgccgacacccagagaagattcaagctgagcgacctgagcatcaacagcaccgagtgcctgcacgtgcactgcagaggcctggagaccagcctggccgagtgcaccttcaccaagagaagaaccatgggctaccaggacttcgccgacgtggtgtgctacacccagaaggccgacagccccatggacgacttcttccagtgcgtgaacggcaagtacatcagccagatgaaggcctgcgacggcatcaacgactgcggcgaccagagcgacgagctgtgctgcaaggcctgccagggcaagggcttccactgcaagagcggcgtgtgcatccccagccagtaccagtgcaacggcgaggtggactgcatcaccggcgaggacgaggtgggctgcgccggcttcgccagcgtgacccaggaggagaccgagatcctgaccgccgacatggacgccgagagaagaagaatcaagagcctgctgcccaagctgagctgcggcgtgaagaacagaatgcacatcagaagaaagagaatcgtgggcggcaagagagcccagctgggcaagatgaagcagatcagcctggacatcttcaagggcctgcacagagtgtacgccatcctggagttctgctgcatcatcctgaagtag

SEQ ID NO: 77538 - DNA, 405 bp, Artificial Sequence
  Description of Artificial Sequence: Synthetic coding sequence
atggagttcgtgatgaagcaggccctgggcggcgccaccaaggacatgggcaagatgctgggcggcgacgaggagaaggaccccgacgccgccaagaaggaggaggagagacaggaggccctgagacaggccgaggaggagagaaaggccaagtacgccaagatggaggccgagagagaggccgtgagacagggcatcagagacaagtacggcatcaagaagaaggaggagagagaggccgaggcccaggccgccatggaggccaacagcgagggcagcctgaccagacccaagaaggccatcccccccggctgcggcgacgaggtggaggaggaggacgagagcatcctggacaccgtgatcaagtacctgcccggccccctgcaggacatgctgaagaagtag

SEQ ID NO: 77539 - DNA, 405 bp, Artificial Sequence
  Description of Artificial Sequence: Synthetic coding sequence
atggacttcgtgatgaagcaggccctgggcggcgccaccaaggacatgggcaagatgctgggcggcgaggaggagaaggaccccgacgcccagaagaaggaggaggagagacaggaggccctgagacagcaggaggaggagagaaaggccaagcacgccagaatggaggccgagagagagaaggtgagacagcagatcagagacaagtacggcctgaagaagaaggaggagaaggaggccgaggagaaggccgccctggagcagccctgcgagggcagcctgaccagacccaagaaggccatccccgccggctgcggcgacgaggaggaggaggaggaggagagcatcctggacaccgtgctgaagtacctgcccggccccctgcaggacatgttcaagaagtag

SEQ ID NO: 77540 - DNA, 405 bp, Artificial Sequence; identical to SEQ ID NO: 77539
  Description of Artificial Sequence: Synthetic coding sequence

SEQ ID NO: 77541 - DNA, 555 bp, Artificial Sequence
  Description of Artificial Sequence: Synthetic coding sequence
atggacttcgtgatgaagcaggccctgggcggcgccaccaaggacatgggcaagatgctgggcggcgaggaggagaaggaccccgacgcccagaagaaggaggaggagagacaggaggccctgagacagcaggaggaggagagaaaggccaagcacgccagaatggaggccgagagagagaaggtgagacagcagatcagagacaagtacggcctgaagaagaaggaggagaaggaggccgaggagaaggccgccctgagaggcagaggcggcggcggcagaggcgagcaccccggccacggcgcccagatccccgccagagccgccgccggccacgtgcaggaggtgaccagaccccccgcccccgcctacagcacctgctactacttcttcctggtgctgagcttcctgttcatcagactgagcctgaacagcgagggcgagaacctgagctggcccctgcccctgttccccggccagggcctgctgcccctgagcagccccagccacctgcccagcagccagggcatccacctgcaccccacccccaagtag

SEQ ID NO: 77542 - DNA, 234 bp, Artificial Sequence
  Description of Artificial Sequence: Synthetic coding sequence
atggacttcgtgatgaagcaggccctgggcggcgccaccaaggacatgggcaagatgctgggcggcgaggaggagaaggaccccgacgcccagaagaaggaggaggagagacaggaggccctgagacagcaggaggaggagagaaaggccaagcacgccagaatggaggccgagagagagaaggtgagacagcagatcagagacaagtacggcctgaagaagaaggaggagtag

SEQ ID NO: 77543 - DNA, 336 bp, Artificial Sequence
  Description of Artificial Sequence: Synthetic coding sequence
atggacttcgtgatgaagcaggccctgggcggcgccaccaaggacatgggcaagatgctgggcggcgaggaggagaaggaccccgacgcccagaagaaggaggaggagagacaggaggccctgagacagcaggaggaggagagaaaggccaagcacgccagaatggaggccgagagagagaaggtgagacagcagatcagagacaagtacggcctgaagaagaaggaggagaaggaggccgaggagaaggccgccctggagcagccctgcgagggcagcctgaccagacccaagaaggccatccccgccggctgcggcgacgaggaggaggagtag

SEQ ID NO: 77544 - DNA, 360 bp, Artificial Sequence
  Description of Artificial Sequence: Synthetic coding sequence
atggacttcgtgatgaagcaggccctgggcggcgccaccaaggacatgggcaagatgctgggcggcgaggaggagaaggaccccgacgcccagaagaaggaggaggagagacaggaggccctgagacagcaggaggaggagagaaaggccaagcacgccagaatggaggccgagagagagaaggtgagacagcagatcagagacaagtacggcctgaagaagaaggaggagaaggaggccgaggagaaggccgccctggagcagccctgcgagggcagcctgaccagacccaagaaggccatccccgccggctgcggcgacgaggaggaggaggaggaggagagcatcctggacacctag

SEQ ID NO: 77545 - DNA, 114 bp, Artificial Sequence
  Description of Artificial Sequence: Synthetic coding sequence
atggacttcgtgatgaagcaggccctgggcggcgccaccaaggacatgggcaagatgctgggcggcgaggaggagaaggaccccgacgcccagaagaaggaggaggagagatag

SEQ ID NO: 77546 - DNA, 405 bp, Artificial Sequence; identical to SEQ ID NO: 77539
  Description of Artificial Sequence: Synthetic coding sequence

SEQ ID NO: 77547 - DNA, 21 bp, Artificial Sequence
  Description of Artificial Sequence: Synthetic coding sequence
atggacttcgtgatgaagtag

SEQ ID NO: 77548 - DNA, 2943 bp, Artificial Sequence
  Description of Artificial Sequence: Synthetic coding sequence
atggccaccgccgccaccagccccgccctgaagagactggacctgagagaccccgccgccctgttcgagacccacggcgccgaggagatcagaggcctggagagacaggtgagagccgagatcgagcacaagaaggaggagctgagacagatggtgggcgagagatacagagacctgatcgaggccgccgacaccatcggccagatgagaagatgcgccgtgggcctggtggacgccgtgaaggccaccgaccagtactgcgccagactgagacaggccggcagcgccgcccccagaccccccagagcccagcagccccagcagcccagccaggagaagttctacagcatggccgcccagatcaagctgctgctggagatccccgagaagatctggagcagcatggaggccagccagtgcctgcacgccacccagctgtacctgctgtgctgccacctgcacagcctgctgcagctggacagcagcagcagcagatacagccccgtgctgagcagattccccatcctgatcagacaggtggccgccgccagccacttcagaagcaccatcctgcacgagagcaagatgctgctgaagtgccagggcgtgagcgaccaggccgtggccgaggccctgtgcagcatcatgctgctggaggagagcagccccagacaggccctgaccgacttcctgctggccagaaaggccaccatccagaagctgctgaaccagccccaccacggcgccggcatcaaggcccagatctgcagcctggtggagctgctggccaccaccctgaagcaggcccacgccctgttctacaccctgcccgagggcctgctgcccgaccccgccctgccctgcggcctgctgttcagcaccctggagaccatcaccggccagcaccccgccggcaagggcaccggcgtgctgcaggaggagatgaagctgtgcagctggttcaagcacctgcccgccagcatcgtggagttccagcccaccctgagaaccctggcccaccccatcagccaggagtacctgaaggacaccctgcagaagtggatccacatgtgcaacgaggacatcaagaacggcatcaccaacctgctgatgtacgtgaagagcatgaagggcctggccggcatcagagacgccatgtgggagctgctgaccaacgagagcaccaaccacagctgggacgtgctgtgcagaagactgctggagaagcccctgctgttctgggaggacatgatgcagcagctgttcctggacagactgcagaccctgaccaaggagggcttcgacagcatcagcagcagcagcaaggagctgctggtgagcgccctgcaggagctggagagcagcaccagcaacagccccagcaacaagcacatccacttcgagtacaacatgagcctgttcctgtggagcgagagccccaacgacctgcccagcgacgccgcctgggtgagcgtggccaacagaggccagttcgccagcagcggcctgagcatgaaggcccaggccatcagcccctgcgtgcagaacttctgcagcgccctggacagcaagctgaaggtgaagctggacgacctgctggcctacctgcccagcgacgacagcagcctgcccaaggacgtgagccccacccaggccaagagcagcgccttcgacagatacgccgacgccggcaccgtgcaggagatgctgagaacccagagcgtggcctgcatcaagcacatcgtggactgcatcagagccgagctgcagagcatcgaggagggcgtgcagggccagcaggacgccctgaacagcgccaagctgcacagcgtgctgttcatggccagactgtgccagagcctgggcgagctgtgcccccacctgaagcagtgcatcctgggcaagagcgagagcagcgagaagcccgccagagagttcagagccctgagaaagcagggcaaggtgaagacccaggagatcatccccacccaggccaagtggcaggaggtgaaggaggtgctgctgcagcagagcgtgatgggctaccaggtgtggagcagcgccgtggtgaaggtgctgatccacggcttcacccagagcctgctgctggacgacgccggcagcgtgctggccaccgccaccagctgggacgagctggagatccaggaggaggccgagagcggcagcagcgtgaccagcaagatcagactgcccgcccagcccagctggtacgtgcagagcttcctgttcagcctgtgccaggagatcaacagagtgggcggccacgccctgcccaaggtgaccctgcaggagatgctgaagagctgcatggtgcaggtggtggccgcctacgagaagctgagcgaggagaagcagatcaagaaggagggcgccttccccgtgacccagaacagagccctgcagctgctgtacgacctgagatacctgaacatcgtgctgaccgccaagggcgacgaggtgaagagcggcagaagcaagcccgacagcagaatcgagaaggtgaccgaccacctggaggccctgatcgaccccttcgacctggacgtgttcaccccccacctgaacagcaacctgcacagactggtgcagagaaccagcgtgctgttcggcctggtgaccggcaccgagaaccagctggcccccagaagcagcaccttcaacagccaggagccccacaacatcctgcccctggccagcagccagatcagattcggcctgctgcccctgagcatgaccagcaccagaaaggccaagagcaccagaaacatcgagaccaaggcccaggtggtgccccccgccagaagcaccgccggcgaccccaccgtgcccggcagcctgttcagacagctggtgagcgaggaggacaacaccagcgcccccagcctgttcaagctgggctggctgagcagcatgaccaagtag

SEQ ID NO: 77549 - DNA, 2823 bp, Artificial Sequence
  Description of Artificial Sequence: Synthetic coding sequence
atggccaccgccgccaccagccccgccctgaagagactggacctgagagaccccgccgccctgttcgagacccacggcgccgaggagatcagaggcctggagagacaggtgagagccgagatcgagcacaagaaggaggagctgagacagatggtgggcgagagatacagagacctgatcgaggccgccgacaccatcggccagatgagaagatgcgccgtgggcctggtggacgccgtgaaggccaccgaccagtactgcgccagactgagacaggccggcagcgccgcccccagaccccccagagcccagcagccccagcagcccagccaggagaagttctacagcatggccgcccagatcaagctgctgctggagatccccgagaagatctggagcagcatggaggccagccagtgcctgcacgccacccagctgtacctgctgtgctgccacctgcacagcctgctgcagctggacagcagcagcagcagatacagccccgtgctgagcagattccccatcctgatcagacaggtggccgccgccagccacttcagaagcaccatcctgcacgagagcaagatgctgctgaagtgccagggcgtgagcgaccaggccgtggccgaggccctgtgcagcatcatgctgctggaggagagcagccccagacaggccctgaccgacttcctgctggccagaaaggccaccatccagaagctgctgaaccagccccaccacggcgccggcatcaaggcccagatctgcagcctggtggagctgctggccaccaccctgaagcaggcccacgccctgttctacaccctgcccgagggcctgctgcccgaccccgccctgccctgcggcctgctgttcagcaccctggagaccatcaccggccagcaccccgccggcaagggcaccggcgtgctgcaggaggagatgaagctgtgcagctggttcaagcacctgcccgccagcatcgtggagttccagcccaccctgagaaccctggcccaccccatcagccaggagtacctgaaggacaccctgcagaagtggatccacatgtgcaacgaggacatcaagaacggcatcaccaacctgctgatgtacgtgaagagcatgaagggcctggccggcatcagagacgccatgtgggagctgctgaccaacgagagcaccaaccacagctgggacgtgctgtgcagaagactgctggagaagcccctgctgttctgggaggacatgatgcagcagctgttcctggacagactgcagaccctgaccaaggagggcttcgacagcatcagcagcagcagcaaggagctgctggtgagcgccctgcaggagctggagagcagcaccagcaacagccccagcaacaagcacatccacttcgagtacaacatgagcctgttcctgtggagcgagagccccaacgacctgcccagcgacgccgcctgggtgagcgtggccaacagaggccagttcgccagcagcggcctgagcatgaaggcccaggccatcagcccctgcgtgcagaacttctgcagcgccctggacagcaagctgaaggtgaagctggacgacctgctggcctacctgcccagcgacgacagcagcctgcccaaggacgtgagccccacccaggccaagagcagcgccttcgacagatacgccgacgccggcaccgtgcaggagatgctgagaacccagagcgtggcctgcatcaagcacatcgtggactgcatcagagccgagctgcagagcatcgaggagggcgtgcagggccagcaggacgccctgaacagcgccaagctgcacagcgtgctgttcatggccagactgtgccagagcctgggcgagctgtgcccccacctgaagcagtgcatcctgggcaagagcgagagcagcgagaagcccgccagagagttcagagccctgagaaagcagggcaaggtgaagacccaggagatcatccccacccaggccaagtggcaggaggtgaaggaggtgctgctgcagcagagcgtgatgggctaccaggtgtggagcagcgccgtggtgaaggtgctgatccacggcttcacccagagcctgctgctggacgacgccggcagcgtgctggccaccgccaccagctgggacgagctggagatccaggaggaggccgagagcggcagcagcgtgaccagcaagatcagactgcccgcccagcccagctggtacgtgcagagcttcctgttcagcctgtgccaggagatcaacagagtgggcggccacgccctgcccaaggtgaccctgcaggagatgctgaagagctgcatggtgcaggtggtggccgcctacgagaagctgagcgaggagaagcagatcaagaaggagggcgccttccccgtgacccagaacagagccctgcagctgctgtacgacctgagatacctgaacatcgtgctgaccgccaagggcgacgaggtgaagagcggcagaagcaagcccgacagcagaatcgagaaggtgaccgaccacctggaggccctgatcgaccccttcgacctggacgtgttcaccccccacctgaacagcaacctgcacagactggtgcagagaaccagcgtgctgttcggcctggtgaccggcaccgagaaccagctggcccccagaagcagcaccttcaacagccaggagccccacaacatcctgcccctggccagcagccagatcagattcggcctgctgcccctgagcatgaccagcaccagaaaggccaagagcaccagaaacatcgagaccaaggcccagtacgacgccaactgctag

SEQ ID NO: 77550 - DNA, 2214 bp, Artificial Sequence
  Description of Artificial Sequence: Synthetic coding sequence
atggagaagagcagaatgaacctgcccaagggccccgacaccctgtgcttcgacaaggacgagttcatgaaggaggacttcgacgtggaccacttcgtgagcgactgcagaaagagagtgcagctggaggagctgagagacgacctggagctgtactacaagctgctgaagaccgccatggtggagctgatcaacaaggactacgccgacttcgtgaacctgagcaccaacctggtgggcatggacaaggccctgaaccagctgagcgtgcccctgggccagctgagagaggaggtgctgagcctgagaagcagcgtgagcgagggcatcagagccgtggacgagagaatgagcaagcaggaggacatcagaaagaagaagatgtgcgtgctgagactgatccaggtgatcagaagcgtggagaagatcgagaagatcctgaacagccagagcagcaaggagaccagcgccctggaggccagcagccccctgctgaccggccagatcctggagagaatcgccaccgagttcaaccagctgcagttccacgccgtgcagagcaagggcatgcccctgctggacaaggtgagacccagaatcgccggcatcaccgccatgctgcagcagagcctggagggcctgctgctggagggcctgcagaccagcgacgtggacatcatcagacactgcctgagaacctacgccaccatcgacaagaccagagacgccgaggccctggtgggccaggtgctggtgaagccctacatcgacgaggtgatcatcgagcagttcgtggagagccaccccaacggcctgcaggtgatgtacaacaagctgctggagttcgtgccccaccactgcagactgctgagagaggtgaccggcggcgccatcagcagcgagaagggcaacaccgtgcccggctacgacttcctggtgaacagcgtgtggccccagatcgtgcagggcctggaggagaagctgcccagcctgttcaaccccggcaaccccgacgccttccacgagaagtacaccatcagcatggacttcgtgagaagactggagagacagtgcggcagccaggccagcgtgaagagactgagagcccaccccgcctaccacagcttcaacaagaagtggaacctgcccgtgtacttccagatcagattcagagagatcgccggcagcctggaggccgccctgaccgacgtgctggaggacgcccccgccgagagcccctactgcctgctggccagccacagaacctggagcagcctgagaagatgctggagcgacgagatgttcctgcccctgctggtgcacagactgtggagactgaccctgcagatcctggccagatacagcgtgttcgtgaacgagctgagcctgagacccatcagcaacgagagccccaaggagatcaagaagcccctggtgaccggcagcaaggagcccagcatcacccagggcaacaccgaggaccagggcagcggccccagcgagaccaagcccgtggtgagcatcagcagaacccagctggtgtacgtggtggccgacctggacaagctgcaggagcagctgcccgagctgctggagatcatcaagcccaagctggagatgatcggcttcaagaacttcagcagcatcagcgccctggaggacagccagagcagcttcagcgcctgcgtgcccagcctgagcagcaagatcatccaggacctgagcgacagctgcttcggcttcctgaagagcgccctggaggtgcccagactgtacagaagaaccaacaaggaggtgcccaccaccgccagcagctacgtggacagcgccctgaagcccctgttccagctgcagagcggccacaaggacaagctgaagcaggccatcatccagcagtggctggagggcaccctgagcgagagcacccacaagtactacgagaccgtgagcgacgtgctgaacagcgtgaagaagatggaggagagcctgaagagactgaagcaggccagaaagaccacccccgccaaccccgtgggccccagcggcggcatgagcgacgacgacaagatcagactgcagctggccctggacgtggagtacctgggcgagcagatccagaagctgggcctgcaggccagcgacatcaagagcttcagcgccctggccgagctggtggccgccgccaaggaccaggccaccgccgagcagccctag

SEQ ID NO: 77551 - DNA, 2217 bp, Artificial Sequence
  Description of Artificial Sequence: Synthetic coding sequence
atggagaagagcagaatgaacctgcccaagggccccgacaccctgtgcttcgacaaggacgagttcatgaaggaggacttcgacgtggaccacttcgtgagcgactgcagaaagagagtgcagctggaggagctgagagacgacctggagctgtactacaagctgctgaagaccgccatggtggagctgatcaacaaggactacgccgacttcgtgaacctgagcaccaacctggtgggcatggacaaggccctgaaccagctgagcgtgcccctgggccagctgagagaggaggtgctgagcctgagaagcagcgtgagcgagggcatcagagccgtggacgagagaatgagcaagcaggaggacatcagaaagaagaagatgtgcgtgctgagactgatccaggtgatcagaagcgtggagaagatcgagaagatcctgaacagccagagcagcaaggagaccagcgccctggaggccagcagccccctgctgaccggccagatcctggagagaatcgccaccgagttcaaccagctgcagttccacgccgtgcagagcaagggcatgcccctgctggacaaggtgagacccagaatcgccggcatcaccgccatgctgcagcagagcctggagggcctgctgctggagggcctgcagaccagcgacgtggacatcatcagacactgcctgagaacctacgccaccatcgacaagaccagagacgccgaggccctggtgggccaggtgctggtgaagccctacatcgacgaggtgatcatcgagcagttcgtggagagccaccccaacggcctgcaggtgatgtacaacaagctgctggagttcgtgccccaccactgcagactgctgagagaggtgaccggcggcgccatcagcagcgagaagggcaacaccgtgcccggctacgacttcctggtgaacagcgtgtggccccagatcgtgcagggcctggaggagaagctgcccagcctgttcaaccccggcaaccccgacgccttccacgagaagtacaccatcagcatggacttcgtgagaagactggagagacagtgcggcagccaggccagcgtgaagagactgagagcccaccccgcctaccacagcttcaacaagaagtggaacctgcccgtgtacttccagatcagattcagagagatcgccggcagcctggaggccgccctgaccgacgtgctggaggacgcccccgccgagagcccctactgcctgctggccagccacagaacctggagcagcctgagaagatgctggagcgacgagatgttcctgcccctgctggtgcacagactgtggagactgaccctgcagatcctggccagatacagcgtgttcgtgaacgagctgagcctgagacccatcagcaacgagagccccaaggagatcaagaagcccctggtgaccggcagcaaggagcccagcatcacccagggcaacaccgaggaccagggcagcggccccagcgagaccaagcccgtggtgagcatcagcagaacccagctggtgtacgtggtggccgacctggacaagctgcaggagcagctgcccgagctgctggagatcatcaagcccaagctggagatgatcggcttcaagaacttcagcagcatcagcgccgccctggaggacagccagagcagcttcagcgcctgcgtgcccagcctgagcagcaagatcatccaggacctgagcgacagctgcttcggcttcctgaagagcgccctggaggtgcccagactgtacagaagaaccaacaaggaggtgcccaccaccgccagcagctacgtggacagcgccctgaagcccctgttccagctgcagagcggccacaaggacaagctgaagcaggccatcatccagcagtggctggagggcaccctgagcgagagcacccacaagtactacgagaccgtgagcgacgtgctgaacagcgtgaagaagatggaggagagcctgaagagactgaagcaggccagaaagaccacccccgccaaccccgtgggccccagcggcggcatgagcgacgacgacaagatcagactgcagctggccctggacgtggagtacctgggcgagcagatccagaagctgggcctgcaggccagcgacatcaagagcttcagcgccctggccgagctggtggccgccgccaaggaccaggccaccgccgagcagccctag

SEQ ID NO: 77552 - DNA, 2040 bp, Artificial Sequence
  Description of Artificial Sequence: Synthetic coding sequence
atggtggagctgatcaacaaggactacgccgacttcgtgaacctgagcaccaacctggtgggcatggacaaggccctgaaccagctgagcgtgcccctgggccagctgagagaggaggtgctgagcctgagaagcagcgtgagcgagggcatcagagccgtggacgagagaatgagcaagcaggaggacatcagaaagaagaagatgtgcgtgctgagactgatccaggtgatcagaagcgtggagaagatcgagaagatcctgaacagccagagcagcaaggagaccagcgccctggaggccagcagccccctgctgaccggccagatcctggagagaatcgccaccgagttcaaccagctgcagttccacgccgtgcagagcaagggcatgcccctgctggacaaggtgagacccagaatcgccggcatcaccgccatgctgcagcagagcctggagggcctgctgctggagggcctgcagaccagcgacgtggacatcatcagacactgcctgagaacctacgccaccatcgacaagaccagagacgccgaggccctggtgggccaggtgctggtgaagccctacatcgacgaggtgatcatcgagcagttcgtggagagccaccccaacggcctgcaggtgatgtacaacaagctgctggagttcgtgccccaccactgcagactgctgagagaggtgaccggcggcgccatcagcagcgagaagggcaacaccgtgcccggctacgacttcctggtgaacagcgtgtggccccagatcgtgcagggcctggaggagaagctgcccagcctgttcaaccccggcaaccccgacgccttccacgagaagtacaccatcagcatggacttcgtgagaagactggagagacagtgcggcagccaggccagcgtgaagagactgagagcccaccccgcctaccacagcttcaacaagaagtggaacctgcccgtgtacttccagatcagattcagagagatcgccggcagcctggaggccgccctgaccgacgtgctggaggacgcccccgccgagagcccctactgcctgctggccagccacagaacctggagcagcctgagaagatgctggagcgacgagatgttcctgcccctgctggtgcacagactgtggagactgaccctgcagatcctggccagatacagcgtgttcgtgaacgagctgagcctgagacccatcagcaacgagagccccaaggagatcaagaagcccctggtgaccggcagcaaggagcccagcatcacccagggcaacaccgaggaccagggcagcggccccagcgagaccaagcccgtggtgagcatcagcagaacccagctggtgtacgtggtggccgacctggacaagctgcaggagcagctgcccgagctgctggagatcatcaagcccaagctggagatgatcggcttcaagaacttcagcagcatcagcgccgccctggaggacagccagagcagcttcagcgcctgcgtgcccagcctgagcagcaagatcatccaggacctgagcgacagctgcttcggcttcctgaagagcgccctggaggtgcccagactgtacagaagaaccaacaaggaggtgcccaccaccgccagcagctacgtggacagcgccctgaagcccctgttccagctgcagagcggccacaaggacaagctgaagcaggccatcatccagcagtggctggagggcaccctgagcgagagcacccacaagtactacgagaccgtgagcgacgtgctgaacagcgtgaagaagatggaggagagcctgaagagactgaagcaggccagaaagaccacccccgccaaccccgtgggccccagcggcggcatgagcgacgacgacaagatcagactgcagctggccctggacgtggagtacctgggcgagcagatccagaagctgggcctgcaggccagcgacatcaagagcttcagcgccctggccgagctggtggccgccgccaaggaccaggccaccgccgagcagccctag

SEQ ID NO: 77553 - DNA, 1869 bp, Artificial Sequence
  Description of Artificial Sequence: Synthetic coding sequence
atgagcaagcaggaggacatcagaaagaagaagatgtgcgtgctgagactgatccaggtgatcagaagcgtggagaagatcgagaagatcctgaacagccagagcagcaaggagaccagcgccctggaggccagcagccccctgctgaccggccagatcctggagagaatcgccaccgagttcaaccagctgcagttccacgccgtgcagagcaagggcatgcccctgctggacaaggtgagacccagaatcgccggcatcaccgccatgctgcagcagagcctggagggcctgctgctggagggcctgcagaccagcgacgtggacatcatcagacactgcctgagaacctacgccaccatcgacaagaccagagacgccgaggccctggtgggccaggtgctggtgaagccctacatcgacgaggtgatcatcgagcagttcgtggagagccaccccaacggcctgcaggtgatgtacaacaagctgctggagttcgtgccccaccactgcagactgctgagagaggtgaccggcggcgccatcagcagcgagaagggcaacaccgtgcccggctacgacttcctggtgaacagcgtgtggccccagatcgtgcagggcctggaggagaagctgcccagcctgttcaaccccggcaaccccgacgccttccacgagaagtacaccatcagcatggacttcgtgagaagactggagagacagtgcggcagccaggccagcgtgaagagactgagagcccaccccgcctaccacagcttcaacaagaagtggaacctgcccgtgtacttccagatcagattcagagagatcgccggcagcctggaggccgccctgaccgacgtgctggaggacgcccccgccgagagcccctactgcctgctggccagccacagaacctggagcagcctgagaagatgctggagcgacgagatgttcctgcccctgctggtgcacagactgtggagactgaccctgcagatcctggccagatacagcgtgttcgtgaacgagctgagcctgagacccatcagcaacgagagccccaaggagatcaagaagcccctggtgaccggcagcaaggagcccagcatcacccagggcaacaccgaggaccagggcagcggccccagcgagaccaagcccgtggtgagcatcagcagaacccagctggtgtacgtggtggccgacctggacaagctgcaggagcagctgcccgagctgctggagatcatcaagcccaagctggagatgatcggcttcaagaacttcagcagcatcagcgccgccctggaggacagccagagcagcttcagcgcctgcgtgcccagcctgagcagcaagatcatccaggacctgagcgacagctgcttcggcttcctgaagagcgccctggaggtgcccagactgtacagaagaaccaacaaggaggtgcccaccaccgccagcagctacgtggacagcgccctgaagcccctgttccagctgcagagcggccacaaggacaagctgaagcaggccatcatccagcagtggctggagggcaccctgagcgagagcacccacaagtactacgagaccgtgagcgacgtgctgaacagcgtgaagaagatggaggagagcctgaagagactgaagcaggccagaaagaccacccccgccaaccccgtgggccccagcggcggcatgagcgacgacgacaagatcagactgcagctggccctggacgtggagtacctgggcgagcagatccagaagctgggcctgcaggccagcgacatcaagagcttcagcgccctggccgagctggtggccgccgccaaggaccaggccaccgccgagcagccctag

SEQ ID NO: 77554 - DNA, 1284 bp, Artificial Sequence
  Description of Artificial Sequence: Synthetic coding sequence
atgggcttcgccatggaggacaccgaggacatcagccagaaccacttcggccacctgtgcatcttcaagtggggccactggaagaaggacctgaagtacaccatcagcatggacttcgtgagaagactggagagacagtgcggcagccaggccagcgtgaagagactgagagcccaccccgcctaccacagcttcaacaagaagtggaacctgcccgtgtacttccagatcagattcagagagatcgccggcagcctggaggccgccctgaccgacgtgctggaggacgcccccgccgagagcccctactgcctgctggccagccacagaacctggagcagcctgagaagatgctggagcgacgagatgttcctgcccctgctggtgcacagactgtggagactgaccctgcagatcctggccagatacagcgtgttcgtgaacgagctgagcctgagacccatcagcaacgagagccccaaggagatcaagaagcccctggtgaccggcagcaaggagcccagcatcacccagggcaacaccgaggaccagggcagcggccccagcgagaccaagcccgtggtgagcatcagcagaacccagctggtgtacgtggtggccgacctggacaagctgcaggagcagctgcccgagctgctggagatcatcaagcccaagctggagatgatcggcttcaagaacttcagcagcatcagcgccgccctggaggacagccagagcagcttcagcgcctgcgtgcccagcctgagcagcaagatcatccaggacctgagcgacagctgcttcggcttcctgaagagcgccctggaggtgcccagactgtacagaagaaccaacaaggaggtgcccaccaccgccagcagctacgtggacagcgccctgaagcccctgttccagctgcagagcggccacaaggacaagctgaagcaggccatcatccagcagtggctggagggcaccctgagcgagagcacccacaagtactacgagaccgtgagcgacgtgctgaacagcgtgaagaagatggaggagagcctgaagagactgaagcaggccagaaagaccacccccgccaaccccgtgggccccagcggcggcatgagcgacgacgacaagatcagactgcagctggccctggacgtggagtacctgggcgagcagatccagaagctgggcctgcaggccagcgacatcaagagcttcagcgccctggccgagctggtggccgccgccaaggaccaggccaccgccgagcagccctag

SEQ ID NO: 77555 - DNA, 2487 bp, Artificial Sequence
  Description of Artificial Sequence: Synthetic coding sequence
atggccgaggccgccctgctgctgctgcccgaggccgccgccgagagagacgccagagagaagctggccctgtgggacagaagacccgacaccaccgcccccctgaccgacagacagaccgacagcgtgctggagctgaaggccgccgccgagaacctgcccgtgcccgccgagctgcccatcgaggacctgtgcagcctgaccagccagagcctgcccatcgagctgaccagcgtggtgcccgagagcaccgaggacatcctgctgaagggcttcaccagcctgggcatggaggaggagagaatcgagaccgcccagcagttcttcagctggttcgccaagctgcagacccagatggaccaggacgagggcaccaagtacagacagatgagagactacctgagcggcttccaggagcagtgcgacgccatcctgaacgacgtgaacagcgccctgcagcacctggagagcctgcagaagcagtacctgttcgtgagcaacaagaccggcaccctgcacgaggcctgcgagcagctgctgaaggagcagagcgagctggtggacctggccgagaacatccagcagaagctgagctacttcaacgagctggagaccatcaacaccaagctgaacagccccaccctgagcgtgaacagcgacggcttcatccccatgctggccaagctggacgactgcatcacctacatcagcagccaccccaacttcaaggactaccccatctacctgctgaagttcaagcagtgcctgagcaaggccctgcacctgatgaagacctacaccgtgaacaccctgcagaccctgaccagccagctgctgaagagagaccccagcagcgtgcccaacgccgacaacgccttcaccctgttctacgtgaagttcagagccgccgcccccaaggtgagaaccctgatcgagcagatcgagctgagaagcgagaagatccccgagtaccagcagctgctgaacgacatccaccagtgctacctggaccagagagagctgctgctgggccccagcatcgcctgcaccgtggccgagctgaccagccagaacaacagagaccactgcgccctggtgagaagcggctgcgccttcatggtgcacgtgtgccaggacgagcaccagctgtacaacgagttcttcaccaagcccaccagcaagctggacgagctgctggagaagctgtgcgtgagcctgtacgacgtgttcagacccctgatcatccacgtgatccacctggagaccctgagcgagctgtgcggcatcctgaagaacgaggtgctggaggaccacgtgcagaacaacgccgagcagctgggcgccttcgccgccggcgtgaagcagatgctggaggacgtgcaggagagactggtgtacagaacccacatctacatccagaccgacatcaccggctacaagcccgcccccggcgacctggcctaccccgacaagctggtgatgatggagcagatcgcccagagcctgaaggacgagcagaagaaggtgcccagcgaggccagcttcagcgacgtgcacctggaggagggcgagagcaacagcctgaccaagagcggcagcaccgagagcctgaaccccagaccccagaccaccatcagccccgccgacctgcacggcatgtggtaccccaccgtgagaagaaccctggtgtgcctgagcaagctgtacagatgcatcgacagagccgtgttccagggcctgagccaggaggccctgagcgcctgcatccagagcctgctgggcgccagcgagagcatcagcaagaacaagacccagatcgacggccagctgttcctgatcaagcacctgctgatcctgagagagcagatcgcccccttccacaccgagttcaccatcaaggagatcagcctggacctgaagaagaccagagacgccgccttcaagatcctgaaccccatgaccgtgcccagattcttcagactgaacagcaacaacgccctgatcgagttcctgctggagggcacccccgagatcagagagcactacctggacagcaagaaggacgtggacagacacctgaagagcgcctgcgagcagttcatccagcagcagaccaagctgttcgtggagcagctggaggagttcatgaccaaggtgagcgccctgaagaccatggccagccagggcggccccaagtacaccctgagccagcagccctgggcccagcccgccaaggtgaacgacctggccgccaccgcctacaagaccatcaagaccaagctgcccgtgaccctgagaagcatgagcctgtacctgagcaacaaggacaccgagttcatcctgttcaagcccgtgagaaacaacatccagcaggtgttccagaagttccacgccctgctgaaggaggagttcagccccgaggacatccagatcatcgcctgccccagcatggagcagctgagcctgctgctgctggtgagcaagtag

SEQ ID NO: 77556 - DNA, 2370 bp, Artificial Sequence
  Description of Artificial Sequence: Synthetic coding sequence
atgggcaccaagatggccgacctggacagcccccccaagctgagcggcgtgcagcagcccagcgagggcgtgggcggcggcagatgcagcgagatcagcgccgagctgatcagaagcctgaccgagctgcaggagctggaggccgtgtacgagagactgtgcggcgaggagaaggtggtggagagagagctggacgccctgctggagcagcagaacaccatcgagagcaagatggtgaccctgcacagaatgggccccaacctgcagctgatcgagggcgacgccaagcagctggccggcatgatcaccttcacctgcaacctggccgagaacgtgagcagcaaggtgagacagctggacctggccaagaacagactgtaccaggccatccagagagccgacgacatcctggacctgaagttctgcatggacggcgtgcagaccgccctgagaagcgaggactacgagcaggccgccgcccacacccacagatacctgtgcctggacaagagcgtgatcgagctgagcagacagggcaaggagggcagcatgatcgacgccaacctgaagctgctgcaggaggccgagcagagactgaaggccatcgtggccgagaagttcgccatcgccaccaaggagggcgacctgccccaggtggagagattcttcaagatcttccccctgctgggcctgcacgaggagggcctgagaaagttcagcgagtacctgtgcaagcaggtggccagcaaggccgaggagaacctgctgatggtgctgggcaccgacatgagcgacagaagagccgccgtgatcttcgccgacaccctgaccctgctgttcgagggcatcgccagaatcgtggagacccaccagcccatcgtggagacctactacggccccggcagactgtacaccctgatcaagtacctgcaggtggagtgcgacagacaggtggagaaggtggtggacaagttcatcaagcagagagactaccaccagcagttcagacacgtgcagaacaacctgatgagaaacagcaccaccgagaagatcgagcccagagagctggaccccatcctgaccgaggtgaccctgatgaacgccagaagcgagctgtacctgagattcctgaagaagagaatcagcagcgacttcgaggtgggcgacagcatggccagcgaggaggtgaagcaggagcaccagaagtgcctggacaagctgctgaacaactgcctgctgagctgcaccatgcaggagctgatcggcctgtacgtgaccatggaggagtacttcatgagagagaccgtgaacaaggccgtggccctggacacctacgagaagggccagctgaccagcagcatggtggacgacgtgttctacatcgtgaagaagtgcatcggcagagccctgagcagcagcagcatcgactgcctgtgcgccatgatcaacctggccaccaccgagctggagagcgacttcagagacgtgctgtgcaacaagctgagaatgggcttccccgccaccaccttccaggacatccagagaggcgtgaccagcgccgtgaacatcatgcacagcagcctgcagcagggcaagttcgacaccaagggcatcgagagcaccgacgaggccaagatgagcttcctggtgaccctgaacaacgtggaggtgtgcagcgagaacatcagcaccctgaagaagaccctggagagcgactgcaccaagctgttcagccagggcatcggcggcgagcaggcccaggccaagttcgacagctgcctgagcgacctggccgccgtgagcaacaagttcagagacctgctgcaggagggcctgaccgagctgaacagcaccgccatcaagccccaggtgcagccctggatcaacagcttcttcagcgtgagccacaacatcgaggaggaggagttcaacgactacgaggccaacgacccctgggtgcagcagttcatcctgaacctggagcagcagatggccgagttcaaggccagcctgagccccgtgatctacgacagcctgaccggcctgatgaccagcctggtggccgtggagctggagaaggtggtgctgaagagcaccttcaacagactgggcggcctgcagttcgacaaggagctgagaagcctgatcgcctacctgaccaccgtgaccacctggaccatcagagacaagttcgccagactgagccagatggccaccatcctgaacctggagagagtgaccgagatcctggactactggggccccaacagcggccccctgacctggagactgacccccgccgaggtgagacaggtgctggccctgagaatcgacttcagaagcgaggacatcaagagactgagactgtag

SEQ ID NO: 77557 - DNA, 2295 bp, Artificial Sequence
  Description of Artificial Sequence: Synthetic coding sequence
atggccgacctggacagcccccccaagctgagcggcgtgcagcagcccagcgagggcgtgggcggcggcagatgcagcgagatcagcgccgagctgatcagaagcctgaccgagctgcaggagctggaggccgtgtacgagagactgtgcggcgaggagaaggtggtggagagagagctggacgccctgctggagcagcagaacaccatcgagagcaagatggtgaccctgcacagaatgggccccaacctgcagctgatcgagggcgacgccaagcagctggccggcatgatcaccttcacctgcaacctggccgagaacgtgagcagcaaggtgagacagctggacctggccaagaacagactgtaccaggccatccagagagccgacgacatcctggacctgaagttctgcatggacggcgtgcagaccgccctgagaagcgaggactacgagcaggccgccgcccacacccacagatacctgtgcctggacaagagcgtgatcgagctgagcagacagggcaaggagggcagcatgatcgacgccaacctgaagctgctgcaggaggccgagcagagactgaaggccatcgtggccgagaagttcgccatcgccaccaaggagggcgacctgccccaggtggagagattcttcaagatcttccccctgctgggcctgcacgaggagggcctgagaaagttcagcgagtacctgtgcaagcaggtggccagcaaggccgaggagaacctgctgatggtgctgggcaccgacatgagcgacagaagagccgccgtgatcttcgccgacaccctgaccctgctgttcgagggcatcgccagaatcgtggagacccaccagcccatcgtggagacctactacggccccggcagactgtacaccctgatcaagtacctgcaggtggagtgcgacagacaggtggagaaggtggtggacaagttcatcaagcagagagactaccaccagcagttcagacacgtgcagaacaacctgatgagaaacagcaccaccgagaagatcgagcccagagagctggaccccatcctgaccgaggtgaccctgatgaacgccagaagcgagctgtacctgagattcctgaagaagagaatcagcagcgacttcgaggtgggcgacagcatggccagcgaggaggtgaagcaggagcaccagaagtgcctggacaagctgctgaacaactgcctgctgagctgcaccatgcaggagctgatcggcctgtacgtgaccatggaggagtacttcatgagagagaccgtgaacaaggccgtggccctggacacctacgagaagggccagctgaccagcagcatggtggacgacgtgttctacatcgtgaagaagtgcatcggcagagccctgagcagcagcagcatcgactgcctgtgcgccatgatcaacctggccaccaccgagctggagagcgacttcagagacgtgctgtgcaacaagctgagaatgggcttccccgccaccaccttccaggacatccagagaggcgtgaccagcgccgtgaacatcatgcacagcagcctgcagcagggcaagttcgacaccaagggcatcgagagcaccgacgaggccaagatgagcttcctgagcgactgcaccaagctgttcagccagggcatcggcggcgagcaggcccaggccaagttcgacagctgcctgagcgacctggccgccgtgagcaacaagttcagagacctgctgcaggagggcctgaccgagctgaacagcaccgccatcaagccccaggtgcagccctggatcaacagcttcttcagcgtgagccacaacatcgaggaggaggagttcaacgactacgaggccaacgacccctgggtgcagcagttcatcctgaacctggagcagcagatggccgagttcaaggccagcctgagccccgtgatctacgacagcctgaccggcctgatgaccagcctggtggccgtggagctggagaaggtggtgctgaagagcaccttcaacagactgggcggcctgcagttcgacaaggagctgagaagcctgatcgcctacctgaccaccgtgaccacctggaccatcagagacaagttcgccagactgagccagatggccaccatcctgaacctggagagagtgaccgagatcctggactactggggccccaacagcggccccctgacctggagactgacccccgccgaggtgagacaggtgctggccctgagaatcgacttcagaagcgaggacatcaagagactgagactgtag

SEQ ID NO: 77558 - DNA, 1014 bp, Artificial Sequence
  Description of Artificial Sequence: Synthetic coding sequence
atggccgacctggacagcccccccaagctgagcggcgtgcagcagcccagcgagggcgtgggcggcggcagatgcagcgagatcagcgccgagctgatcagaagcctgaccgagctgcaggagctggaggccgtgtacgagagactgtgcggcgaggagaaggtggtggagagagagctggacgccctgctggagcagcagaacaccatcgagagcaagatggtgaccctgcacagaatgggccccaacctgcagctgatcgagggcgacgccaagcagctggccggcatgatcaccttcacctgcaacctggccgagaacgtgagcagcaaggtgagacagctggacctggccaagaacagactgtaccaggccatccagagagccgacgacatcctggacctgaagttctgcatggacggcgtgcagaccgccctgagaagcgaggactacgagcaggccgccgcccacacccacagatacctgtgcctggacaagagcgtgatcgagctgagcagacagggcaaggagggcagcatgatcgacgccaacctgaagctgctgcaggaggccgagcagagactgaaggccatcgtggccgagaagttcgccatcgccaccaaggagggcgacctgccccaggtggagagattcttcaagatcttccccctgctgggcctgcacgaggagggcctgagaaagttcagcgagtacctgtgcaagcaggtggccagcaaggccgaggagaacctgctgatggtgctgggcaccgacatgagcgacagaagagccgccgtgatcttcgccgacaccctgaccctgctgttcgagggcatcgccagaatcgtggagacccaccagcccatcgtggagacctactacggccccggcagactgtacaccctgatcaagtacctgcaggtggagtgcgacagacaggtggagaaggtggtggacaagttcatcaagcagagagactaccaccagcagaacttcgtgttcagcttcttctag

SEQ ID NO: 77559 - DNA, 1344 bp, Artificial Sequence
  Description of Artificial Sequence: Synthetic coding sequence
atgagaaacagcaccaccgagaagatcgagcccagagagctggaccccatcctgaccgaggtgaccctgatgaacgccagaagcgagctgtacctgagattcctgaagaagagaatcagcagcgacttcgaggtgggcgacagcatggccagcgaggaggtgaagcaggagcaccagaagtgcctggacaagctgctgaacaactgcctgctgagctgcaccatgcaggagctgatcggcctgtacgtgaccatggaggagtacttcatgagagagaccgtgaacaaggccgtggccctggacacctacgagaagggccagctgaccagcagcatggtggacgacgtgttctacatcgtgaagaagtgcatcggcagagccctgagcagcagcagcatcgactgcctgtgcgccatgatcaacctggccaccaccgagctggagagcgacttcagagacgtgctgtgcaacaagctgagaatgggcttccccgccaccaccttccaggacatccagagaggcgtgaccagcgccgtgaacatcatgcacagcagcctgcagcagggcaagttcgacaccaagggcatcgagagcaccgacgaggccaagatgagcttcctggtgaccctgaacaacgtggaggtgtgcagcgagaacatcagcaccctgaagaagaccctggagagcgactgcaccaagctgttcagccagggcatcggcggcgagcaggcccaggccaagttcgacagctgcctgagcgacctggccgccgtgagcaacaagttcagagacctgctgcaggagggcctgaccgagctgaacagcaccgccatcaagccccaggtgcagccctggatcaacagcttcttcagcgtgagccacaacatcgaggaggaggagttcaacgactacgaggccaacgacccctgggtgcagcagttcatcctgaacctggagcagcagatggccgagttcaaggccagcctgagccccgtgatctacgacagcctgaccggcctgatgaccagcctggtggccgtggagctggagaaggtggtgctgaagagcaccttcaacagactgggcggcctgcagttcgacaaggagctgagaagcctgatcgcctacctgaccaccgtgaccacctggaccatcagagacaagttcgccagactgagccagatggccaccatcctgaacctggagagagtgaccgagatcctggactactggggccccaacagcggccccctgacctggagactgacccccgccgaggtgagacaggtgctggccctgagaatcgacttcagaagcgaggacatcaagagactgagactgtag

SEQ ID NO: 77560 - DNA, 2583 bp, Artificial Sequence
  Description of Artificial Sequence: Synthetic coding sequence
atgggctgggtgggcggcagaagaagagacagcgccagcccccccggcagaagcagaagcgccgccgacgacatcaaccccgcccccgccaacatggagggcggcggcggcagcgtggccgtggccggcctgggcgccagaggcagcggcgccgccgccgccaccgtgagagagctgctgcaggacggctgctacagcgacttcctgaacgaggacttcgacgtgaagacctacaccagccagagcatccaccaggccgtgatcgccgagcagctggccaagctggcccagggcatcagccagctggacagagagctgcacctgcaggtggtggccagacacgaggacctgctggcccaggccaccggcatcgagagcctggagggcgtgctgcagatgatgcagaccagaatcggcgccctgcagggcgccgtggacagaatcaaggccaagatcgtggagccctacaacaagatcgtggccagaaccgcccagctggccagactgcaggtggcctgcgacctgctgagaagaatcatcagaatcctgaacctgagcaagagactgcagggccagctgcagggcggcagcagagagatcaccaaggccgcccagagcctgaacgagctggactacctgagccagggcatcgacctgagcggcatcgaggtgatcgagaacgacctgctgttcatcgccagagccagactggaggtggagaaccaggccaagagactgctggagcagggcctggagacccagaaccccacccaggtgggcaccgccctgcaggtgttctacaacctgggcaccctgaaggacaccatcaccagcgtggtggacggctactgcgccaccctggaggagaacatcaacagcgccctggacatcaaggtgctgacccagcccagccagagcgccgtgagaggcggccccggcagaagcaccatgcccacccccggcaacaccgccgccctgagagccagcttctggaccaacatggagaagctgatggaccacatctacgccgtgtgcggccaggtgcagcacctgcagaaggtgctggccaagaagagagaccccgtgagccacatctgcttcatcgaggagatcgtgaaggacggccagcccgagatcttctacaccttctggaacagcgtgacccaggccctgagcagccagttccacatggccaccaacagcagcatgttcctgaagcaggccttcgagggcgagtaccccaagctgctgagactgtacaacgacctgtggaagagactgcagcagtacagccagcacatccagggcaacttcaacgccagcggcaccaccgacctgtacgtggacctgcagcacatggaggacgacgcccaggacatcttcatccccaagaagcccgactacgaccccgagaaggccctgaaggacagcctgcagccctacgaggccgcctacctgagcaagagcctgagcagactgttcgaccccatcaacctggtgttcccccccggcggcagaaacccccccagcagcgacgagctggacggcatcatcaagaccatcgccagcgagctgaacgtggccgccgtggacaccaacctgaccctggccgtgagcaagaacgtggccaagaccatccagctgtacagcgtgaagagcgagcagctgctgagcacccagggcgacgccagccaggtgatcggccccctgaccgagggccagagaagaaacgtggccgtggtgaacagcctgtacaagctgcaccagagcgtgaccaaggtggtgagcagccagagcagcttccccctggccgccgagcagaccatcatcagcgccctgaaggccatccacgccctgatggagaacgccgtgcagcccctgctgaccagcgtgggcgacgccatcgaggccatcatcatcaccatgcaccaggaggacttcagcggcagcctgagcagcagcggcaagcccgacgtgccctgcagcctgtacatgaaggagctgcagggcttcatcgccagagtgatgagcgactacttcaagcacttcgagtgcctggacttcgtgttcgacaacaccgaggccatcgcccagagagccgtggagctgttcatcagacacgccagcctgatcagacccctgggcgagggcggcaagatgagactggccgccgacttcgcccagatggagctggccgtgggccccttctgcagaagagtgagcgacctgggcaagagctacagaatgctgagaagcttcagacccctgctgttccaggccagcgagcacgtggccagcagccccgccctgggcgacgtgatccccttcagcatcatcatccagttcctgttcaccagagcccccgccgagctgaagagccccttccagagagccgagtggagccacaccagattcagccagtggctggacgaccaccccagcgagaaggacagactgctgctgatcagaggcgccctggaggcctacgtgcagagcgtgagaagcagagagggcaaggagttcgcccccgtgtaccccatcatggtgcagctgctgcagaaggccatgagcgccctgcagtag

SEQ ID NO: 77561 - DNA, 2520 bp, Artificial Sequence
  Description of Artificial Sequence: Synthetic coding sequence
atgggctgggtgggcggcagaagaagagacagcgccagcccccccggcagaagcagaagcgccgccgacgacatcaaccccgcccccgccaacatggagggcggcggcggcagcgtggccgtggccggcctgggcgccagaggcagcggcgccgccgccgccaccgtgagagagctgctgcaggacggctgctacagcgacttcctgaacgaggacttcgacgtgaagacctacaccagccagagcatccaccaggccgtgatcgccgagcagctggccaagctggcccagggcatcagccagctggacagagagctgcacctgcaggtggtggccagacacgaggacctgctggcccaggccaccggcatcgagagcctggagggcgtgctgcagatgatgcagaccagaatcggcgccctgcagggcgccgtggacagaatcaaggccaagatcgtggagccctacaacaagatcgtggccagaaccgcccagctggccagactgcaggtggcctgcgacctgctgagaagaatcatcagaatcctgaacctgagcaagagactgcagggccagctgcagggcggcagcagagagatcaccaaggccgcccagagcctgaacgagctggactacctgagccagggcatcgacctgagcggcatcgaggtgatcgagaacgacctgctgttcatcgccagagccagactggaggtggagaaccaggccaagagactgctggagcagggcctggagacccagaaccccacccaggtgggcaccgccctgcaggtgttctacaacctgggcaccctgaaggacaccatcaccagcgtggtggacggctactgcgccaccctggaggagaacatcaacagcgccctggacatcaaggtgctgacccagcccagccagagcgccgtgagaggcggccccggcagaagcaccatgcccacccccggcaacaccgccgccctgagagccagcttctggaccaacatggagaagctgatggaccacatctacgccgtgtgcggccaggtgcagcacctgcagaaggtgctggccaagaagagagaccccgtgagccacatctgcttcatcgaggagatcgtgaaggacggccagcccgagatcttctacaccttctggaacagcgtgacccaggccctgagcagccagttccacatggccaccaacagcagcatgttcctgaagcaggccttcgagggcgagtaccccaagctgctgagactgtacaacgacctgtggaagagactgcagcagtacagccagcacatccagggcaacttcaacgccagcggcaccaccgacctgtacgtggacctgcagcacatggaggacgacgcccaggacatcttcatccccaagaagcccgactacgaccccgagaaggccctgaaggacagcctgcagccctacgaggccgcctacctgagcaagagcctgagcagactgttcgaccccatcaacctggtgttcccccccggcggcagaaacccccccagcagcgacgagctggacggcatcatcaagaccatcgccagcgagctgaacgtggccgccgtggacaccaacctgaccctggccgtgagcaagaacgtggccaagaccatccagctgtacagcgtgaagagcgagcagctgctgagcacccagggcgacgccagccaggtgatcggccccctgaccgagggccagagaagaaacgtggccgtggtgaacagcctgtacaagctgcaccagagcgtgaccaaggccatccacgccctgatggagaacgccgtgcagcccctgctgaccagcgtgggcgacgccatcgaggccatcatcatcaccatgcaccaggaggacttcagcggcagcctgagcagcagcggcaagcccgacgtgccctgcagcctgtacatgaaggagctgcagggcttcatcgccagagtgatgagcgactacttcaagcacttcgagtgcctggacttcgtgttcgacaacaccgaggccatcgcccagagagccgtggagctgttcatcagacacgccagcctgatcagacccctgggcgagggcggcaagatgagactggccgccgacttcgcccagatggagctggccgtgggccccttctgcagaagagtgagcgacctgggcaagagctacagaatgctgagaagcttcagacccctgctgttccaggccagcgagcacgtggccagcagccccgccctgggcgacgtgatccccttcagcatcatcatccagttcctgttcaccagagcccccgccgagctgaagagccccttccagagagccgagtggagccacaccagattcagccagtggctggacgaccaccccagcgagaaggacagactgctgctgatcagaggcgccctggaggcctacgtgcagagcgtgagaagcagagagggcaaggagttcgcccccgtgtaccccatcatggtgcagctgctgcagaaggccatgagcgccctgcagtag

SEQ ID NO: 77562 - DNA, 2472 bp, Artificial Sequence
  Description of Artificial Sequence: Synthetic coding sequence
atgggctgggtgggcggcagaagaagagacagcgccagcccccccggcagaagcagaagcgccgccgacgacatcaaccccgcccccgccaacatggagggcggcggcggcagcgtggccgtggccggcctgggcgccagaggcagcggcgccgccgccgccaccgtgagagagctgctgcaggacggctgctacagcgacttcctgaacgaggacttcgacgtgaagacctacaccagccagagcatccaccaggccgtgatcgccgagcagctggccaagctggcccagggcatcagccagctggacagagagctgcacctgcaggtggtggccagacacgaggacctgctggcccaggccaccggcatcgagagcctggagggcgtgctgcagatgatgcagaccagaatcggcgccctgcagggcgccgtggacagaatcaaggccaagatcgtggagccctacaacaagatcgtggccagaaccgcccagctggccagactgcaggtggcctgcgacctgctgagaagaatcatcagaatcctgaacctgagcaagagactgcagggccagctgcagggcggcagcagagagatcaccaaggccgcccagagcctgaacgagctggactacctgagccagggcatcgacctgagcggcatcgaggtgatcgagaacgacctgctgttcatcgccagagccagactggaggtggagaaccaggccaagagactgctggagcagggcctggagacccagaaccccacccaggtgggcaccgccctgcaggtgttctacaacctgggcaccctgaaggacaccatcaccagcgtggtggacggctactgcgccaccctggaggagaacatcaacagcgccctggacatcaaggtgctgacccagcccagccagagcgccgtgagaggcggccccggcagaagcaccatgcccacccccggcaacaccgccgccctgagagccagcttctggaccaacatggagaagctgatggaccacatctacgccgtgtgcggccaggtgcagcacctgcagaaggtgctggccaagaagagagaccccgtgagccacatctgcttcatcgaggagatcgtgaaggacggccagcccgagatcttctacaccttctggaacagcgtgacccaggccctgagcagccagttccacatggccaccaacagcagcatgttcctgaagcaggccttcgagggcgagtaccccaagctgctgagactgtacaacgacctgtggaagagactgcagcagtacagccagcacatccagggcaacttcaacgccagcggcaccaccgacctgtacgtggacctgcagcacatggaggacgacgcccaggacatcttcatccccaagaagcccgactacgaccccgagaaggccctgaaggacagcctgcagccctacgaggccgcctacctgagcaagagcctgagcagactgttcgaccccatcaacctggtgttcccccccggcggcagaaacccccccagcagcgacgagctggacggcatcatcaagaccatcgccagcgagctgaacgtggccgccgtggacaccaacctgaccctggccgtgagcaagaacgtggccaagaccatccagctgtacagcgtgaagagcgagcagctgctgagcacccagggcgacgccagccaggtgatcggccccctgaccgagggccagagaagaaacgtggccgtggtgaacagcctgtacaagctgcaccagagcgtgaccaaggtggtgagcagccagagcagcttccccctggccgccgagcagaccatcatcagcgccctgaaggccatccacgccctgatggagaacgccgtgcagcccctgctgaccagcgtgggcgacgccatcgaggccatcatcatcaccatgcaccaggaggacttcagcggcagcctgagcagcagcggcaagcccgacgtgccctgcagcctgtacatgaaggagctgcagggcttcatcgccagagtgatgagcgactacttcaagcacttcgagtgcctggacttcgtgttcgacaacaccgaggccatcgcccagagagccgtggagctgttcatcagacacgccagcctgatcagacccctgggcgagggcggcaagatgagactggccgccgacttcgcccagatggagctggccgtgggccccttctgcagaagagtgagcgacctgggcaagagctacagaatgctgagaagcttcagacccctgctgttccaggccagcgagcacgtggccagcagccccgccctgggcgacgtgatccccttcagcatcatcatccagttcctgttcaccagagcccccgccgagctgaagagccccttccagagagccgagtggagccacaccagattcagccagtggctggacgaccaccccagcgagaaggacagactgctgctgatcagatag

SEQ ID NO: 77563 - DNA, 2067 bp, Artificial Sequence
  Description of Artificial Sequence: Synthetic coding sequence
atgagaggcagattcgcccacgcccagtacagcagatgcctgagaggcccctgcctggccgaggtggccgccggcggcggcaccagaagcgccatggccgagggcagcggcgaggtggtggccgtgagcgccaccggcgccgccaacggcctgaacaacggcgccggcggcaccagcgccaccacctgcaaccccctgagcagaaagctgcacaagatcctggagaccagactggacaacgacaaggagatgctggaggccctgaaggccctgagcaccttcttcgtggagaacagcctgagaaccagaagaaacctgagaggcgacatcgagagaaagagcctggccatcaacgaggagttcgtgagcatcttcaaggaggtgaaggaggagctggagagcatcagcgaggacgtgcaggccatgagcaactgctgccaggacatgaccagcagactgcaggccgccaaggagcagacccaggacctgatcgtgaagaccaccaagctgcagagcgagagccagaagctggagatcagagcccaggtggccgacgccttcctgagcaagttccagctgaccagcgacgagatgagcctgctgagaggcaccagagagggccccatcaccgaggacttcttcaaggccctgggcagagtgaagcagatccacaacgacgtgaaggtgctgctgagaaccaaccagcagaccgccggcctggagatcatggagcagatggccctgctgcaggagaccgcctacgagagactgtacagatgggcccagagcgagtgcagaaccctgacccaggagagctgcgacgtgagccccgtgctgacccaggccatggaggccctgcaggacagacccgtgctgtacaagtacaccctggacgagttcggcaccgccagaagaagcaccgtggtgagaggcttcatcgacgccctgaccagaggcggccccggcggcacccccagacccatcgagatgcacagccacgaccccctgagatacgtgggcgacatgctggcctggctgcaccaggccaccgccagcgagaaggagcacctggaggccctgctgaagcacgtgaccacccagggcgtggaggagaacatccaggaggtggtgggccacatcaccgagggcgtgtgcagacccctgaaggtgagaatcgagcaggtgatcgtggccgagcccggcgccgtgctgctgtacaagatcagcaacctgctgaagttctaccaccacaccatcagcggcatcgtgggcaacagcgccaccgccctgctgaccaccatcgaggagatgcacctgctgagcaagaagatcttcttcaacagcctgagcctgcacgccagcaagctgatggacaaggtggagctgcccccccccgacctgggccccagcagcgccctgaaccagaccctgatgctgctgagagaggtgctggccagccacgacagcagcgtggtgcccctggacgccagacaggccgacttcgtgcaggtgctgagctgcgtgctggaccccctgctgcagatgtgcaccgtgagcgccagcaacctgggcaccgccgacatggccaccttcatggtgaacagcctgtacatgatgaagaccaccctggccctgttcgagttcaccgacagaagactggagatgctgcagttccagatcgaggcccacctggacaccctgatcaacgagcaggccagctacgtgctgaccagagtgggcctgagctacatctacaacaccgtgcagcagcacaagcccgagcagggcagcctggccaacatgcccaacctggacagcgtgaccctgaaggccgccatggtgcagttcgacagatacctgagcgcccccgacaacctgctgatcccccagctgaacttcctgctgagcgccaccgtgaaggagcagatcgtgaagcagagcaccgagctggtgtgcagagcctacggcgaggtgtacgccgccgtgatgaaccccatcaacgagtacaaggaccccgagaacatcctgcacagaagcccccagcaggtgcagaccctgctgagctag

SEQ ID NO: 77564 - DNA, 1848 bp, Artificial Sequence
  Description of Artificial Sequence: Synthetic coding sequence
atggccgagggcagcggcgaggtggtggccgtgagcgccaccggcgccgccaacggcctgaacaacggcgccggcggcaccagcgccaccacctgcaaccccctgagcagaaagctgcacaagatcctggagaccagactggacaacgacaaggagatgctggaggccctgaaggccctgagcaccttcttcgtggagaacagcctgagaaccagaagaaacctgagaggcgacatcgagagaaagagcctggccatcaacgaggagttcgtgagcatcttcaaggaggtgaaggaggagctggagagcatcagcgaggacgtgcaggccatgagcaactgctgccaggacatgaccagcagactgcaggccgccaaggagcagacccaggacctgatcgtgaagaccaccaagctgcagagcgagagccagaagctggagatcagagcccaggtggccgacgccttcctgagcaagttccagctgaccagcgacgagatgagcctgctgagaggcaccagagagggccccatcaccgaggacttcttcaaggccctgggcagagtgaagcagatccacaacgacgtgaaggtgctgctgagaaccaaccagcagaccgccggcctggagatcatggagcagatggccctgctgcaggagaccgcctacgagagactgtacagatgggcccagagcgagtgcagaaccctgacccaggagagctgcgacgtgagccccgtgctgacccaggccatggaggccctgcaggacagacccgtgctgtacaagtacaccctggacgagttcggcaccgccagaagaagcaccgtggtgagaggcttcatcgacgccctgaccagaggcggccccggcggcacccccagacccatcgagatgcacagccacgaccccctgagatacgtgggcgacatgctggcctggctgcaccaggccaccgccagcgagaaggagcacctggaggccctgctgaagcacgtgaccacccagggcgtggaggagaacatccaggaggtggtgggccacatcaccgagggcgtgtgcagacccctgaaggtgagaatcgagcaggtgatcgtggccgagcccggcgccgtgctgctgtacaagatcagcaacctgctgaagttctaccaccacaccatcagcggcatcgtgggcaacagcgccaccgccctgctgaccaccatcgaggagatgcacctgctgagcaagaagatcttcttcaacagcctgagcctgcacgccagcaagctgatggacaaggtggagctgcccccccccgacctgggccccagcagcgccctgaaccagaccctgatgctgctgagagaggtgctggccagccacgacagcagcgtggtgcccctggacgccagacaggccgacttcgtgcaggtgctgagctgcgtgctggaccccctgctgcagatgtgcaccgtgagcgccagcaacctgggcaccgccgacatggccaccttcatggtgaacagcctgtacatgatgaagaccaccctggccctgttcgagttcaccgacagaagactggagatgctgcagttccagatcgaggcccacctggacaccctgatcaacgagcaggccagctacgtgctgaccagagtgggcctgagctacatctacaacaccgtgcagcagcacaagcccgagcagggcagcctggccaacatgcccaacctggacagcgtgaccctgaaggccgccatggtgcagttcgacagatacctgagcgcccccgacaacctgctgatcccccagctgaacttcctgctgagcgccaccgtgaagagaccccccaacggcccctag

SEQ ID NO: 77565 - DNA, 1974 bp, Artificial Sequence
  Description of Artificial Sequence: Synthetic coding sequence
atggccgagggcagcggcgaggtggtggccgtgagcgccaccggcgccgccaacggcctgaacaacggcgccggcggcaccagcgccaccacctgcaaccccctgagcagaaagctgcacaagatcctggagaccagactggacaacgacaaggagatgctggaggccctgaaggccctgagcaccttcttcgtggagaacagcctgagaaccagaagaaacctgagaggcgacatcgagagaaagagcctggccatcaacgaggagttcgtgagcatcttcaaggaggtgaaggaggagctggagagcatcagcgaggacgtgcaggccatgagcaactgctgccaggacatgaccagcagactgcaggccgccaaggagcagacccaggacctgatcgtgaagaccaccaagctgcagagcgagagccagaagctggagatcagagcccaggtggccgacgccttcctgagcaagttccagctgaccagcgacgagatgagcctgctgagaggcaccagagagggccccatcaccgaggacttcttcaaggccctgggcagagtgaagcagatccacaacgacgtgaaggtgctgctgagaaccaaccagcagaccgccggcctggagatcatggagcagatggccctgctgcaggagaccgcctacgagagactgtacagatgggcccagagcgagtgcagaaccctgacccaggagagctgcgacgtgagccccgtgctgacccaggccatggaggccctgcaggacagacccgtgctgtacaagtacaccctggacgagttcggcaccgccagaagaagcaccgtggtgagaggcttcatcgacgccctgaccagaggcggccccggcggcacccccagacccatcgagatgcacagccacgaccccctgagatacgtgggcgacatgctggcctggctgcaccaggccaccgccagcgagaaggagcacctggaggccctgctgaagcacgtgaccacccagggcgtggaggagaacatccaggaggtggtgggccacatcaccgagggcgtgtgcagacccctgaaggtgagaatcgagcaggtgatcgtggccgagcccggcgccgtgctgctgtacaagatcagcaacctgctgaagttctaccaccacaccatcagcggcatcgtgggcaacagcgccaccgccctgctgaccaccatcgaggagatgcacctgctgagcaagaagatcttcttcaacagcctgagcctgcacgccagcaagctgatggacaaggtggagctgcccccccccgacctgggccccagcagcgccctgaaccagaccctgatgctgctgagagaggtgctggccagccacgacagcagcgtggtgcccctggacgccagacaggccgacttcgtgcaggtgctgagctgcgtgctggaccccctgctgcagatgtgcaccgtgagcgccagcaacctgggcaccgccgacatggccaccttcatggtgaacagcctgtacatgatgaagaccaccctggccctgttcgagttcaccgacagaagactggagatgctgcagttccagatcgaggcccacctggacaccctgatcaacgagcaggccagctacgtgctgaccagagtgggcctgagctacatctacaacaccgtgcagcagcacaagcccgagcagggcagcctggccaacatgcccaacctggacagcgtgaccctgaaggccgccatggtgcagttcgacagatacctgagcgcccccgacaacctgctgatcccccagctgaacttcctgctgagcgccaccgtgaaggagcagatcgtgaagcagagcaccgagctggtgtgcagagcctacggcgaggtgtacgccgccgtgatgaaccccatcaacgagtacaaggaccccgagaacatcctgcacagaagcccccagcaggtgcagaccctgctgagctag

SEQ ID NO: 77566 - DNA, 2313 bp, Artificial Sequence
  Description of Artificial Sequence: Synthetic coding sequence
atggacttcagcaagttcctggccgacgacttcgacgtgaaggagtggatcaacgccgccttcagagccggcagcaaggaggccgccagcggcaaggccgacggccacgccgccaccctggtgatgaagctgcagctgttcatccaggaggtgaaccacgccgtggaggagaccagccaccaggccctgcagaacatgcccaaggtgctgagagacgtggaggccctgaagcaggaggccagcttcctgaaggagcagatgatcctggtgaaggaggacatcaagaagttcgagcaggacaccagccagagcatgcaggtgctggtggagatcgaccaggtgaagagcagaatgcagctggccgccgagagcctgcaggaggccgacaagtggagcaccctgagcgccgacatcgaggagaccttcaagacccaggacatcgccgtgatcagcgccaagctgaccggcatgcagaacagcctgatgatgctggtggacacccccgactacagcgagaagtgcgtgcacctggaggccctgaagaacagactggaggccctggccagcccccagatcgtggccgccttcaccagccaggccgtggaccagagcaaggtgttcgtgaaggtgttcaccgagatcgacagaatgccccagctgctggcctactactacaagtgccacaaggtgcagctgctggccgcctggcaggagctgtgccagagcgacctgagcctggacagacagctgaccggcctgtacgacgccctgctgggcgcctggcacacccagatccagtgggccacccaggtgttccagaagccccacgaggtggtgatggtgctgctgatccagaccctgggcgccctgatgcccagcctgcccagctgcctgagcaacggcgtggagagagccggccccgagcaggagctgaccagactgctggagttctacgacgccaccgcccacttcgccaagggcctggagatggccctgctgccccacctgcacgagcacaacctggtgaaggtgaccgagctggtggacgccgtgtacgacccctacaagccctaccagctgaagtacggcgacatggaggagagcaacctgctgatccagatgagcgccgtgcccctggagcacggcgaggtgatcgactgcgtgcaggagctgagccacagcgtgaacaagctgttcggcctggccagcgccgccgtggacagatgcgtgagattcaccaacggcctgggcacctgcggcctgctgagcgccctgaagagcctgttcgccaagtacgtgagcgacttcaccagcaccctgcagagcatcagaaagaagtgcaagctggaccacatcccccccaacagcctgttccaggaggactggaccgccttccagaacagcatcagaatcatcgccacctgcggcgagctgctgagacactgcggcgacttcgagcagcagctggccaacagaatcctgagcaccgccggcaagtacctgagcgacagctgcagccccagaagcctggccggcttccaggagagcatcctgaccgacaagaagaacagcgccaagaacccctggcaggagtacaactacctgcagaaggacaaccccgccgagtacgccagcctgatggagatcctgtacaccctgaaggagaagggcagcagcaaccacaacctgctggccgcccccagagccgccctgaccagactgaaccagcaggcccaccagctggccttcgacagcgtgttcctgagaatcaagcagcagctgctgctgatcagcaagatggacagctggaacaccgccggcatcggcgagaccctgaccgacgagctgcccgccttcagcctgacccccctggagtacatcagcaacatcggccagtacatcatgagcctgcccctgaacctggagcccttcgtgacccaggaggacagcgccctggagctggccctgcacgccggcaagctgcccttcccccccgagcagggcgacgagctgcccgagctggacaacatggccgacaactggctgggcagcatcgccagagccaccatgcagacctactgcgacgccatcctgcagatccccgagctgagcccccacagcgccaagcagctggccaccgacatcgactacctgatcaacgtgatggacgccctgggcctgcagcccagcagaaccctgcagcacatcgtgaccctgctgaagaccagacccgaggactacagacaggtgagcaagggcctgcccagaagactggccaccaccgtggccaccatgagaagcgtgaactactag

SEQ ID NO: 77567 - DNA, 1839 bp, Artificial Sequence
  Description of Artificial Sequence: Synthetic coding sequence
atggccaccgccgccaccatccccagcgtggccaccgccaccgccgccgccctgggcgaggtggaggacgagggcctgctggccagcctgttcagagacagattccccgaggcccagtggagagagagacccgacgtgggcagatacctgagagagctgagcggcagcggcctggagagactgagaagagagcccgagagactggccgaggagagagcccagctgctgcagcagaccagagacctggccttcgccaactacaagaccttcatcagaggcgccgagtgcaccgagagaatccacagactgttcggcgacgtggaggccagcctgggcagactgctggacagactgcccagcttccagcagagctgcagaaacttcgtgaaggaggccgaggagatcagcagcaacagaagaatgaacagcctgaccctgaacagacacaccgagatcctggagatcctggagatcccccagctgatggacacctgcgtgagaaacagctactacgaggaggccctggagctggccgcctacgtgagaagactggagagaaagtacagcagcatccccgtgatccagggcatcgtgaacgaggtgagacagagcatgcagctgatgctgagccagctgatccagcagctgagaaccaacatccagctgcccgcctgcctgagagtgatcggctacctgagaagaatggacgtgttcaccgaggccgagctgagagtgaagttcctgcaggccagagacgcctggctgagaagcatcctgaccgccatccccaacgacgacccctacttccacatcaccaagaccatcgaggccagcagagtgcacctgttcgacatcatcacccagtacagagccatcttcagcgacgaggaccccctgctgccccccgccatgggcgagcacaccgtgaacgagagcgccatcttccacggctgggtgctgcagaaggtgagccagttcctgcaggtgctggagaccgacctgtacagaggcatcggcggccacctggacagcctgctgggccagtgcatgtacttcggcctgagcttcagcagagtgggcgccgacttcagaggccagctggcccccgtgttccagagagtggccatcagcaccttccagaaggccatccaggagaccgtggagaagttccaggaggagatgaacagctacatgctgatcagcgcccccgccatcctgggcaccagcaacatgcccgccgccgtgcccgccacccagcccggcaccctgcagccccccatggtgctgctggacttcccccccctggcctgcttcctgaacaacatcctggtggccttcaacgacctgagactgtgctgccccgtggccctggcccaggacgtgaccggcgccctggaggacgccctggccaaggtgaccaagatcatcctggccttccacagagccgaggaggccgccttcagcagcggcgagcaggagctgttcgtgcagttctgcaccgtgttcctggaggacctggtgccctacctgaacagatgcctgcaggtgctgttcccccccgcccagatcgcccagaccctgggcatcccccccacccagctgagcaagtacggcaacctgggccacgtgaacatcggcgccatccaggagcccctggccttcatcctgcccaagagagagaccctgttcaccctggacgaccaggccctgggccccgagctgaccgcccccgcccccgagccccccgccgaggagcccagactggagcccgccggccccgcctgccccgagggcggcagagccgagacccaggccgagccccccagcgtgggcccctag

SEQ ID NO: 77568 - DNA, 2109 bp, Artificial Sequence
  Description of Artificial Sequence: Synthetic coding sequence
atggagagccccagcgcccccccccacagatggtgcatcccctggcagagactgctgctgaccgccagcctgctgaccttctggaacccccccaccaccgccaagctgaccatcgagagcacccccttcaacgtggccgagggcaaggaggtgctgctgctggtgcacaacctgccccagcacctgttcggctacagctggtacaagggcgagagagtggacggcaacagacagatcatcggctacgtgatcggcacccagcaggccacccccggccccgcctacagcggcagagagatcatctaccccaacgccagcctgctgatccagaacatcatccagaacgacaccggcttctacaccctgcacgtgatcaagagcgacctggtgaacgaggaggccaccggccagttcagagtgtaccccgagctgcccaagcccagcatcagcagcaacaacagcaagcccgtggaggacaaggacgccgtggccttcacctgcgagcccgagacccaggacgccacctacctgtggtgggtgaacaaccagagcctgcccgtgagccccagactgcagctgagcaacggcaacagaaccctgaccctgttcaacgtgaccagaaacgacaccgccagctacaagtgcgagacccagaaccccgtgagcgccagaagaagcgacagcgtgatcctgaacgtgctgtacggccccgacgcccccaccatcagccccctgaacaccagctacagaagcggcgagaacctgaacctgagctgccacgccgccagcaacccccccgcccagtacagctggttcgtgaacggcaccttccagcagagcacccaggagctgttcatccccaacatcaccgtgaacaacagcggcagctacacctgccaggcccacaacagcgacaccggcctgaacagaaccaccgtgaccaccatcaccgtgtacgccgagccccccaagcccttcatcaccagcaacaacagcaaccccgtggaggacgaggacgccgtggccctgacctgcgagcccgagatccagaacaccacctacctgtggtgggtgaacaaccagagcctgcccgtgagccccagactgcagctgagcaacgacaacagaaccctgaccctgctgagcgtgaccagaaacgacgtgggcccctacgagtgcggcatccagaacaagctgagcgtggaccacagcgaccccgtgatcctgaacgtgctgtacggccccgacgaccccaccatcagccccagctacacctactacagacccggcgtgaacctgagcctgagctgccacgccgccagcaacccccccgcccagtacagctggctgatcgacggcaacatccagcagcacacccaggagctgttcatcagcaacatcaccgagaagaacagcggcctgtacacctgccaggccaacaacagcgccagcggccacagcagaaccaccgtgaagaccatcaccgtgagcgccgagctgcccaagcccagcatcagcagcaacaacagcaagcccgtggaggacaaggacgccgtggccttcacctgcgagcccgaggcccagaacaccacctacctgtggtgggtgaacggccagagcctgcccgtgagccccagactgcagctgagcaacggcaacagaaccctgaccctgttcaacgtgaccagaaacgacgccagagcctacgtgtgcggcatccagaacagcgtgagcgccaacagaagcgaccccgtgaccctggacgtgctgtacggccccgacacccccatcatcagcccccccgacagcagctacctgagcggcgccaacctgaacctgagctgccacagcgccagcaaccccagcccccagtacagctggagaatcaacggcatcccccagcagcacacccaggtgctgttcatcgccaagatcacccccaacaacaacggcacctacgcctgcttcgtgagcaacctggccaccggcagaaacaacagcatcgtgaagagcatcaccgtgagcgccagcggcaccagccccggcctgagcgccggcgccaccgtgggcatcatgatcggcgtgctggtgggcgtggccctgatctag

SEQ ID NO: 77569 - DNA, 981 bp, Artificial Sequence
  Description of Artificial Sequence: Synthetic coding sequence
atgatggcctacatgaaccccggcccccactacagcgtgaacgccctggccctgagcggccccagcgtggacctgatgcaccaggccgtgccctaccccagcccccccctggccctggacccccccagaagacagagacaggagagaaccgtgtacaccgagagccagcagaaggtgctggagttctacttccagaaggaccagtaccccaactacgaccagagactgaacctggccgagatgctgagcctgagagagcagcagctgcaggtgtggttcaagaacagaagagccaagctggccagagagagaagactgcagcagcagccccagagagtgcccggccagagaggcagaggcgccagagccgcccccctggtgcccgtggccgccgccagcttccccggcggccccgagttcccccagggcagaggcagctggatcagcccccagcccggcccctggggcgtgctgcccgccgccgagcccaagatctacagcctgcccagaacctggggcggccccgagtgcggcacccaggagggcctgaaggccgtgcccgcccccggccccggccccatccccgcccccatccccggccccgcccagatccccggccccgtgcccggccccgcccccaacctgggccccatgagcggccccctgagcgtgagcatccccggccccatccccgcccccatcagctgccccggccccatccccgaccccgtgctgggcagaaccctgatgcccggccccggcagcctgcccacccccgcccccggcgccctgtggccccagagcccctacgccagcaacctgagccccgacacccagctgtaccccgacttcaccaagctgctgcccctgctggacagattcgaggagagcagcctgagcaccaccaccagccagtacaaggaggaggacggcttcgtggacaagaaccacagcgtgcccagaagcctgctggacctgtag

SEQ ID NO: 77570 - DNA, 900 bp, Artificial Sequence
  Description of Artificial Sequence: Synthetic coding sequence
atgatggcctacatgaaccccggcccccactacagcgtgaacgccctggccctgagcggccccagcgtggacctgatgcaccaggccgtgccctaccccagcgcccccagaaagcagagaagagagagaaccaccttcaccagaagccagctggaggagctggaggccctgttcgccaagacccagtaccccgacgtgtacgccagagaggaggtggccctgaagatcaacctgcccgagagcagagtgcaggtgtggttcaagaacagaagagccaagtgcagacagcagagacagcagcagaagcagcagcagcagccccccggcggccaggccaaggccagacccgccaagagaaaggccggcaccagccccagacccagcaccgacgtgtgccccgaccccctgggcatcagcgacagctacagcccccccctgcccggccccagcggcagccccaccaccgccgtggccaccgtgagcatctggagccccgccagcgagagccccctgcccgaggcccagagagccggcctggtggccagcggccccagcctgaccagcgccccctacgccatgacctacgcccccgccagcgccttctgcagcagccccagcgcctacggcagccccagcagctacttcagcggcctggacccctacctgagccccatggtgccccagctgggcggccccgccctgagccccctgagcggccccagcgtgggccccagcctggcccagagccccaccagcctgagcggccagagctacggcgcctacagccccgtggacagcctggagttcaaggaccccaccggcacctggaagttcacctacaaccccatggaccccctggactacaaggaccagagcgcctggaagttccagatcctgtag

SEQ ID NO: 77571 - DNA, 900 bp, Artificial Sequence; identical to SEQ ID NO: 77570
  Description of Artificial Sequence: Synthetic coding sequence

SEQ ID NO: 77572 - DNA, 900 bp, Artificial Sequence; identical to SEQ ID NO: 77570
  Description of Artificial Sequence: Synthetic coding sequence

SEQ ID NO: 77573 - DNA, 3678 bp, Artificial Sequence
  Description of Artificial Sequence: Synthetic coding sequence
atggccgccgtgctggagagcctgctgagagaggaggtgagcgtggccgccgtggtgagatggatcgccagaagcacccagggcagcgaggacaacgccggcgaggccgccgccctgagcagcctgagagccctgagaaaggagttcgtgcccttcctgctgaacttcctgagagagcagagcagcagagtgctgccccagggcccccccacccccgccaagacccccggcgccagcgccgccctgcccggcagacccggcggcccccccagaggcagcagaggcgccagaagccagctgttcccccccaccgaggcccagagcaccgccgccgaggcccccctggccagaagaggcggcagaagaagaggccccggccccgccagagagagaggcggcagaggcctggaggagggcgtgagcggcgagagcctgcccggcgccggcggcagaagactgagaggcagcggcagccccagcagacccagcctgaccctgagcgacccccccaacctgagcaacctggaggagttcccccccgtgggcagcgtgccccccggccccaccgagacccagctgagctgcagaagatgggtgcccagaagactgtggggcgtgagccacagcagcagcgccctgagaagcggcgcccccggctgcagaaccaagcccagcagaagaatcaaccccacccccgtgagcgaggagagaagcctgagcaagcccaagacctgcttcaccagcccccccatcagctgcgtgcccagcagcaagcagctgcagcagagccccacccccacctgccccacccccgagctgggcagccccctgcccagcagaaccggcagcctgaccgacgagcccgccgaccccgccagagtgagcagcagacagagactggagctggtggccctggtgtacagcagctgcatcgccgagaacctggtgcccaacctgttcctggagctgttcttcgtgttccagctgctgaccgccagaagaatggtgaccgccaaggacagcgaccccgagctgagccccgccgtgctggacagcctggagagccccctgttccagagcatccacgactgcgtgttcttcgccgtgcaggtgctggagtgccacttccaggtgctgagcaacctggacaagggcaccctgaagctgctggccgagaacgagagactgctgtgcttcagccccgccctgcagggcagactgagagccgcctacgagggcagcgtggccaaggtgagcctggtgatgccccccagcacccaggccgtgagcttccagcccgagaccgacaacagagccaacttcagcagcgacagagccttccacaccttcaagaagcagagagacgtgttctacgaggtgctgagagagtgggaggaccaccacgaggagcccggctgggacttcgagaagggcctgggcagcagaatcagagccatgatgggccagctgagcgccgcctgcagccacagccacttcgtgagactgttccagaagcagctgctgcagatgtgccagagccccggcggcgccggcggcaccgtgctgggcgaggcccccgacgtgctgagcatgctgggcgccgacaagctgggcagactgtggagactgcaggagagactgatggccccccagagcagcggcggcccctgccccccccccaccttccccggctgccagggcttcttcagagacttcatcctgagcgccagcagcttccagttcaaccagcacctgatggacagcctgagcctgaagatccaggagctgaacggcctggccctgccccagcacgagcccaacgacgaggacggcgagagcgacgtggactggcagggcgagagaaagcagttcgccgtggtgctgctgagcctgagactgctggccaagttcctgggcttcgtggccttcctgccctacagaggccccgagcccccccccaccggcgagctgcaggacagcatcctggccctgagaagccaggtgccccccgtgctggacgtgagaaccctgctgcagagaggcctgcaggccagaagagccgtgctgaccgtgccctggctggtggagttcctgagcttcgccgaccacgtggtgcccctgctggagtactacagagacatcttcaccctgctgctgagactgcacagaagcctggtgctgagccaggagagcgagggcaagatgtgcttcctgaacaagctgctgctgctggccgtgctgggctggctgttccagatccccaccgtgcccgaggacctgttcttcctggaggagggccccagctacgccttcgaggtggacaccgtggcccccgagcacggcctggacaacgcccccgtggtggaccagcagctgctgtacacctgctgcccctacatcggcgagctgagaaagctgctggccagctgggtgagcggcagcagcggcagaagcggcggcttcatgagaaagatcacccccaccaccaccaccagcctgggcgcccagcccagccagaccagccagggcctgcaggcccagctggcccaggccttcttccacaaccagccccccagcctgagaagaaccgtggagttcgtggccgagagaatcggcagcaactgcgtgaagcacatcaaggccaccctggtggccgacctggtgagacaggccgagagcctgctgcaggagcagctggtgacccagggcgaggagggcggcgaccccgcccagctgctggagatcctgtgcagccagctgtgcccccacggcgcccaggccctggccctgggcagagagttctgccagagaaagagccccggcgccgtgagagccctgctgcccgaggagacccccgccgccgtgctgagcagcgccgagaacatcgccgtgggcctggccaccgagaaggcctgcgcctggctgagcgccaacatcaccgccctgatcagaagagaggtgaaggccgccgtgagcagaaccctgagagcccagggccccgagcccgccgccagaggcgagagaagaggctgcagcagagcctgcgagcaccacgcccccctgcccagccacctgatcagcgagatcaaggacgtgctgagcctggccgtgggccccagagaccccgacgagggcgtgagccccgagcacctggagcagctgctgggccagctgggccagaccctgagatgcagacagttcctgtgcccccccgccgagcagcacctggccaagtgcagcgtggagctggccagcctgctggtggccgaccagatccccatcctgggcccccccgcccagtacagactggagagaggccaggccagaagactgctgcacatgctgctgagcctgtggaaggaggacttccagggccccgtgcccctgcagctgctgctgagccccagaaacgtgggcctgctggccgacaccagacccagagagtgggacctgctgctgttcctgctgagagagctggtggagaagggcctgatgggcagaatggagatcgaggcctgcctgggcagcctgcaccaggcccagtggcccggcgacttcgccgaggagctggccaccctgagcaacctgttcctggccgagccccacctgcccgagccccagctgagagcctgcgagctggtgcagcccaacagaggcaccgtgctggcccagagctag

SEQ ID NO: 77574 - DNA, 3684 bp, Artificial Sequence
  Description of Artificial Sequence: Synthetic coding sequence
atggccgccgtgctggagagcctgctgagagaggaggtgagcgtggccgccgtggtgagatggatcgccagaagcacccagggcagcgaggacaacgccggcgaggccgccgccctgagcagcctgagagccctgagaaaggagttcgtgcccttcctgctgaacttcctgagagagcagagcagcagagtgctgccccagggcccccccacccccgccaagacccccggcgccagcgccgccctgcccggcagacccggcggcccccccagaggcagcagaggcgccagaagccagctgttcccccccaccgaggcccagagcaccgccgccgaggcccccctggccagaagaggcggcagaagaagaggccccggccccgccagagagagaggcggcagaggcctggaggagggcgtgagcggcgagagcctgcccggcgccggcggcagaagactgagaggcagcggcagccccagcagacccagcctgaccctgagcgacccccccaacctgagcaacctggaggagttcccccccgtgggcagcgtgccccccggccccaccggcaccaagcccagcagaagaatcaaccccacccccgtgagcgaggagagaagcctgagcaagcccaagacctgcttcaccagcccccccatcagctgcgtgcccagcagccagcccagcgccctggacaccagcccctggggcctgggcctgccccccggctgcagaagcctgcaggaggagagagagatgctgagaaaggagagaagcaagcagctgcagcagagccccacccccacctgccccacccccgagctgggcagccccctgcccagcagaaccggcagcctgaccgacgagcccgccgaccccgccagagtgagcagcagacagagactggagctggtggccctggtgtacagcagctgcatcgccgagaacctggtgcccaacctgttcctggagctgttcttcgtgttccagctgctgaccgccagaagaatggtgaccgccaaggacagcgaccccgagctgagccccgccgtgctggacagcctggagagccccctgttccagagcatccacgactgcgtgttcttcgccgtgcaggtgctggagtgccacttccaggtgctgagcaacctggacaagggcaccctgaagctgctggccgagaacgagagactgctgtgcttcagccccgccctgcagggcagactgagagccgcctacgagggcagcgtggccaaggtgagcctggtgatgccccccagcacccaggccgtgagcttccagcccgagaccgacaacagagccaacttcagcagcgacagagccttccacaccttcaagaagcagagagacgtgttctacgaggtgctgagagagtgggaggaccaccacgaggagcccggctgggacttcgagaagggcctgggcagcagaatcagagccatgatgggccagctgagcgccgcctgcagccacagccacttcgtgagactgttccagaagcagctgctgcagatgtgccagagccccggcggcgccggcggcaccgtgctgggcgaggcccccgacgtgctgagcatgctgggcgccgacaagctgggcagactgtggagactgcaggagagactgatggccccccagagcagcggcggcccctgccccccccccaccttccccggctgccagggcttcttcagagacttcatcctgagcgccagcagcttccagttcaaccagcacctgatggacagcctgagcctgaagatccaggagctgaacggcctggccctgccccagcacgagcccaacgacgaggacggcgagagcgacgtggactggcagggcgagagaaagcagttcgccgtggtgctgctgagcctgagactgctggccaagttcctgggcttcgtggccttcctgccctacagaggccccgagcccccccccaccggcgagctgcaggacagcatcctggccctgagaagccaggtgccccccgtgctggacgtgagaaccctgctgcagagaggcctgcaggccagaagagccgtgctgaccgtgccctggctggtggagttcctgagcttcgccgaccacgtggtgcccctgctggagtactacagagacatcttcaccctgctgctgagactgcacagaagcctggtgctgagccaggagagcgagggcaagatgtgcttcctgaacaagctgctgctgctggccgtgctgggctggctgttccagatccccaccgtgcccgaggacctgttcttcctggaggagggccccagctacgccttcgaggtggacaccgtggcccccgagcacggcctggacaacgcccccgtggtggaccagcagctgctgtacacctgctgcccctacatcggcgagctgagaaagctgctggccagctgggtgagcggcagcagcggcagaagcggcggcttcatgagaaagatcacccccaccaccaccaccagcctgggcgcccagcccagccagaccagccagggcctgcaggcccagctggcccaggccttcttccacaaccagccccccagcctgagaagaaccgtggagttcgtggccgagagaatcggcagcaactgcgtgaagcacatcaaggccaccctggtggccgacctggtgagacaggccgagagcctgctgcaggagcagctggtgacccagggcgaggagggcggcgaccccgcccagctgctggagatcctgtgcagccagctgtgcccccacggcgcccaggccctggccctgggcagagagttctgccagagaaagagccccggcgccgtgagagccctgctgcccgaggagacccccgccgccgtgctgagcagcgccgagaacatcgccgtgggcctggccaccgagaaggcctgcgcctggctgagcgccaacatcaccgccctgatcagaagagaggtgaaggccgccgtgagcagaaccctgagagcccagggccccgagcccgccgccagaggcgagagaagaggctgcagcagagcctgcgagcaccacgcccccctgcccagccacctgatcagcgagatcaaggacgtgctgagcctggccgtgggccccagagaccccgacgagggcgtgagccccgagcacctggagcagctgctgggccagctgggccagaccctgagatgcagacagttcctgtgcccccccgccgagcagcacctggccaagtgcagcgtggagctggccagcctgctggtggccgaccagatccccatcctgggcccccccgcccagtacagactggagagaggccaggccagaagactgctgcacatgctgctgagcctgtggaaggaggacttccagggccccgtgcccctgcagctgctgctgagccccagaaacgtgggcctgctggccgacaccagacccagagagtgggacctgctgctgttcctgctgagagagctggtggagaagggcctgatgggcagaatggagatcgaggcctgcctgggcagcctgcaccaggcccagtggcccggcgacttcgccgaggagctggccaccctgagcaacctgttcctggccgagccccacctgcccgagccccagctgagagcctgcgagctggtgcagcccaacagaggcaccgtgctggcccagagctag

SEQ ID NO: 77575 - DNA, 2697 bp, Artificial Sequence
  Description of Artificial Sequence: Synthetic coding sequence
atggccctgatcatggagcccgtgagcaagtggagccccagccaggtggtggactggatgaagggcctggacgactgcctgcagcagtacatcaagaacttcgagagagagaagatcagcggcgaccagctgctgagaatcacccaccaggagctggaggacctgggcgtgagcagaatcggccaccaggagctgatcctggaggccgtggacctgctgtgcgccctgaactacggcctggagaccgagaacctgaagaccctgagccacaagctgaacgccagcgccaagaacctgcagaacttcatcaccggcagaagaagaagcggccactacgacggcagaaccagcagaaagctgcccaacgacttcctgaccagcgtggtggacctgatcggcgccgccaagagcctgctggcctggctggacagaagccccttcgccgccgtgaccgactacagcgtgaccagaaacaacgtgatccagctgtgcctggagctgaccaccatcgtgcagcaggactgcaccgtgtacgagaccgagaacaagatcctgcacgtgtgcaagaccctgagcggcgtgtgcgaccacatcatcagcctgagcagcgaccccctggtgagccagagcgcccacctggaggtgatccagctggccaacatcaagcccagcgagggcctgggcatgtacatcaagagcacctacgacggcctgcacgtgatcaccggcaccaccgagaacagccccgccgacagatgcaagaagatccacgccggcgacgaggtgatccaggtgaaccaccagaccgtggtgggctggcagctgaagaacctggtgaacgccctgagagaggaccccagcggcgtgatcctgaccctgaagaagagaccccagagcatgctgaccagcgcccccgccctgctgaagaacatgagatggaagcccctggccctgcagcccctgatccccagaagccccaccagcagcgtggccacccccagcagcaccatcagcacccccaccaagagagacagcagcgccctgcaggacctgtacatcccccccccccccgccgagccctacatccccagagacgagaagggcaacctgccctgcgaggacctgagaggccacatggtgggcaagcccgtgcacaagggcagcgagagccccaacagcttcctggaccaggagtacagaaagagattcaacatcgtggaggaggacaccgtgctgtactgctacgagtacgagaagggcagaagcagcagccagggcagaagagagagcacccccacctacggcaagctgagacccatcagcatgcccgtggagtacaactgggtgggcgactacgaggaccccaacaagatgaagagagacagcagaagagagaacagcctgctgagatacatgagcaacgagaagatcgcccaggaggagtacatgttccagagaaacagcaagaaggacaccggcaagaagagcaagaagaagggcgacaagagcaacagccccacccactacagcctgctgcccagcctgcagatggacgccctgagacaggacatcatgggcacccccgtgcccgagaccaccctgtaccacaccttccagcagagcagcctgcagcacaagagcaagaagaagaacaagggccccatcgccggcaagagcaagagaagaatcagctgcaaggacctgggcagaggcgactgcgagggctggctgtggaagaagaaggacgccaagagctacttcagccagaagtggaagaagtactggttcgtgctgaaggacgccagcctgtactggtacatcaacgaggaggacgagaaggccgagggcttcatcagcctgcccgagttcaagatcgacagagccagcgagtgcagaaagaagtacgccttcaaggcctgccaccccaagatcaagagcttctacttcgccgccgagcacctggacgacatgaacagatggctgaacagaatcaacatgctgaccgccggctacgccgagagagagagaatcaagcaggagcaggactactggagcgagagcgacaaggaggaggccgacacccccagcacccccaagcaggacagccccccccccccctacgacacctaccccagaccccccagcatgagctgcgccagcccctacgtggaggccaagcacagcagactgagcagcaccgagaccagccagagccagagcagccacgaggagttcagacaggaggtgaccggcagcagcgccgtgagccccatcagaaagaccgccagccagagaagaagctggcaggacctgatcgagacccccctgaccagcagcggcctgcactacctgcagaccctgcccctggaggacagcgtgttcagcgacagcgccgccatcagccccgagcacagaagacagagcaccctgcccacccagaagtgccacctgcaggaccactacggcccctaccccctggccgagagcgagagaatgcaggtgctgaacggcaacggcggcaagcccagaagcttcaccctgcccagagacagcggcttcaaccactgctgcctgaacgcccccgtgagcgcctgcgacccccaggacgacgtgcagccccccgaggtggaggaggaggaggaggaggaggaggaggagggcgaggccgccggcgagaacatcggcgagaagagctag

SEQ ID NO: 77576 - DNA, 3105 bp, Artificial Sequence
  Description of Artificial Sequence: Synthetic coding sequence
atggccctgatcatggagcccgtgagcaagtggagccccagccaggtggtggactggatgaagggcctggacgactgcctgcagcagtacatcaagaacttcgagagagagaagatcagcggcgaccagctgctgagaatcacccaccaggagctggaggacctgggcgtgagcagaatcggccaccaggagctgatcctggaggccgtggacctgctgtgcgccctgaactacggcctggagaccgagaacctgaagaccctgagccacaagctgaacgccagcgccaagaacctgcagaacttcatcaccggcagaagaagaagcggccactacgacggcagaaccagcagaaagctgcccaacgacttcctgaccagcgtggtggacctgatcggcgccgccaagagcctgctggcctggctggacagaagccccttcgccgccgtgaccgactacagcgtgaccagaaacaacgtgatccagctgtgcctggagctgaccaccatcgtgcagcaggactgcaccgtgtacgagaccgagaacaagatcctgcacgtgtgcaagaccctgagcggcgtgtgcgaccacatcatcagcctgagcagcgaccccctggtgagccagagcgcccacctggaggtgatccagctggccaacatcaagcccagcgagggcctgggcatgtacatcaagagcacctacgacggcctgcacgtgatcaccggcaccaccgagaacagccccgccgacagatgcaagaagatccacgccggcgacgaggtgatccaggtgaaccaccagaccgtggtgggctggcagctgaagaacctggtgaacgccctgagagaggaccccagcggcgtgatcctgaccctgaagaagagaccccagagcatgctgaccagcgcccccgccctgctgaagaacatgagatggaagcccctggccctgcagcccctgatccccagaagccccaccagcagcgtggccacccccagcagcaccatcagcacccccaccaagagagacagcagcgccctgcaggacctgtacatcccccccccccccgccgagccctacatccccagagacgagaagggcaacctgccctgcgaggacctgagaggccacatggtgggcaagcccgtgcacaagggcagcgagagccccaacagcttcctggaccaggagtacagaaagagattcaacatcgtggaggaggacaccgtgctgtactgctacgagtacgagaagggcagaagcagcagccagggcagaagagagagcacccccacctacggcaagctgagacccatcagcatgcccgtggagtacaactgggtgggcgactacgaggaccccaacaagatgaagagagacagcagaagagagaacagcctgctgagatacatgagcaacgagaagatcgcccaggaggagtacatgttccagagaaacagcaagaaggacaccggcaagaagagcaagaagaagggcgacaagagcaacagccccacccactacagcctgctgcccagcctgcagatggacgccctgagacaggacatcatgggcacccccgtgcccgagaccaccctgtaccacaccttccagcagagcagcctgcagcacaagagcaagaagaagaacaagggccccatcgccggcaagagcaagagaagaatcagctgcaaggacctgggcagaggcgactgcgagggctggctgtggaagaagaaggacgccaagagctacttcagccagaagtggaagaagtactggttcgtgctgaaggacgccagcctgtactggtacatcaacgaggaggacgagaaggccgagggcttcatcagcctgcccgagttcaagatcgacagagccagcgagtgcagaaagaagtacgccttcaaggcctgccaccccaagatcaagagcttctacttcgccgccgagcacctggacgacatgaacagatggctgaacagaatcaacatgctgaccgccggctacgccgagagagagagaatcaagcaggagcaggactactggagcgagagcgacaaggaggaggccgacacccccagcacccccaagcaggacagccccccccccccctacgacacctaccccagaccccccagcatgagctgcgccagcccctacgtggaggccaagcacagcagactgagcagcaccgagaccagccagagccagagcagccacgaggagttcagacaggaggtgaccggcagcagcgccgtgagccccatcagaaagaccgccagccagagaagaagctggcaggacctgatcgagacccccctgaccagcagcggcctgcactacctgcagaccctgcccctggaggacagcgtgttcagcgacagcgccgccatcagccccgagcacagaagacagagcaccctgcccacccagaagtgccacctgcaggaccactacggcccctaccccctggccgagagcgagagaatgcaggtgctgaacggcaacggcggcaagcccagaagcttcaccctgcccagagacagcggcttcaaccactgctgcctgaacgcccccgtgagcgcctgcgacccccaggacgacgtgcagccccccgaggtggaggaggaggaggaggaggaggaggaggagggcgaggccgccggcgagaacatcggcgagaagagcgagagcagagaggagaagctgggcgacagcctgcaggacctgtacagagccctggagcaggccagcctgagccccctgggcgagcacagaatcagcaccaagatggagtacaagctgagcttcatcaagagatgcaacgaccccgtgatgaacgagaagctgcacagactgagaatcctgaagagcaccctgaaggccagagagggcgaggtggccatcatcgacaaggtgctggacaaccccgacctgaccagcaaggagttccagcagtggaagcagatgtacctggacctgttcctggacatctgccagaacaccaccagcaacgaccccctgagcatcagcagcgaggtggacgtgatcaccagcagcctggcccacacccacagctacatcgagacccacgtgtag

SEQ ID NO: 77577 - DNA, 3015 bp, Artificial Sequence
  Description of Artificial Sequence: Synthetic coding sequence
atggccctgatcatggagcccgtgagcaagtggagccccagccaggtggtggactggatgaagggcctggacgactgcctgcagcagtacatcaagaacttcgagagagagaagatcagcggcgaccagctgctgagaatcacccaccaggagctggaggacctgggcgtgagcagaatcggccaccaggagctgatcctggaggccgtggacctgctgtgcgccctgaactacggcctggagaccgagaacctgaagaccctgagccacaagctgaacgccagcgccaagaacctgcagaacttcatcaccggcagaagaagaagcggccactacgacggcagaaccagcagaaagctgcccaacgacttcctgaccagcgtggtggacctgatcggcgccgccaagagcctgctggcctggctggacagaagccccttcgccgccgtgaccgactacagcgtgaccagaaacaacgtgatccagctgtgcctggagctgaccaccatcgtgcagcaggactgcaccgtgtacgagaccgagaacaagatcctgcacgtgtgcaagaccctgagcggcgtgtgcgaccacatcatcagcctgagcagcgaccccctggtgagccagagcgcccacctggaggtgatccagctggccaacatcaagcccagcgagggcctgggcatgtacatcaagagcacctacgacggcctgcacgtgatcaccggcaccaccgagaacagccccgccgacagatgcaagaagatccacgccggcgacgaggtgatccaggtgaaccaccagaccgtggtgggctggcagctgaagaacctggtgaacgccctgagagaggaccccagcggcgtgatcctgaccctgaagaagagaccccagagcatgctgaccagcgcccccgccctgctgaagaacatgagatggaagcccctggccctgcagcccctgatccccagaagccccaccagcagcgtggccacccccagcagcaccatcagcacccccaccaagagagacagcagcgccctgcaggacctgtacatcccccccccccccgccgagccctacatccccagagacgagaagggcaacctgccctgcgaggacctgagaggccacatggtgggcaagcccgtgcacaagggcagcgagagccccaacagcttcctggaccaggagtacagaaagagattcaacatcgtggaggaggacaccgtgctgtactgctacgagtacgagaagggcagaagcagcagccagggcagaagagagagcacccccacctacgagaacagcctgctgagatacatgagcaacgagaagatcgcccaggaggagtacatgttccagagaaacagcaagaaggacaccggcaagaagagcaagaagaagggcgacaagagcaacagccccacccactacagcctgctgcccagcctgcagatggacgccctgagacaggacatcatgggcacccccgtgcccgagaccaccctgtaccacaccttccagcagagcagcctgcagcacaagagcaagaagaagaacaagggccccatcgccggcaagagcaagagaagaatcagctgcaaggacctgggcagaggcgactgcgagggctggctgtggaagaagaaggacgccaagagctacttcagccagaagtggaagaagtactggttcgtgctgaaggacgccagcctgtactggtacatcaacgaggaggacgagaaggccgagggcttcatcagcctgcccgagttcaagatcgacagagccagcgagtgcagaaagaagtacgccttcaaggcctgccaccccaagatcaagagcttctacttcgccgccgagcacctggacgacatgaacagatggctgaacagaatcaacatgctgaccgccggctacgccgagagagagagaatcaagcaggagcaggactactggagcgagagcgacaaggaggaggccgacacccccagcacccccaagcaggacagccccccccccccctacgacacctaccccagaccccccagcatgagctgcgccagcccctacgtggaggccaagcacagcagactgagcagcaccgagaccagccagagccagagcagccacgaggagttcagacaggaggtgaccggcagcagcgccgtgagccccatcagaaagaccgccagccagagaagaagctggcaggacctgatcgagacccccctgaccagcagcggcctgcactacctgcagaccctgcccctggaggacagcgtgttcagcgacagcgccgccatcagccccgagcacagaagacagagcaccctgcccacccagaagtgccacctgcaggaccactacggcccctaccccctggccgagagcgagagaatgcaggtgctgaacggcaacggcggcaagcccagaagcttcaccctgcccagagacagcggcttcaaccactgctgcctgaacgcccccgtgagcgcctgcgacccccaggacgacgtgcagccccccgaggtggaggaggaggaggaggaggaggaggaggagggcgaggccgccggcgagaacatcggcgagaagagcgagagcagagaggagaagctgggcgacagcctgcaggacctgtacagagccctggagcaggccagcctgagccccctgggcgagcacagaatcagcaccaagatggagtacaagctgagcttcatcaagagatgcaacgaccccgtgatgaacgagaagctgcacagactgagaatcctgaagagcaccctgaaggccagagagggcgaggtggccatcatcgacaaggtgctggacaaccccgacctgaccagcaaggagttccagcagtggaagcagatgtacctggacctgttcctggacatctgccagaacaccaccagcaacgaccccctgagcatcagcagcgaggtggacgtgatcaccagcagcctggcccacacccacagctacatcgagacccacgtgtag

SEQ ID NO: 77578 - DNA, 2550 bp, Artificial Sequence
  Description of Artificial Sequence: Synthetic coding sequence
atggccctgatcatggagcccgtgagcaagtggagccccagccaggtggtggactggatgaagggcctggacgactgcctgcagcagtacatcaagaacttcgagagagagaagatcagcggcgaccagctgctgagaatcacccaccaggagctggaggacctgggcgtgagcagaatcggccaccaggagctgatcctggaggccgtggacctgctgtgcgccctgaactacggcctggagaccgagaacctgaagaccctgagccacaagctgaacgccagcgccaagaacctgcagaacttcatcaccggcagaagaagaagcggccactacgacggcagaaccagcagaaagctgcccaacgacttcctgaccagcgtggtggacctgatcggcgccgccaagagcctgctggcctggctggacagaagccccttcgccgccgtgaccgactacagcgtgaccagaaacaacgtgatccagctgtgcctggagctgaccaccatcgtgcagcaggactgcaccgtgtacgagaccgagaacaagatcctgcacgtgtgcaagaccctgagcggcgtgtgcgaccacatcatcagcctgagcagcgaccccctggtgagccagagcgcccacctggaggtgatccagctggccaacatcaagcccagcgagggcctgggcatgtacatcaagagcacctacgacggcctgcacgtgatcaccggcaccaccgagaacagccccgccgacagatgcaagaagatccacgccggcgacgaggtgatccaggtgaaccaccagaccgtgcccctgatccccagaagccccaccagcagcgtggccacccccagcagcaccatcagcacccccaccaagagagacagcagcgccctgcaggacctgtacatcccccccccccccgccgagccctacatccccagagacgagaagggcaacctgccctgcgaggacctgagaggccacatggtgggcaagcccgtgcacaagggcagcgagagccccaacagcttcctggaccaggagtacagaaagagattcaacatcgtggaggaggacaccgtgctgtactgctacgagtacgagaagggcagaagcagcagccagggcagaagagagagcacccccacctacggcaagctgagacccatcagcatgcccgtggagtacaactgggtgggcgactacgaggaccccaacaagatgaagagagacagcagaagagagaacagcctgctgagatacatgagcaacgagaagatcgcccaggaggagtacatgttccagagaaacagcaagaaggacaccggcaagaagagcaagaagaagggcgacaagagcaacagccccacccactacagcctgctgcccagcctgcagatggacgccctgagacaggacatcatgggcacccccgtgcccgagaccaccctgtaccacaccttccagcagagcagcctgcagcacaagagcaagaagaagaacaagggccccatcgccggcaagagcaagagaagaatcagctgcaaggacctgggcagaggcgactgcgagggctggctgtggaagaagaaggacgccaagagctacttcagccagaagtggaagaagtactggttcgtgctgaaggacgccagcctgtactggtacatcaacgaggaggacgagaaggccgagggcttcatcagcctgcccgagttcaagatcgacagagccagcgagtgcagaaagaagtacgccttcaaggcctgccaccccaagatcaagagcttctacttcgccgccgagcacctggacgacatgaacagatggctgaacagaatcaacatgctgaccgccggctacgccgagagagagagaatcaagcaggagcaggactactggagcgagagcgacaaggaggaggccgacacccccagcacccccaagcaggacagccccccccccccctacgacacctaccccagaccccccagcatgagctgcgccagcccctacgtggaggccaagcacagcagactgagcagcaccgagaccagccagagccagagcagccacgaggagttcagacaggaggtgaccggcagcagcgccgtgagccccatcagaaagaccgccagccagagaagaagctggcaggacctgatcgagacccccctgaccagcagcggcctgcactacctgcagaccctgcccctggaggacagcgtgttcagcgacagcgccgccatcagccccgagcacagaagacagagcaccctgcccacccagaagtgccacctgcaggaccactacggcccctaccccctggccgagagcgagagaatgcaggtgctgaacggcaacggcggcaagcccagaagcttcaccctgcccagagacagcggcttcaaccactgctgcctgaacgcccccgtgagcgcctgcgacccccaggacgacgtgcagccccccgaggtggaggaggaggaggaggaggaggaggaggagggcgaggccgccggcgagaacatcggcgagaagagctag

SEQ ID NO: 77579 - DNA, 414 bp, Artificial Sequence
  Description of Artificial Sequence: Synthetic coding sequence
atggacgacagcgacacccccacctactacctgcagatcgagccccaggacggctgccaccccggcgacagcgtggagagaagcgtgacctgcctgcccagcgccagcgacgagaacgagaaccagctggacggcgacggccacgagcacctgaccagcagcgacagcgccatgggcaagccccaggtgagcgagcaggacagcctgaacaacaacgagagctgcaccctgagctgcgaggtggccgccggcgagaacctgcagaacaccctgtgcgaggccagcagagacgagcaggccttcctgggcaaggacaagaagatccccggcaagagaagccccagaagcaagaagggcaccgccaagaagatcccccccgacagcagaatcctgttccccggcggcggcctgtag

SEQ ID NO: 77580 - DNA, 1851 bp, Artificial Sequence
  Description of Artificial Sequence: Synthetic coding sequence
atggacgacagcgacacccccacctactacctgcagatcgagccccaggacggctgccaccccggcgacagcgtggagagaagcgtgacctgcctgcccagcgccagcgacgagaacgagaaccagctggacggcgacggccacgagcacctgaccagcagcgacagcgccatgggcaagccccaggtgagcgagcaggacagcctgaacaacaacgagagctgcaccctgagctgcgaggtggccgccggcgagaacctgcagaacaccctgtgcgaggccagcagagacgagcaggccttcctgggcaaggacaagaagatccccggcaagagaagccccagaagcaagaagggcaccgccaagaagatcccccccggcctgttcagcggcgacatcgcccccctgatgcaggagaaggtgctgagcgccgtgacctacgccgtggacgacgaggaggccgccgaggtgaacgccaacgagcagcccgaggcccccaagctggtgctgcagagcctgttcagcctgatcagaggcgaggtggagcagctggacagcagagccctgcccctgtgcctgcaccagatcgccgagagctacttccaggaggaggactacgagaaggccatgaagttcatccagctggagagactgtaccacgagcagctgctggccaacctgagcgccatccaggagcagtgggagaccaagtggaagaccgtgcagccccacaccgtgaccgccctgagaaacagcgagaagggcttcaacggcgaggacttcgagagactgaccaagatctgcgccacccaccaggaccccctgctgagcaagcacaagatcgccgccgtggagaagagccaggagagaaagtgcagcacccagctgctggtgagcgaggaccccaaggagggcggcgccaccaccaaggagagcgagagcaagacctgcctgggcaccgagagcagcaaggagagccagcacaccgtggagcccctgggcagcagcccctgctgccaccagatggacgtgcagaccgacagccccagcctgagcgtgaccgccggcaaggaccacatggaggagctgctgtgcagcgccgaggccaccctggccctgcacacccagagcagcgagaccgccggcagccccagcggccccgacagcagcgaggacgcctgcgaggacgacagcagactgcagctggcccagaccgaggcctgccaggacgtggccagaatcgagggcatcgccgaggaccccaaggtgttcctgagcagcaagagcaagaccgagcccctgatcagccccggctgcgacagaatcccccccgccctgatcagcgagggcaagtacagccaggcccagagaaaggagctgagactgcccctgagagacgccagcgaggccctgcccaccgaccagctggagaacaacgagctgaacgagctgcagcagcccgacctgaccgacagcgacggcaagagcccccaggcccaggccgacagcgacggcagcgagaacgtgctgtgcggcaacaaccagatcagcgacctgggcatcctgctgcccgaggtgtgcatggcccccgaggagaagggcgacaaggacgaccagctgaacaaggagaccgaggactacctgaacagcctgctggagggctgcctgaaggacaccgaggacagcctgagctacgaggacaaccaggacgacgacagcgacctgctgcaggacctgagccccgaggaggccagctacagcctgcaggagaacctgcccagcgacgagagctgcctgagcctggacgacctggccaagagaatcgagatcgccgaggtgaaccagagatag

SEQ ID NO: 77581 - DNA, 2178 bp, Artificial Sequence
  Description of Artificial Sequence: Synthetic coding sequence
atggacgacagcgacacccccacctactacctgcagatcgagccccaggacggctgccaccccggcgacagcgtggagagaagcgtgacctgcctgcccagcgccagcgacgagaacgagaaccagctggacggcgacggccacgagcacctgaccagcagcgacagcgccatgggcaagccccaggtgagcgagcaggacagcctgaacaacaacgagagctgcaccctgagctgcgaggtggccgccggcgagaacctgcagaacaccctgtgcgaggccagcagagacgagcaggccttcctgggcaaggacaagaagatccccggcaagagaagccccagaagcaagaagggcaccgccaagaagatcccccccggcctgttcagcggcgacatcgcccccctgatgcaggagaaggtgctgagcgccgtgacctacgccgtggacgacgaggaggccgccgaggtgaacgccaacgagcagcccgaggcccccaagctggtgctgcagagcctgttcagcctgatcagaggcgaggtggagcagctggacagcagagccctgcccctgtgcctgcaccagatcgccgagagctacttccaggaggaggactacgagaaggccatgaagttcatccagctggagagactgtaccacgagcagctgctggccaacctgagcgccatccaggagcagtgggagaccaagtggaagaccgtgcagccccacaccgtgaccgccctgagaaacagcgagaagggcttcaacggcgaggacttcgagagactgaccaagatctgcgccacccaccaggaccccctgctgagcaagcacaagatcgccgccgtggagaagagccaggagagaaagtgcagcacccagctgctggtgagcgaggaccccaaggagggcggcgccaccaccaaggagagcgagagcaagacctgcctgggcaccgagagcagcaaggagagccagcacaccgtggagcccctgggcagcagcccctgctgccaccagatggacgtgcagaccgacagccccagcctgagcgtgaccgccggcaaggaccacatggaggagctgctgtgcagcgccgaggccaccctggccctgcacacccagagcagcgagaccgccggcagccccagcggccccgacagcagcgaggacgcctgcgaggacgacagcagactgcagctggcccagaccgaggcctgccaggacgtggccagaatcgagggcatcgccgaggaccccaaggtgttcctgagcagcaagagcaagaccgagcccctgatcagccccggctgcgacagaatcccccccgccctgatcagcgagggcaagtacagccaggcccagagaaaggagctgagactgcccctgagagacgccagcgaggccctgcccaccgaccagctggagaacaacgagctgaacgagctgcagcagcccgacctgaccgacagcgacggcaagagcccccaggcccaggccgacagcgacggcagcgagaacgtgctgtgcggcaacaaccagatcagcgacctgggcatcctgctgcccgaggtgtgcatggcccccgaggagaagggcgacaaggacgaccagctgaacaaggagaccgaggactacctgaacagcctgctggagggctgcctgaaggacaccgaggacagcctgagctacgaggacaaccaggacgacgacagcgacctgctgcaggacctgagccccgaggaggccagctacagcctgcaggagaacctgcccagcgacgagagctgcctgagcctggacgacctggccaagagaatcgagatcgccgaggtggtgcccaccgagggcctggtgagcatcctgaagaagagaaacgacaccgtgggcgaccaccccgcccagatgcagcacaagcccagcaagagaagagtgagattccaggagatcgacgacagcctggaccaggacgaggtgggcggcggcagctgcatcctgctggtgctgctgtgcatcgccaccgtgttcctgagcgtgggcggcaccgccctgtactgcaccttcggcgacatggagagccccgtgtgcaccgacttcgccgacaacatggacttctactacaccaagctgctgcagggcgtggccgagctgaagcactggatctacctgagctag

SEQ ID NO: 77582 - DNA, 3057 bp, Artificial Sequence
  Description of Artificial Sequence: Synthetic coding sequence
atgaagatgtggctgctggtgagccacctggtgatcatcagcatcaccacctgcctggccgagttcacctggtacagaagatacggccacggcgtgagcgaggaggacaagggcttcggccccatcttcgaggagcagcccatcaacaccatctaccccgaggagagcctggagggcaaggtgagcctgaactgcagagccagagccagccccttccccgtgtacaagtggagaatgaacaacggcgacgtggacctgaccagcgacagatacagcatggtgggcggcaacctggtgatcaacaaccccgacaagcagaaggacgccggcatctactactgcctggccagcaacaactacggcatggtgagaagcaccgaggccaccctgagcttcggctacctggaccccttcccccccgaggagagacccgaggtgagagtgaaggagggcaagggcatggtgctgctgtgcgaccccccctaccacttccccgacgacctgagctacagatggctgctgaacgagttccccgtgttcatcaccatggacaagagaagattcgtgagccagaccaacggcaacctgtacatcgccaacgtggaggccagcgacaagggcaactacagctgcttcgtgagcagccccagcatcaccaagagcgtgttcagcaagttcatccccctgatccccatccccgagagaaccaccaagccctaccccgccgacatcgtggtgcagttcaaggacgtgtacgccctgatgggccagaacgtgaccctggagtgcttcgccctgggcaaccccgtgcccgacatcagatggagaaaggtgctggagcccatgcccagcaccgccgagatcagcaccagcggcgccgtgctgaagatcttcaacatccagctggaggacgagggcatctacgagtgcgaggccgagaacatcagaggcaaggacaagcaccaggccagaatctacgtgcaggccttccccgagtgggtggagcacatcaacgacaccgaggtggacatcggcagcgacctgtactggccctgcgtggccaccggcaagcccatccccaccatcagatggctgaagaacggctacgcctaccacaagggcgagctgagactgtacgacgtgaccttcgagaacgccggcatgtaccagtgcatcgccgagaacacctacggcgccatctacgccaacgccgagctgaagatcctggccctggcccccaccttcgagatgaaccccatgaagaagaagatcctggccgccaagggcggcagagtgatcatcgagtgcaagcccaaggccgcccccaagcccaagttcagctggagcaagggcaccgagtggctggtgaacagcagcagaatcctgatctgggaggacggcagcctggagatcaacaacatcaccagaaacgacggcggcatctacacctgcttcgccgagaacaacagaggcaaggccaacagcaccggcaccctggtgatcaccgaccccaccagaatcatcctggcccccatcaacgccgacatcaccgtgggcgagaacgccaccatgcagtgcgccgccagcttcgaccccgccctggacctgaccttcgtgtggagcttcaacggctacgtgatcgacttcaacaaggagaacatccactaccagagaaacttcatgctggacagcaacggcgagctgctgatcagaaacgcccagctgaagcacgccggcagatacacctgcaccgcccagaccatcgtggacaacagcagcgccagcgccgacctggtggtgagaggcccccccggcccccccggcggcctgagaatcgaggacatcagagccaccagcgtggccctgacctggagcagaggcagcgacaaccacagccccatcagcaagtacaccatccagaccaagaccatcctgagcgacgactggaaggacgccaagaccgacccccccatcatcgagggcaacatggaggccgccagagccgtggacctgatcccctggatggagtacgagttcagagtggtggccaccaacaccctgggcagaggcgagcccagcatccccagcaacagaatcaagaccgacggcgccgcccccaacgtggcccccagcgacgtgggcggcggcggcggcagaaacagagagctgaccatcacctgggcccccctgagcagagagtaccactacggcaacaacttcggctacatcgtggccttcaagcccttcgacggcgaggagtggaagaaggtgaccgtgaccaaccccgacaccggcagatacgtgcacaaggacgagaccatgagccccagcaccgccttccaggtgaaggtgaaggccttcaacaacaagggcgacggcccctacagcctggtggccgtgatcaacagcgcccaggacgcccccagcgaggcccccaccgaggtgggcgtgaaggtgctgagcagcagcgagatcagcgtgcactgggagcacgtgctggagaagatcgtggagagctaccagatcagatactgggccgcccacgacaaggaggaggccgccaacagagtgcaggtgaccagccaggagtacagcgccagactggagaacctgctgcccgacacccagtacttcatcgaggtgggcgcctgcaacagcgccggctgcggcccccccagcgacatgatcgaggccttcaccaagaaggccccccccagccagccccccagaatcatcagcagcgtgagaagcggcagcagatacatcatcacctgggaccacgtggtggccctgagcaacgagagcaccgtgaccggctacaaggtgctgtacagacccgacggccagcacgacggcaagctgtacagcacccacaagcacagcatcgaggtgcccatccccagagacggcgagtacgtggtggaggtgagagcccacagcgacggcggcgacggcgtggtgagccaggtgaagatcagcggcgcccccaccctgagccccagcctgctgggcctgctgctgcccgccttcggcatcctggtgtacctggagttctag

SEQ ID NO: 77583 - DNA, 3024 bp, Artificial Sequence
  Description of Artificial Sequence: Synthetic coding sequence
atgaagatgtggctgctggtgagccacctggtgatcatcagcatcaccacctgcctggccgtgagcgaggaggacaagggcttcggccccatcttcgaggagcagcccatcaacaccatctaccccgaggagagcctggagggcaaggtgagcctgaactgcagagccagagccagccccttccccgtgtacaagtggagaatgaacaacggcgacgtggacctgaccagcgacagatacagcatggtgggcggcaacctggtgatcaacaaccccgacaagcagaaggacgccggcatctactactgcctggccagcaacaactacggcatggtgagaagcaccgaggccaccctgagcttcggctacctggaccccttcccccccgaggagagacccgaggtgagagtgaaggagggcaagggcatggtgctgctgtgcgaccccccctaccacttccccgacgacctgagctacagatggctgctgaacgagttccccgtgttcatcaccatggacaagagaagattcgtgagccagaccaacggcaacctgtacatcgccaacgtggaggccagcgacaagggcaactacagctgcttcgtgagcagccccagcatcaccaagagcgtgttcagcaagttcatccccctgatccccatccccgagagaaccaccaagccctaccccgccgacatcgtggtgcagttcaaggacgtgtacgccctgatgggccagaacgtgaccctggagtgcttcgccctgggcaaccccgtgcccgacatcagatggagaaaggtgctggagcccatgcccagcaccgccgagatcagcaccagcggcgccgtgctgaagatcttcaacatccagctggaggacgagggcatctacgagtgcgaggccgagaacatcagaggcaaggacaagcaccaggccagaatctacgtgcaggccttccccgagtgggtggagcacatcaacgacaccgaggtggacatcggcagcgacctgtactggccctgcgtggccaccggcaagcccatccccaccatcagatggctgaagaacggctacgcctaccacaagggcgagctgagactgtacgacgtgaccttcgagaacgccggcatgtaccagtgcatcgccgagaacacctacggcgccatctacgccaacgccgagctgaagatcctggccctggcccccaccttcgagatgaaccccatgaagaagaagatcctggccgccaagggcggcagagtgatcatcgagtgcaagcccaaggccgcccccaagcccaagttcagctggagcaagggcaccgagtggctggtgaacagcagcagaatcctgatctgggaggacggcagcctggagatcaacaacatcaccagaaacgacggcggcatctacacctgcttcgccgagaacaacagaggcaaggccaacagcaccggcaccctggtgatcaccgaccccaccagaatcatcctggcccccatcaacgccgacatcaccgtgggcgagaacgccaccatgcagtgcgccgccagcttcgaccccgccctggacctgaccttcgtgtggagcttcaacggctacgtgatcgacttcaacaaggagaacatccactaccagagaaacttcatgctggacagcaacggcgagctgctgatcagaaacgcccagctgaagcacgccggcagatacacctgcaccgcccagaccatcgtggacaacagcagcgccagcgccgacctggtggtgagaggcccccccggcccccccggcggcctgagaatcgaggacatcagagccaccagcgtggccctgacctggagcagaggcagcgacaaccacagccccatcagcaagtacaccatccagaccaagaccatcctgagcgacgactggaaggacgccaagaccgacccccccatcatcgagggcaacatggaggccgccagagccgtggacctgatcccctggatggagtacgagttcagagtggtggccaccaacaccctgggcagaggcgagcccagcatccccagcaacagaatcaagaccgacggcgccgcccccaacgtggcccccagcgacgtgggcggcggcggcggcagaaacagagagctgaccatcacctgggcccccctgagcagagagtaccactacggcaacaacttcggctacatcgtggccttcaagcccttcgacggcgaggagtggaagaaggtgaccgtgaccaaccccgacaccggcagatacgtgcacaaggacgagaccatgagccccagcaccgccttccaggtgaaggtgaaggccttcaacaacaagggcgacggcccctacagcctggtggccgtgatcaacagcgcccaggacgcccccagcgaggcccccaccgaggtgggcgtgaaggtgctgagcagcagcgagatcagcgtgcactgggagcacgtgctggagaagatcgtggagagctaccagatcagatactgggccgcccacgacaaggaggaggccgccaacagagtgcaggtgaccagccaggagtacagcgccagactggagaacctgctgcccgacacccagtacttcatcgaggtgggcgcctgcaacagcgccggctgcggcccccccagcgacatgatcgaggccttcaccaagaaggccccccccagccagccccccagaatcatcagcagcgtgagaagcggcagcagatacatcatcacctgggaccacgtggtggccctgagcaacgagagcaccgtgaccggctacaaggtgctgtacagacccgacggccagcacgacggcaagctgtacagcacccacaagcacagcatcgaggtgcccatccccagagacggcgagtacgtggtggaggtgagagcccacagcgacggcggcgacggcgtggtgagccaggtgaagatcagcggcgcccccaccctgagccccagcctgctgggcctgctgctgcccgccttcggcatcctggtgtacctggagttctag

SEQ ID NO: 77584 - DNA, 1884 bp, Artificial Sequence
  Description of Artificial Sequence: Synthetic coding sequence
atgaagatgtggctgctggtgagccacctggtgatcatcagcatcaccacctgcctggccgagttcacctggtacagaagatacggccacggcgtgagcgaggaggacaagggcttcggccccatcttcgaggagcagcccatcaacaccatctaccccgaggagagcctggagggcaaggtgagcctgaactgcagagccagagccagccccttccccgtgtacaagtggagaatgaacaacggcgacgtggacctgaccagcgacagatacagcatggtgggcggcaacctggtgatcaacaaccccgacaagcagaaggacgccggcatctactactgcctggccagcaacaactacggcatggtgagaagcaccgaggccaccctgagcttcggctacctggaccccttcccccccgaggagagacccgaggtgagagtgaaggagggcaagggcatggtgctgctgtgcgaccccccctaccacttccccgacgacctgagctacagatggctgctgaacgagttccccgtgttcatcaccatggacaagagaagattcgtgagccagaccaacggcaacctgtacatcgccaacgtggaggccagcgacaagggcaactacagctgcttcgtgagcagccccagcatcaccaagagcgtgttcagcaagttcatccccctgatccccatccccgagagaaccaccaagccctaccccgccgacatcgtggtgcagttcaaggacgtgtacgccctgatgggccagaacgtgaccctggagtgcttcgccctgggcaaccccgtgcccgacatcagatggagaaaggtgctggagcccatgcccagcaccgccgagatcagcaccagcggcgccgtgctgaagatcttcaacatccagctggaggacgagggcatctacgagtgcgaggccgagaacatcagaggcaaggacaagcaccaggccagaatctacgtgcaggccttccccgagtgggtggagcacatcaacgacaccgaggtggacatcggcagcgacctgtactggccctgcgtggccaccggcaagcccatccccaccatcagatggctgaagaacggctacgcctaccacaagggcgagctgagactgtacgacgtgaccttcgagaacgccggcatgtaccagtgcatcgccgagaacacctacggcgccatctacgccaacgccgagctgaagatcctggccctggcccccaccttcgagatgaaccccatgaagaagaagatcctggccgccaagggcggcagagtgatcatcgagtgcaagcccaaggccgcccccaagcccaagttcagctggagcaagggcaccgagtggctggtgaacagcagcagaatcctgatctgggaggacggcagcctggagatcaacaacatcaccagaaacgacggcggcatctacacctgcttcgccgagaacaacagaggcaaggccaacagcaccggcaccctggtgatcaccgaccccaccagaatcatcctggcccccatcaacgccgacatcaccgtgggcgagaacgccaccatgcagtgcgccgccagcttcgaccccgccctggacctgaccttcgtgtggagcttcaacggctacgtgatcgacttcaacaaggagaacatccactaccagagaaacttcatgctggacagcaacggcgagctgctgatcagaaacgcccagctgaagcacgccggcagatacacctgcaccgcccagaccatcgtggacaacagcagcgccagcgccgacctggtggtgagaggcaagaacagaaagggcggcgagaagaacatggtggacagcttcctgcccgtgtgcgccagcctgccccccacctggtag

SEQ ID NO: 77585 - DNA, 1884 bp, Artificial Sequence; identical to SEQ ID NO: 77584
  Description of Artificial Sequence: Synthetic coding sequence

SEQ ID NO: 77586 - DNA, 1884 bp, Artificial Sequence; identical to SEQ ID NO: 77584
  Description of Artificial Sequence: Synthetic coding sequence

SEQ ID NO: 77587 - DNA, 258 bp, Artificial Sequence
  Description of Artificial Sequence: Synthetic coding sequence
atgaagatgtggctgctggtgagccacctggtgatcatcagcatcaccacctgcctggccgagttcacctggtacagaagatacggccacggcgtgagcgaggaggacaagggcttcggccccatcttcgaggagcagcccatcaacaccatctaccccgaggagagcctggagggcaaggtgagcctgaactgcagagccagagccagccccttccccgtgtacaagtggagaatgaacaacggcgacgtggactag

SEQ ID NO: 77588 - DNA, 3057 bp, Artificial Sequence; identical to SEQ ID NO: 77582
  Description of Artificial Sequence: Synthetic coding sequence

SEQ ID NO: 77589 - DNA, 192 bp, Artificial Sequence
  Description of Artificial Sequence: Synthetic coding sequence
atgaagatgtggctgctggtgagccacctggtgatcatcagcatcaccacctgcctggccgagttcacctggtacagaagatacggccacggcgtgagcgaggaggacaagggcttcggccccatcttcgaggagcagcccatcaacaccatctaccccgaggagagcctggagggcaaggtgagcctgtag

SEQ ID NO: 77590 - DNA, 273 bp, Artificial Sequence
  Description of Artificial Sequence: Synthetic coding sequence
atgaagatgtggctgctggtgagccacctggtgatcatcagcatcaccacctgcctggccgagttcacctggtacagaagatacggccacggcgtgagcgaggaggacaagggcttcggccccatcttcgaggagcagcccatcaacaccatctaccccgaggagagcctggagggcaaggtgagcctgaactgcagagccagagccagccccttccccgtgtacaagtggagaatgaacaacggcgacgtggacctgaccagcgacagatag

SEQ ID NO: 77591 - DNA, 222 bp, Artificial Sequence
  Description of Artificial Sequence: Synthetic coding sequence
atgaagatgtggctgctggtgagccacctggtgatcatcagcatcaccacctgcctggccgagttcacctggtacagaagatacggccacggcgtgagcgaggaggacaagggcttcggccccatcttcgaggagcagcccatcaacaccatctaccccgaggagagcctggagggcaaggtgagcctgaactgcagagccagagccagccccttcccctag

SEQ ID NO: 77592 - DNA, 3123 bp, Artificial Sequence
  Description of Artificial Sequence: Synthetic coding sequence
atgggcaccgccaccagaagaaagccccacctgctgctggtggccgccgtggccctggtgagcagcagcgcctggagcagcgccctgggcagccagaccaccttcggccccgtgttcgaggaccagcccctgagcgtgctgttccccgaggagagcaccgaggagcaggtgctgctggcctgcagagccagagccagcccccccgccacctacagatggaagatgaacggcaccgagatgaagctggagcccggcagcagacaccagctggtgggcggcaacctggtgatcatgaaccccaccaaggcccaggacgccggcgtgtaccagtgcctggccagcaaccccgtgggcaccgtggtgagcagagaggccatcctgagattcggcttcctgcaggagttcagcaaggaggagagagaccccgtgaaggcccacgagggctggggcgtgatgctgccctgcaacccccccgcccactaccccggcctgagctacagatggctgctgaacgagttccccaacttcatccccaccgacggcagacacttcgtgagccagaccaccggcaacctgtacatcgccagaaccaacgccagcgacctgggcaactacagctgcctggccaccagccacatggacttcagcaccaagagcgtgttcagcaagttcgcccagctgaacctggccgccgaggacaccagactgttcgcccccagcatcaaggccagattccccgccgagacctacgccctggtgggccagcaggtgaccctggagtgcttcgccttcggcaaccccgtgcccagaatcaagtggagaaaggtggacggcagcctgagcccccagtggaccaccgccgagcccaccctgcagatccccagcgtgagcttcgaggacgagggcacctacgagtgcgaggccgagaacagcaagggcagagacaccgtgcagggcagaatcatcgtgcaggcccagcccgagtggctgaaggtgatcagcgacaccgaggccgacatcggcagcaacctgagatggggctgcgccgccgccggcaagcccagacccaccgtgagatggctgagaaacggcgagcccctggccagccagaacagagtggaggtgctggccggcgacctgagattcagcaagctgagcctggaggacagcggcatgtaccagtgcgtggccgagaacaagcacggcaccatctacgccagcgccgagctggccgtgcaggccctggcccccgacttcagactgaaccccgtgagaagactgatccccgccgccagaggcggcgagatcctgatcccctgccagcccagagccgcccccaaggccgtggtgctgtggagcaagggcaccgagatcctggtgaacagcagcagagtgaccgtgacccccgacggcaccctgatcatcagaaacatcagcagaagcgacgagggcaagtacacctgcttcgccgagaacttcatgggcaaggccaacagcaccggcatcctgagcgtgagagacgccaccaagatcaccctggcccccagcagcgccgacatcaacctgggcgacaacctgaccctgcagtgccacgccagccacgaccccaccatggacctgaccttcacctggaccctggacgacttccccatcgacttcgacaagcccggcggccactacagaagaaccaacgtgaaggagaccatcggcgacctgaccatcctgaacgcccagctgagacacggcggcaagtacacctgcatggcccagaccgtggtggacagcgccagcaaggaggccaccgtgctggtgagaggcccccccggcccccccggcggcgtggtggtgagagacatcggcgacaccaccatccagctgagctggagcagaggcttcgacaaccacagccccatcgccaagtacaccctgcaggccagaaccccccccgccggcaagtggaagcaggtgagaaccaaccccgccaacatcgagggcaacgccgagaccgcccaggtgctgggcctgaccccctggatggactacgagttcagagtgatcgccagcaacatcctgggcaccggcgagcccagcggccccagcagcaagatcagaaccagagaggccgcccccagcgtggcccccagcggcctgagcggcggcggcggcgcccccggcgagctgatcgtgaactggacccccatgagcagagagtaccagaacggcgacggcttcggctacctgctgagcttcagaagacagggcagcacccactggcagaccgccagagtgcccggcgccgacgcccagtacttcgtgtacagcaacgagagcgtgagaccctacacccccttcgaggtgaagatcagaagctacaacagaagaggcgacggccccgagagcctgaccgccctggtgtacagcgccgaggaggagcccagagtggcccccaccaaggtgtgggccaagggcgtgagcagcagcgagatgaacgtgacctgggagcccgtgcagcaggacatgaacggcatcctgctgggctacgagatcagatactggaaggccggcgacaaggaggccgccgccgacagagtgagaaccgccggcctggacaccagcgccagagtgagcggcctgcaccccaacaccaagtaccacgtgaccgtgagagcctacaacagagccggcaccggccccgccagccccagcgccaacgccaccaccatgaagcccccccccagaagaccccccggcaacatcagctggaccttcagcagcagcagcctgagcatcaagtgggaccccgtggtgcccttcagaaacgagagcgccgtgaccggctacaagatgctgtaccagaacgacctgcacctgacccccaccctgcacctgaccggcaagaactggatcgagatccccgtgcccgaggacatcggccacgccctggtgcagatcagaaccaccggccccggcggcgacggcatccccgccgaggtgcacatcgtgagaaacggcggcaccagcatgatggtggagaacatggccgtgagacccgccccccaccccggcaccgtgatcagccacagcgtggccatgctgatcctgatcggcagcctggagctgtag

SEQ ID NO: 77593 - DNA, 3087 bp, Artificial Sequence
  Description of Artificial Sequence: Synthetic coding sequence
atgatgttcccctggaagcagctgatcctgctgagcttcatcggctgcctgggcggcgagctgctgctgcagggccccgtgttcatcaaggagcccagcaacagcatcttccccgtgggcagcgaggacaagaagatcaccctgcactgcgaggccagaggcaaccccagcccccactacagatggcagctgaacggcagcgacatcgacatgagcatggagcacagatacaagctgaacggcggcaacctggtggtgatcaaccccaacagaaactgggacaccggcacctaccagtgcttcgccaccaacagcctgggcaccatcgtgagcagagaggccaagctgcagttcgcctacctggagaacttcaagaccaagatgagaagcaccgtgagcgtgagagagggccagggcgtggtgctgctgtgcggcccccccccccacagcggcgagctgagctacgcctggatcttcaacgagtaccccagcttcgtggaggaggacagcagaagattcgtgagccaggagaccggccacctgtacatcagcaaggtggagcccagcgacgtgggcaactacacctgcgtggtgaccagcatggtgaccaacgccagagtgctgggcagccccacccccctggtgctgagaagcgacggcgtgatgggcgagtacgagcccaagatcgaggtgcagttccccgagaccctgcccgccgccaagggcagcaccgtgaagctggagtgcttcgccctgggcaaccccatcccccagatcaactggagaagaagcgacggcctgcccttcagcagcaagatcaagctgagaaagttcagcggcgtgctggagatccccaacttccagcaggaggacgccggcagctacgagtgcatcgccgagaacagcagaggcaagaacgtggccagaggcagactgacctactacgccaagccccactgggtgcagctgatcaaggacgtggagatcgccgtggaggacagcctgtactgggagtgcagagccagcggcaagcccaagcccagctacagatggctgaagaacggcgccgccctggtgctggaggagagaacccagatcgagaacggcgccctgaccatcagcaacctgagcgtgaccgacagcggcatgttccagtgcatcgccgagaacaagcacggcctggtgtacagcagcgccgagctgaaggtggtggccagcgcccccgacttcagcaagaaccccatgaagaagctggtgcaggtgcaggtgggcagcctggtgagcctggactgcaagcccagagccagccccagagccctgagcagctggaagaagggcgacgtgagcgtgcaggagcacgagagaatcagcctgctgaacgacggcggcctgaagatcgccaacgtgaccaaggccgacgccggcacctacacctgcatggccgagaaccagttcggcaaggccaacggcaccacccacctggtggtgaccgagcccaccagaatcaccctggcccccagcaacatggacgtgagcgtgggcgagagcgtgatcctgccctgccaggtgcagcacgaccccctgctggacatcatcttcacctggtacttcaacggcgccctggccgacttcaagaaggacggcagccacttcgagaaggtgggcggcagcagcagcggcgacctgatgatcagaaacatccagctgaagcacagcggcaagtacgtgtgcatggtgcagaccggcgtggacagcgtgagcagcgccgccgacctgatcgtgagaggcagccccggcccccccgagaacgtgaaggtggacgagatcaccgacaccaccgcccagctgagctggaaggagggcaaggacaaccacagccccgtgatcagctacagcatccaggccagaacccccttcagcgtgggctggcagaccgtgaccaccgtgcccgaggtgatcgacggcaagacccacaccgccaccgtggtggagctgaacccctgggtggagtacgagttcagagtggtggccagcaacaagatcggcggcggcgagcccagcctgcccagcgagaaggtgagaaccgaggaggccgtgcccgaggtgccccccagcgaggtgaacggcggcggcggcagcagaagcgagctggtgatcacctgggaccccgtgcccgaggagctgcagaacggcgagggcttcggctacgtggtggccttcagacccctgggcgtgaccacctggatccagaccgtggtgaccagccccgacacccccagatacgtgttcagaaacgagagcatcgtgccctacagcccctacgaggtgaaggtgggcgtgtacaacaacaagggcgagggccccttcagccccgtgaccaccgtgttcagcgccgaggaggagcccaccgtggcccccagccaggtgagcgccaacagcctgagcagcagcgagatcgaggtgagctggaacaccatcccctggaagctgagcaacggccacctgctgggctacgaggtgagatactggaacggcggcggcaaggaggagagcagcagcaagatgaaggtggccggcaacgagaccagcgccagactgagaggcctgaagagcaacctggcctactacaccgccgtgagagcctacaacagcgccggcgccggccccttcagcgccaccgtgaacgtgaccaccaagaagaccccccccagccagccccccggcaacgtggtgtggaacgccaccgacaccaaggtgctgctgaactgggagcaggtgaaggccatggagaacgagagcgaggtgaccggctacaaggtgttctacagaaccagcagccagaacaacgtgcaggtgctgaacaccaacaagaccagcgccgagctggtgctgcccatcaaggaggactacatcatcgaggtgaaggccaccaccgacggcggcgacggcaccagcagcgagcagatcagaatccccagaatcaccagcatggacgccagaggcagcaccagcgccatcagcaacgtgcaccccatgagcagctacatgcccatcgtgctgttcctgatcgtgtacgtgctgtggtag

SEQ ID NO: 77594 - DNA, 2424 bp, Artificial Sequence
  Description of Artificial Sequence: Synthetic coding sequence
atgggcgagtacgagcccaagatcgaggtgcagttccccgagaccgtgcccaccgccaagggcgccaccgtgaagctggagtgcttcgccctgggcaaccccgtgcccaccatcatctggagaagagccgacggcaagcccatcgccagaaaggccagaagacacaagagcaacggcatcctggagatccccaacttccagcaggaggacgccggcctgtacgagtgcgtggccgagaacagcagaggcaagaacgtggccagaggccagctgaccttctacgcccagcccaactggatccagaagatcaacgacatccacgtggccatggaggagaacgtgttctgggagtgcaaggccaacggcagacccaagcccacctacaagtggctgaagaacggcgagcccctgctgaccagagacagaatccagatcgagcagggcaccctgaacatcaccatcgtgaacctgagcgacgccggcatgtaccagtgcctggccgagaacaagcacggcgtgatcttcagcaacgccgagctgagcgtgatcgccgtgggccccgacttcagcagaaccctgctgaagagagtgaccctggtgaaggtgggcggcgaggtggtgatcgagtgcaagcccaaggccagccccaagcccgtgtacacctggaagaagggcagagacatcctgaaggagaacgagagaatcaccatcagcgaggacggcaacctgagaatcatcaacgtgaccaagagcgacgccggcagctacacctgcatcgccaccaaccacttcggcaccgccagcagcaccggcaacctggtggtgaaggaccccaccagagtgatggtgccccccagcagcatggacgtgaccgtgggcgagagcatcgtgctgccctgccaggtgacccacgaccacagcctggacatcgtgttcacctggagcttcaacggccacctgatcgacttcgacagagacggcgaccacttcgagagagtgggcggccaggacagcgccggcgacctgatgatcagaaacatccagctgaagcacgccggcaagtacgtgtgcatggtgcagaccagcgtggacagactgagcgccgccgccgacctgatcgtgagaggcccccccggcccccccgaggccgtgaccatcgacgagatcaccgacaccaccgcccagctgagctggagacccggccccgacaaccacagccccatcaccatgtacgtgatccaggccagaacccccttcagcgtgggctggcaggccgtgagcaccgtgcccgagctgatcgacggcaagaccttcaccgccaccgtggtgggcctgaacccctgggtggagtacgagttcagaaccgtggccgccaacgtgatcggcatcggcgagcccagcagacccagcgagaagagaagaaccgaggaggccctgcccgaggtgacccccgccaacgtgagcggcggcggcggcagcaagagcgagctggtgatcacctgggagaccgtgcccgaggagctgcagaacggcagaggcttcggctacgtggtggccttcagaccctacggcaagatgatctggatgctgaccgtgctggccagcgccgacgccagcagatacgtgttcagaaacgagagcgtgcaccccttcagccccttcgaggtgaaggtgggcgtgttcaacaacaagggcgagggccccttcagccccaccaccgtggtgtacagcgccgaggaggagcccaccaagccccccgccagcatcttcgccagaagcctgagcgccaccgacatcgaggtgttctgggccagccccctggagaagaacagaggcagaatccagggctacgaggtgaagtactggagacacgaggacaaggaggagaacgccagaaagatcagaaccgtgggcaaccagaccagcaccaagatcaccaacctgaagggcagcgtgctgtaccacctggccgtgaaggcctacaacagcgccggcaccggccccagcagcgccaccgtgaacgtgaccaccagaaagcccccccccagccagccccccggcaacatcatctggaacagcagcgacagcaagatcatcctgaactgggaccaggtgaaggccctggacaacgagagcgaggtgaagggctacaaggtgctgtacagatggaacagacagagcagcaccagcgtgatcgagaccaacaagaccagcgtggagctgagcctgcccttcgacgaggactacatcatcgagatcaagcccttcagcgacggcggcgacggcagcagcagcgagcagatcagaatccccaagatcagcaacgcctacgccagaggcagcggcgccagcaccagcaacgcctgcaccctgagcgccatcagcaccatcatgatcagcctgaccgccagaagcagcctgtag

SEQ ID NO: 77595 - DNA, 2097 bp, Artificial Sequence
  Description of Artificial Sequence: Synthetic coding sequence
atggaggagaacgtgttctgggagtgcaaggccaacggcagacccaagcccacctacaagtggctgaagaacggcgagcccctgctgaccagagacagaatccagatcgagcagggcaccctgaacatcaccatcgtgaacctgagcgacgccggcatgtaccagtgcctggccgagaacaagcacggcgtgatcttcagcaacgccgagctgagcgtgatcgccgtgggccccgacttcagcagaaccctgctgaagagagtgaccctggtgaaggtgggcggcgaggtggtgatcgagtgcaagcccaaggccagccccaagcccgtgtacacctggaagaagggcagagacatcctgaaggagaacgagagaatcaccatcagcgaggacggcaacctgagaatcatcaacgtgaccaagagcgacgccggcagctacacctgcatcgccaccaaccacttcggcaccgccagcagcaccggcaacctggtggtgaaggaccccaccagagtgatggtgccccccagcagcatggacgtgaccgtgggcgagagcatcgtgctgccctgccaggtgacccacgaccacagcctggacatcgtgttcacctggagcttcaacggccacctgatcgacttcgacagagacggcgaccacttcgagagagtgggcggccaggacagcgccggcgacctgatgatcagaaacatccagctgaagcacgccggcaagtacgtgtgcatggtgcagaccagcgtggacagactgagcgccgccgccgacctgatcgtgagaggcccccccggcccccccgaggccgtgaccatcgacgagatcaccgacaccaccgcccagctgagctggagacccggccccgacaaccacagccccatcaccatgtacgtgatccaggccagaacccccttcagcgtgggctggcaggccgtgagcaccgtgcccgagctgatcgacggcaagaccttcaccgccaccgtggtgggcctgaacccctgggtggagtacgagttcagaaccgtggccgccaacgtgatcggcatcggcgagcccagcagacccagcgagaagagaagaaccgaggaggccctgcccgaggtgacccccgccaacgtgagcggcggcggcggcagcaagagcgagctggtgatcacctgggagaccgtgcccgaggagctgcagaacggcagaggcttcggctacgtggtggccttcagaccctacggcaagatgatctggatgctgaccgtgctggccagcgccgacgccagcagatacgtgttcagaaacgagagcgtgcaccccttcagccccttcgaggtgaaggtgggcgtgttcaacaacaagggcgagggccccttcagccccaccaccgtggtgtacagcgccgaggaggagcccaccaagccccccgccagcatcttcgccagaagcctgagcgccaccgacatcgaggtgttctgggccagccccctggagaagaacagaggcagaatccagggctacgaggtgaagtactggagacacgaggacaaggaggagaacgccagaaagatcagaaccgtgggcaaccagaccagcaccaagatcaccaacctgaagggcagcgtgctgtaccacctggccgtgaaggcctacaacagcgccggcaccggccccagcagcgccaccgtgaacgtgaccaccagaaagcccccccccagccagccccccggcaacatcatctggaacagcagcgacagcaagatcatcctgaactgggaccaggtgaaggccctggacaacgagagcgaggtgaagggctacaaggtgctgtacagatggaacagacagagcagcaccagcgtgatcgagaccaacaagaccagcgtggagctgagcctgcccttcgacgaggactacatcatcgagatcaagcccttcagcgacggcggcgacggcagcagcagcgagcagatcagaatccccaagatcagcaacgcctacgccagaggcagcggcgccagcaccagcaacgcctgcaccctgagcgccatcagcaccatcatgatcagcctgaccgccagaagcagcctgtag

SEQ ID NO: 77596 - DNA, 3081 bp, Artificial Sequence
  Description of Artificial Sequence: Synthetic coding sequence
atgagactgccctgggagctgctggtgctgcagagcttcatcctgtgcctggccgacgacagcaccctgcacggccccatcttcatccaggagcccagccccgtgatgttccccctggacagcgaggagaagaaggtgaagctgaactgcgaggtgaagggcaaccccaagccccacatcagatggaagctgaacggcaccgacgtggacaccggcatggacttcagatacagcgtggtggagggcagcctgctgatcaacaaccccaacaagacccaggacgccggcacctaccagtgcaccgccaccaacagcttcggcaccatcgtgagcagagaggccaagctgcagttcgcctacctggacaacttcaagaccagaaccagaagcaccgtgagcgtgagaagaggccagggcatggtgctgctgtgcggcccccccccccacagcggcgagctgagctacgcctggatcttcaacgagtaccccagctaccaggacaacagaagattcgtgagccaggagaccggcaacctgtacatcgccaaggtggagaagagcgacgtgggcaactacacctgcgtggtgaccaacaccgtgaccaaccacaaggtgctgggcccccccacccccctgatcctgagaaacgacggcgtgatgggcgagtacgagcccaagatcgaggtgcagttccccgagaccgtgcccaccgccaagggcgccaccgtgaagctggagtgcttcgccctgggcaaccccgtgcccaccatcatctggagaagagccgacggcaagcccatcgccagaaaggccagaagacacaagagcaacggcatcctggagatccccaacttccagcaggaggacgccggcctgtacgagtgcgtggccgagaacagcagaggcaagaacgtggccagaggccagctgaccttctacgcccagcccaactggatccagaagatcaacgacatccacgtggccatggaggagaacgtgttctgggagtgcaaggccaacggcagacccaagcccacctacaagtggctgaagaacggcgagcccctgctgaccagagacagaatccagatcgagcagggcaccctgaacatcaccatcgtgaacctgagcgacgccggcatgtaccagtgcctggccgagaacaagcacggcgtgatcttcagcaacgccgagctgagcgtgatcgccgtgggccccgacttcagcagaaccctgctgaagagagtgaccctggtgaaggtgggcggcgaggtggtgatcgagtgcaagcccaaggccagccccaagcccgtgtacacctggaagaagggcagagacatcctgaaggagaacgagagaatcaccatcagcgaggacggcaacctgagaatcatcaacgtgaccaagagcgacgccggcagctacacctgcatcgccaccaaccacttcggcaccgccagcagcaccggcaacctggtggtgaaggaccccaccagagtgatggtgccccccagcagcatggacgtgaccgtgggcgagagcatcgtgctgccctgccaggtgacccacgaccacagcctggacatcgtgttcacctggagcttcaacggccacctgatcgacttcgacagagacggcgaccacttcgagagagtgggcggccaggacagcgccggcgacctgatgatcagaaacatccagctgaagcacgccggcaagtacgtgtgcatggtgcagaccagcgtggacagactgagcgccgccgccgacctgatcgtgagaggcccccccggcccccccgaggccgtgaccatcgacgagatcaccgacaccaccgcccagctgagctggagacccggccccgacaaccacagccccatcaccatgtacgtgatccaggccagaacccccttcagcgtgggctggcaggccgtgagcaccgtgcccgagctgatcgacggcaagaccttcaccgccaccgtggtgggcctgaacccctgggtggagtacgagttcagaaccgtggccgccaacgtgatcggcatcggcgagcccagcagacccagcgagaagagaagaaccgaggaggccctgcccgaggtgacccccgccaacgtgagcggcggcggcggcagcaagagcgagctggtgatcacctgggagaccgtgcccgaggagctgcagaacggcagaggcttcggctacgtggtggccttcagaccctacggcaagatgatctggatgctgaccgtgctggccagcgccgacgccagcagatacgtgttcagaaacgagagcgtgcaccccttcagccccttcgaggtgaaggtgggcgtgttcaacaacaagggcgagggccccttcagccccaccaccgtggtgtacagcgccgaggaggagcccaccaagccccccgccagcatcttcgccagaagcctgagcgccaccgacatcgaggtgttctgggccagccccctggagaagaacagaggcagaatccagggctacgaggtgaagtactggagacacgaggacaaggaggagaacgccagaaagatcagaaccgtgggcaaccagaccagcaccaagatcaccaacctgaagggcagcgtgctgtaccacctggccgtgaaggcctacaacagcgccggcaccggccccagcagcgccaccgtgaacgtgaccaccagaaagcccccccccagccagccccccggcaacatcatctggaacagcagcgacagcaagatcatcctgaactgggaccaggtgaaggccctggacaacgagagcgaggtgaagggctacaaggtgctgtacagatggaacagacagagcagcaccagcgtgatcgagaccaacaagaccagcgtggagctgagcctgcccttcgacgaggactacatcatcgagatcaagcccttcagcgacggcggcgacggcagcagcagcgagcagatcagaatccccaagatcagcaacgcctacgccagaggcagcggcgccagcaccagcaacgcctgcaccctgagcgccatcagcaccatcatgatcagcctgaccgccagaagcagcctgtag

SEQ ID NO: 77597 - DNA, 3081 bp, Artificial Sequence; identical to SEQ ID NO: 77596
  Description of Artificial Sequence: Synthetic coding sequence

SEQ ID NO: 77598 - DNA, 351 bp, Artificial Sequence
  Description of Artificial Sequence: Synthetic coding sequence
atgagactgccctgggagctgctggtgctgcagagcttcatcctgtgcctggccgacgacagcaccctgcacggccccatcttcatccaggagcccagccccgtgatgttccccctggacagcgaggagaagaaggtgaagctgaactgcgaggtgaagggcaaccccaagccccacatcagatggaagctgaacggcaccgacgtggacaccggcatggacttcagatacagcgtggtggagggcagcctgctgatcaacaaccccaacaagacccaggacgccggcacctaccagtgcaccgccaccaacagcttcggcaccatcgtgagcagagaggccaagctgtag

SEQ ID NO: 77599 - DNA, 3081 bp, Artificial Sequence; identical to SEQ ID NO: 77596
  Description of Artificial Sequence: Synthetic coding sequence

SEQ ID NO: 77600 - DNA, 2097 bp, Artificial Sequence; identical to SEQ ID NO: 77595
  Description of Artificial Sequence: Synthetic coding sequence

SEQ ID NO: 77601 - DNA, 165 bp, Artificial Sequence
  Description of Artificial Sequence: Synthetic coding sequence
atgagactgccctgggagctgctggtgctgcagagcttcatcctgtgcctggccgacgacagcaccctgcacggccccatcttcatccaggagcccagccccgtgatgttccccctggacagcgaggagaagaaggtgaagctgaactgcgaggtgaagggctag

SEQ ID NO: 77602 - DNA, 3303 bp, Artificial Sequence
  Description of Artificial Sequence: Synthetic coding sequence
atggccagcagctggaagctgatgctgttcctgagcgtgaccatgtgcctgagcgagtacagcaagagcctgcccggcctgagcaccagctacgccgccctgctgagaatcaagaagagcagcagcagcagcctgttcggcagcaagaccagacccagatacagcagccccagcctgggcaccctgagcgccagcagccccagctggctgggcgccgcccagaactactacagccccatcaacctgtaccacagcagcgacgccttcaagcaggacgagagcgtggactacggccccgtgttcgtgcaggagcccgacgacatcatcttccccaccgacagcgacgagaagaaggtggccctgaactgcgaggtgagaggcaaccccgtgcccagctacagatggctgagaaacggcaccgagatcgacctggagagcgactacagatacagcctgatcgacggcaccttcatcatcagcaaccccagcgaggccaaggacagcggccactaccagtgcctggccaccaacaccgtgggcagcatcctgagcagagaggccaccctgcagttcgcctacctgggcaacttcagcggcagaaccagaagcgccgtgagcgtgagagagggccagggcgtggtgctgatgtgcagcccccccccccacagccccgagatcatctacagctgggtgttcaacgagttccccagcttcgtggccgaggacagcagaagattcatcagccaggagaccggcaacctgtacatcagcaaggtgcagaccagcgacgtgggcagctacatctgcctggtgaagaacaccgtgaccaacgccagagtgctgagcccccccacccccctgaccctgagaaacgacggcgtgatgggcgagtacgagcccaagatcgaggtgcacttccccttcaccgtgaccgccgccaagggcaccaccgtgaagatggagtgcttcgccctgggcaaccccgtgcccaccatcacctggatgaaggtgaacggctacatccccagcaaggccagactgagaaagagccaggccgtgctggagatccccaacgtgcagctggacgacgccggcatctacgagtgcagagccgagaacagcagaggcaagaacagcttcagaggccagctgcaggtgtacacctacccccactgggtggagaagctgaacgacacccagctggacagcggcagccccctgagatgggagtgcaaggccaccggcaagcccagacccacctacagatggctgaagaacggcgtgcccctgagcccccagagcagagtggagatggtgaacggcgtgctgatgatccacaacgtgaaccagagcgacgccggcatgtaccagtgcctggccgagaacaagtacggcgccatctacgccagcgccgagctgaagatcctggccagcgcccccaccttcgccctgaaccagctgaagaagaccatcatcgtgaccaaggaccaggaggtggtgatcgagtgcaagccccagggcagccccaagcccaccatcagctggaagaagggcgacagagccgtgagagagaacaagagaatcgccatcctgcccgacggcagcctgagaatcctgaacgccagcaagagcgacgagggcaagtacgtgtgcagaggcgagaacgtgttcggcagcgccgagatcatcgccagcctgagcgtgaaggagcccaccagaatcgagctgacccccaagagaaccgagctgaccgtgggcgagagcatcgtgctgaactgcaaggccatccacgacgccagcctggacgtgaccttctactggaccctgaagggccagcccatcgacttcgaggaggagggcggccacttcgagagcatcagagcccaggccagcagcgccgacctgatgatcagaaacatcctgctgatgcacgccggcagatacggctgcagagtgcagaccaccgccgacagcgtgagcgacgaggccgagctgctggtgagaggcccccccggcccccccggcatcgtgatcgtggaggagatcaccgagagcaccgccaccctgagctggagccccgccgccgacaaccacagccccatcagcagctacaacctgcaggccagaagccccttcagcctgggctggcagaccgtgaagaccgtgcccgagatcatcaccggcgacatggagagcgccatggccgtggacctgaacccctgggtggagtacgagttcagagtggtggccaccaaccccatcggcaccggcgaccccagcacccccagcagaatgatcagaaccaacgaggccgtgcccaagaccgcccccaccaacgtgagcggcagaagcggcagaagacacgagctggtgatcgcctgggagcccgtgagcgaggagttccagaacggcgagggcttcggctacatcgtggccttcagacccaacggcaccagaggctggaaggagaagatggtgaccagcagcgaggccagcaagttcatctacagagacgagagcgtgccccccctgacccccttcgaggtgaaggtgggcgtgtacaacaacaagggcgacggccccttcagccagatcgtggtgatctgcagcgccgagggcgagcccagcgccgcccccaccgacgtgaaggccaccagcgtgagcgtgagcgagatcctggtggcctggaagcacatcaaggagagcctgggcagaccccagggcttcgaggtgggctactggaaggacatggagcaggaggacaccgccgagaccgtgaagaccagaggcaacgagagcttcgtgatcctgaccggcctggagggcaacaccctgtaccacttcaccgtgagagcctacaacggcgccggctacggcccccccagcagcgaggtgagcgccaccaccaagaagagcccccccagccaggcccccagcaacctgagatgggagcagcagggcagccaggtgagcctgggctgggagcccgtgatccccctggccaacgagagcgaggtggtgggctacaaggtgttctacagacaggagggccacagcaacagccaggtgatcgagacccagaagctgcaggccgtggtgcccctgcccgacgccggcgtgtacatcatcgaggtgagagcctacagcgagggcggcgacggcaccgccagcagccagatcagagtgcccagctacagcggcggcaagatcaccagcgcccagagcaccctgcacagcctgagcaccagcagcagcagcgtgaccctgctgctggccctgatgatccccagcaccagctggtag

SEQ ID NO: 77603 - DNA, 3081 bp, Artificial Sequence
  Description of Artificial Sequence: Synthetic coding sequence
atggccagcagctggaagctgatgctgttcctgagcgtgaccatgtgcctgagcgagagcgtggactacggccccgtgttcgtgcaggagcccgacgacatcatcttccccaccgacagcgacgagaagaaggtggccctgaactgcgaggtgagaggcaaccccgtgcccagctacagatggctgagaaacggcaccgagatcgacctggagagcgactacagatacagcctgatcgacggcaccttcatcatcagcaaccccagcgaggccaaggacagcggccactaccagtgcctggccaccaacaccgtgggcagcatcctgagcagagaggccaccctgcagttcgcctacctgggcaacttcagcggcagaaccagaagcgccgtgagcgtgagagagggccagggcgtggtgctgatgtgcagcccccccccccacagccccgagatcatctacagctgggtgttcaacgagttccccagcttcgtggccgaggacagcagaagattcatcagccaggagaccggcaacctgtacatcagcaaggtgcagaccagcgacgtgggcagctacatctgcctggtgaagaacaccgtgaccaacgccagagtgctgagcccccccacccccctgaccctgagaaacgacggcgtgatgggcgagtacgagcccaagatcgaggtgcacttccccttcaccgtgaccgccgccaagggcaccaccgtgaagatggagtgcttcgccctgggcaaccccgtgcccaccatcacctggatgaaggtgaacggctacatccccagcaaggccagactgagaaagagccaggccgtgctggagatccccaacgtgcagctggacgacgccggcatctacgagtgcagagccgagaacagcagaggcaagaacagcttcagaggccagctgcaggtgtacacctacccccactgggtggagaagctgaacgacacccagctggacagcggcagccccctgagatgggagtgcaaggccaccggcaagcccagacccacctacagatggctgaagaacggcgtgcccctgagcccccagagcagagtggagatggtgaacggcgtgctgatgatccacaacgtgaaccagagcgacgccggcatgtaccagtgcctggccgagaacaagtacggcgccatctacgccagcgccgagctgaagatcctggccagcgcccccaccttcgccctgaaccagctgaagaagaccatcatcgtgaccaaggaccaggaggtggtgatcgagtgcaagccccagggcagccccaagcccaccatcagctggaagaagggcgacagagccgtgagagagaacaagagaatcgccatcctgcccgacggcagcctgagaatcctgaacgccagcaagagcgacgagggcaagtacgtgtgcagaggcgagaacgtgttcggcagcgccgagatcatcgccagcctgagcgtgaaggagcccaccagaatcgagctgacccccaagagaaccgagctgaccgtgggcgagagcatcgtgctgaactgcaaggccatccacgacgccagcctggacgtgaccttctactggaccctgaagggccagcccatcgacttcgaggaggagggcggccacttcgagagcatcagagcccaggccagcagcgccgacctgatgatcagaaacatcctgctgatgcacgccggcagatacggctgcagagtgcagaccaccgccgacagcgtgagcgacgaggccgagctgctggtgagaggcccccccggcccccccggcatcgtgatcgtggaggagatcaccgagagcaccgccaccctgagctggagccccgccgccgacaaccacagccccatcagcagctacaacctgcaggccagaagccccttcagcctgggctggcagaccgtgaagaccgtgcccgagatcatcaccggcgacatggagagcgccatggccgtggacctgaacccctgggtggagtacgagttcagagtggtggccaccaaccccatcggcaccggcgaccccagcacccccagcagaatgatcagaaccaacgaggccgtgcccaagaccgcccccaccaacgtgagcggcagaagcggcagaagacacgagctggtgatcgcctgggagcccgtgagcgaggagttccagaacggcgagggcttcggctacatcgtggccttcagacccaacggcaccagaggctggaaggagaagatggtgaccagcagcgaggccagcaagttcatctacagagacgagagcgtgccccccctgacccccttcgaggtgaaggtgggcgtgtacaacaacaagggcgacggccccttcagccagatcgtggtgatctgcagcgccgagggcgagcccagcgccgcccccaccgacgtgaaggccaccagcgtgagcgtgagcgagatcctggtggcctggaagcacatcaaggagagcctgggcagaccccagggcttcgaggtgggctactggaaggacatggagcaggaggacaccgccgagaccgtgaagaccagaggcaacgagagcttcgtgatcctgaccggcctggagggcaacaccctgtaccacttcaccgtgagagcctacaacggcgccggctacggcccccccagcagcgaggtgagcgccaccaccaagaagagcccccccagccaggcccccagcaacctgagatgggagcagcagggcagccaggtgagcctgggctgggagcccgtgatccccctggccaacgagagcgaggtggtgggctacaaggtgttctacagacaggagggccacagcaacagccaggtgatcgagacccagaagctgcaggccgtggtgcccctgcccgacgccggcgtgtacatcatcgaggtgagagcctacagcgagggcggcgacggcaccgccagcagccagatcagagtgcccagctacagcggcggcaagatcaccagcgcccagagcaccctgcacagcctgagcaccagcagcagcagcgtgaccctgctgctggccctgatgatccccagcaccagctggtag

SEQ ID NO: 77604 - DNA, 3303 bp, Artificial Sequence; identical to SEQ ID NO: 77602
  Description of Artificial Sequence: Synthetic coding sequence

SEQ ID NO: 77605 - DNA, 3303 bp, Artificial Sequence; identical to SEQ ID NO: 77602
  Description of Artificial Sequence: Synthetic coding sequence

SEQ ID NO: 77606 - DNA, 2736 bp, Artificial Sequence
  Description of Artificial Sequence: Synthetic coding sequence
atggccagcagctggaagctgatgctgttcctgagcgtgaccatgtgcctgagcgagtacagcaagagcctgcccggcctgagcaccagctacgccgccctgctgagaatcaagaagagcagcagcagcagcctgttcggcagcaagaccagacccagatacagcagccccagcctgggcaccctgagcgccagcagccccagctggctgggcgccgcccagaactactacagccccatcaacctgtaccacagcagcgacgccttcaagcaggacgagagcgtggactacggccccgtgttcgtgcaggagcccgacgacatcatcttccccaccgacagcgacgagaagaaggtggccctgaactgcgaggtgagaggcaaccccgtgcccagctacagatggctgagaaacggcaccgagatcgacctggagagcgactacagatacagcctgatcgacggcaccttcatcatcagcaaccccagcgaggccaaggacagcggccactaccagtgcctggccaccaacaccgtgggcagcatcctgagcagagaggccaccctgcagttcgcctacctgggcaacttcagcggcagaaccagaagcgccgtgagcgtgagagagggccagggcgtggtgctgatgtgcagcccccccccccacagccccgagatcatctacagctgggtgttcaacgagttccccagcttcgtggccgaggacagcagaagattcatcagccaggagaccggcaacctgtacatcagcaaggtgcagaccagcgacgtgggcagctacatctgcctggtgaagaacaccgtgaccaacgccagagtgctgagcccccccacccccctgaccctgagaaacgacggcgtgatgggcgagtacgagcccaagatcgaggtgcacttccccttcaccgtgaccgccgccaagggcaccaccgtgaagatggagtgcttcgccctgggcaaccccgtgcccaccatcacctggatgaaggtgaacggctacatccccagcaaggccagactgagaaagagccaggccgtgctggagatccccaacgtgcagctggacgacgccggcatctacgagtgcagagccgagaacagcagaggcaagaacagcttcagaggccagctgcaggtgtacacctacccccactgggtggagaagctgaacgacacccagctggacagcggcagccccctgagatgggagtgcaaggccaccggcaagcccagacccacctacagatggctgaagaacggcgtgcccctgagcccccagagcagagtggagatggtgaacggcgtgctgatgatccacaacgtgaaccagagcgacgccggcatgtaccagtgcctggccgagaacaagtacggcgccatctacgccagcgccgagctgaagatcctggccagcgcccccaccttcgccctgaaccagctgaagaagaccatcatcgtgaccaaggaccaggaggtggtgatcgagtgcaagccccagggcagccccaagcccaccatcagctggaagaagggcgacagagccgtgagagagaacaagagaatcgccatcctgcccgacggcagcctgagaatcctgaacgccagcaagagcgacgagggcaagtacgtgtgcagaggcgagaacgtgttcggcagcgccgagatcatcgccagcctgagcgtgaaggagcccaccagaatcgagctgacccccaagagaaccgagctgaccgtgggcgagagcatcgtgctgaactgcaaggccatccacgacgccagcctggacgtgaccttctactggaccctgaagggccagcccatcgacttcgaggaggagggcggccacttcgagagcatcagagcccaggccagcagcgccgacctgatgatcagaaacatcctgctgatgcacgccggcagatacggctgcagagtgcagaccaccgccgacagcgtgagcgacgaggccgagctgctggtgagaggcccccccggcccccccggcatcgtgatcgtggaggagatcaccgagagcaccgccaccctgagctggagccccgccgccgacaaccacagccccatcagcagctacaacctgcaggccagaagccccttcagcctgggctggcagaccgtgaagaccgtgcccgagatcatcaccggcgacatggagagcgccatggccgtggacctgaacccctgggtggagtacgagttcagagtggtggccaccaaccccatcggcaccggcgaccccagcacccccagcagaatgatcagaaccaacgaggccgtgcccaagaccgcccccaccaacgtgagcggcagaagcggcagaagacacgagctggtgatcgcctgggagcccgtgagcgaggagttccagaacggcgagggcttcggctacatcgtggccttcagacccaacggcaccagaggctggaaggagaagatggtgaccagcagcgaggccagcaagttcatctacagagacgagagcgtgccccccctgacccccttcgaggtgaaggtgggcgtgtacaacaacaagggcgacggccccttcagccagatcgtggtgatctgcagcgccgagggcgagcccagcgccgcccccaccgacgtgaaggccaccagcgtgagcgtgagcgagatcctggtggcctggaagcacatcaaggagagcctgggcagaccccagggcttcgaggtgtag

SEQ ID NO: 77607 - DNA, 3087 bp, Artificial Sequence
  Description of Artificial Sequence: Synthetic coding sequence
atgagactgctgtggaagctggtgatcctgctgcccctgatcaacagcagcgccggcgacggcctgctgagcagacccatcttcacccaggagccccacgacgtgatcttccccctggacctgagcaagagcgaggtgatcctgaactgcgccgccaacggctaccccagcccccactacagatggaagcagaacggcaccgacatcgacttcaccatgagctaccactacagactggacggcggcagcctggccatcaacagcccccacaccgaccaggacatcggcatgtaccagtgcctggccaccaacctgctgggcaccatcctgagcagaaaggccaagctgcagttcgcctacatcgaggacttcgagaccaagaccagaagcaccgtgagcgtgagagagggccagggcgtggtgctgctgtgcggcccccccccccacttcggcgacctgagctacgcctggaccttcaacgacaaccccctgtacgtgcaggaggacaacagaagattcgtgagccaggagaccggcaacctgtacatcgccaaggtggagcccagcgacgtgggcaactacacctgcttcatcaccaacaaggaggcccagagaagcgtgcagggcccccccacccccctggtgcagagaaccgacggcgtgatgggcgagtacgagcccaagatcgaggtgagattccccgagaccatccaggccgccaaggacagcagcgtgaagctggagtgcttcgccctgggcaaccccgtgcccgacatcagctggagaagactggacggcagccccctgcccggcaaggtgaagtacagcaagagccaggccatcctggagatccccaacttccagcaggaggacgagggcttctacgagtgcatcgccagcaacctgagaggcagaaacctggccaagggccagctgatcttctacgccccccccgagtgggagcagaagatccagaacacccacctgagcatctacgacaacctgctgtgggagtgcaaggccagcggcaagcccaacccctggtacacctggctgaagaacggcgagagactgaaccccgaggagagaatccagatcgagaacggcaccctgatcatcaccatgctgaacgtgagcgacagcggcgtgtaccagtgcgccgccgagaacaagtaccagatcatctacgccaacgccgagctgagagtgctggccagcgcccccgacttcagcaagagccccgtgaagaagaagagcttcgtgcaggtgggcggcgacatcgtgatcggctgcaagcccaacgccttccccagagccgccatcagctggaagagaggcaccgagaccctgagacagagcaagagaatcttcctgctggaggacggcagcctgaagatctacaacatcaccagaagcgacgccggcagctacacctgcatcgccaccaaccagttcggcaccgccaagaacaccggcagcctgatcgtgaaggagagaaccgtgatcaccgtgccccccagcaagatggacgtgaccgtgggcgagagcatcgtgctgccctgccaggtgagccacgaccccagcatcgaggtggtgttcgtgtggttcttcaacggcgacgtgatcgacctgaagaagggcgtggcccacttcgagagaatcggcggcgagagcgtgggcgacctgatgatcagaaacatccagctgcaccacagcggcaagtacctgtgcaccgtgcagaccaccctggagagcctgagcgccgtggccgacatcatcgtgagaggcccccccggcccccccgaggacgtgcaggtggaggacatcagcagcaccaccagccagctgagctggagagccggccccgacaacaacagccccatccagatcttcaccatccagaccagaacccccttcagcgtgggctggcaggccgtggccaccgtgcccgagatcctgaacggcaagacctacaacgccaccgtggtgggcctgagcccctgggtggagtacgagttcagagtggtggccggcaacagcatcggcatcggcgagcccagcgagcccagcgagctgctgagaaccaaggccagcgtgcccgtggtggcccccgtgaacatccacggcggcggcggcagcagaagcgagctggtgatcacctgggagagcatccccgaggagctgcagaacggcgagggcttcggctacatcatcatgttcagacccgtgggcagcaccacctggagcaaggagaaggtgagcagcgtggagagcagcagattcgtgtacagaaacgagagcatcatccccctgagccccttcgaggtgaaggtgggcgtgtacaacaacgagggcgagggcagcctgagcaccgtgaccatcgtgtacagcggcgaggacgagccccagctggcccccagaggcaccagcctgcagagcttcagcgccagcgagatggaggtgagctggaacgccatcgcctggaacagaaacaccggcagagtgctgggctacgaggtgctgtactggaccgacgacagcaaggagagcatgatcggcaagatcagagtgagcggcaacgtgaccaccaagaacatcaccggcctgaaggccaacaccatctacttcgccagcgtgagagcctacaacaccgccggcaccggccccagcagcccccccgtgaacgtgaccaccaagaagagcccccccagccagccccccgccaacatcgcctggaagctgaccaacagcaagctgtgcctgaactgggagcacgtgaagaccatggagaacgagagcgaggtgctgggctacaagatcctgtacagacagaacagacagagcaagacccacatcctggagaccaacaacaccagcgccgagctgctggtgcccttcgaggaggactacctgatcgagatcagaaccgtgagcgacggcggcgacggcagcagcagcgaggagatcagaatccccaagatgagcagcctgagcagcagaggcatccagttcctggagcccagcacccacttcctgagcatcgtgatcgtgatcttccactgcttcgccatccagcccctgatctag

SEQ ID NO: 77608 - DNA, 3087 bp, Artificial Sequence; identical to SEQ ID NO: 77607
  Description of Artificial Sequence: Synthetic coding sequence

SEQ ID NO: 77609 - DNA, 2871 bp, Artificial Sequence
  Description of Artificial Sequence: Synthetic coding sequence
atgagctaccactacagactggacggcggcagcctggccatcaacagcccccacaccgaccaggacatcggcatgtaccagtgcctggccaccaacctgctgggcaccatcctgagcagaaaggccaagctgcagttcgcctacatcgaggacttcgagaccaagaccagaagcaccgtgagcgtgagagagggccagggcgtggtgctgctgtgcggcccccccccccacttcggcgacctgagctacgcctggaccttcaacgacaaccccctgtacgtgcaggaggacaacagaagattcgtgagccaggagaccggcaacctgtacatcgccaaggtggagcccagcgacgtgggcaactacacctgcttcatcaccaacaaggaggcccagagaagcgtgcagggcccccccacccccctggtgcagagaaccgacggcgtgatgggcgagtacgagcccaagatcgaggtgagattccccgagaccatccaggccgccaaggacagcagcgtgaagctggagtgcttcgccctgggcaaccccgtgcccgacatcagctggagaagactggacggcagccccctgcccggcaaggtgaagtacagcaagagccaggccatcctggagatccccaacttccagcaggaggacgagggcttctacgagtgcatcgccagcaacctgagaggcagaaacctggccaagggccagctgatcttctacgccccccccgagtgggagcagaagatccagaacacccacctgagcatctacgacaacctgctgtgggagtgcaaggccagcggcaagcccaacccctggtacacctggctgaagaacggcgagagactgaaccccgaggagagaatccagatcgagaacggcaccctgatcatcaccatgctgaacgtgagcgacagcggcgtgtaccagtgcgccgccgagaacaagtaccagatcatctacgccaacgccgagctgagagtgctggccagcgcccccgacttcagcaagagccccgtgaagaagaagagcttcgtgcaggtgggcggcgacatcgtgatcggctgcaagcccaacgccttccccagagccgccatcagctggaagagaggcaccgagaccctgagacagagcaagagaatcttcctgctggaggacggcagcctgaagatctacaacatcaccagaagcgacgccggcagctacacctgcatcgccaccaaccagttcggcaccgccaagaacaccggcagcctgatcgtgaaggagagaaccgtgatcaccgtgccccccagcaagatggacgtgaccgtgggcgagagcatcgtgctgccctgccaggtgagccacgaccccagcatcgaggtggtgttcgtgtggttcttcaacggcgacgtgatcgacctgaagaagggcgtggcccacttcgagagaatcggcggcgagagcgtgggcgacctgatgatcagaaacatccagctgcaccacagcggcaagtacctgtgcaccgtgcagaccaccctggagagcctgagcgccgtggccgacatcatcgtgagaggcccccccggcccccccgaggacgtgcaggtggaggacatcagcagcaccaccagccagctgagctggagagccggccccgacaacaacagccccatccagatcttcaccatccagaccagaacccccttcagcgtgggctggcaggccgtggccaccgtgcccgagatcctgaacggcaagacctacaacgccaccgtggtgggcctgagcccctgggtggagtacgagttcagagtggtggccggcaacagcatcggcatcggcgagcccagcgagcccagcgagctgctgagaaccaaggccagcgtgcccgtggtggcccccgtgaacatccacggcggcggcggcagcagaagcgagctggtgatcacctgggagagcatccccgaggagctgcagaacggcgagggcttcggctacatcatcatgttcagacccgtgggcagcaccacctggagcaaggagaaggtgagcagcgtggagagcagcagattcgtgtacagaaacgagagcatcatccccctgagccccttcgaggtgaaggtgggcgtgtacaacaacgagggcgagggcagcctgagcaccgtgaccatcgtgtacagcggcgaggacgagccccagctggcccccagaggcaccagcctgcagagcttcagcgccagcgagatggaggtgagctggaacgccatcgcctggaacagaaacaccggcagagtgctgggctacgaggtgctgtactggaccgacgacagcaaggagagcatgatcggcaagatcagagtgagcggcaacgtgaccaccaagaacatcaccggcctgaaggccaacaccatctacttcgccagcgtgagagcctacaacaccgccggcaccggccccagcagcccccccgtgaacgtgaccaccaagaagagcccccccagccagccccccgccaacatcgcctggaagctgaccaacagcaagctgtgcctgaactgggagcacgtgaagaccatggagaacgagagcgaggtgctgggctacaagatcctgtacagacagaacagacagagcaagacccacatcctggagaccaacaacaccagcgccgagctgctggtgcccttcgaggaggactacctgatcgagatcagaaccgtgagcgacggcggcgacggcagcagcagcgaggagatcagaatccccaagatgagcagcctgagcagcagaggcatccagttcctggagcccagcacccacttcctgagcatcgtgatcgtgatcttccactgcttcgccatccagcccctgatctag

SEQ ID NO: 77610 - DNA, 3996 bp, Artificial Sequence
  Description of Artificial Sequence: Synthetic coding sequence
atgcaggccgcccccagagccggctgcggcgccgccctgctgctgtggatcgtgagcagctgcctgtgcagagcctggaccgcccccagcaccagccagaagtgcgacgagcccctggtgagcggcctgccccacgtggccttcagcagcagcagcagcatcagcggcagctacagccccggctacgccaagatcaacaagagaggcggcgccggcggctggagccccagcgacagcgaccactaccagtggctgcaggtggacttcggcaacagaaagcagatcagcgccatcgccacccagggcagatacagcagcagcgactgggtgacccagtacagaatgctgtacagcgacaccggcagaaactggaagccctaccaccaggacggcaacatctgggccttccccggcaacatcaacagcgacggcgtggtgagacacgagctgcagcaccccatcatcgccagatacgtgagaatcgtgcccctggactggaacggcgagggcagaatcggcctgagaatcgaggtgtacggctgcagctactgggccgacgtgatcaacttcgacggccacgtggtgctgccctacagattcagaaacaagaagatgaagaccctgaaggacgtgatcgccctgaacttcaagaccagcgagagcgagggcgtgatcctgcacggcgagggccagcagggcgactacatcaccctggagctgaagaaggccaagctggtgctgagcctgaacctgggcagcaaccagctgggccccatctacggccacaccagcgtgatgaccggcagcctgctggacgaccaccactggcacagcgtggtgatcgagagacagggcagaagcatcaacctgaccctggacagaagcatgcagcacttcagaaccaacggcgagttcgactacctggacctggactacgagatcaccttcggcggcatccccttcagcggcaagcccagcagcagcagcagaaagaacttcaagggctgcatggagagcatcaactacaacggcgtgaacatcaccgacctggccagaagaaagaagctggagcccagcaacgtgggcaacctgagcttcagctgcgtggagccctacaccgtgcccgtgttcttcaacgccaccagctacctggaggtgcccggcagactgaaccaggacctgttcagcgtgagcttccagttcagaacctggaaccccaacggcctgctggtgttcagccacttcgccgacaacctgggcaacgtggagatcgacctgaccgagagcaaggtgggcgtgcacatcaacatcacccagaccaagatgagccagatcgacatcagcagcggcagcggcctgaacgacggccagtggcacgaggtgagattcctggccaaggagaacttcgccatcctgaccatcgacggcgacgaggccagcgccgtgagaaccaacagccccctgcaggtgaagaccggcgagaagtacttcttcggcggcttcctgaaccagatgaacaacagcagccacagcgtgctgcagcccagcttccagggctgcatgcagctgatccaggtggacgaccagctggtgaacctgtacgaggtggcccagagaaagcccggcagcttcgccaacgtgagcatcgacatgtgcgccatcatcgacagatgcgtgcccaaccactgcgagcacggcggcaagtgcagccagacctgggacagcttcaagtgcacctgcgacgagaccggctacagcggcgccacctgccacaacagcatctacgagcccagctgcgaggcctacaagcacctgggccagaccagcaactactactggatcgaccccgacggcagcggccccctgggccccctgaaggtgtactgcaacatgaccgaggacaaggtgtggaccatcgtgagccacgacctgcagatgcagacccccgtggtgggctacaaccccgagaagtacagcgtgacccagctggtgtacagcgccagcatggaccagatcagcgccatcaccgacagcgccgagtactgcgagcagtacgtgagctacttctgcaagatgagcagactgctgaacacccccgacggcagcccctacacctggtgggtgggcaaggccaacgagaagcactactactggggcggcagcggccccggcatccagaagtgcgcctgcggcatcgagagaaactgcaccgaccccaagtactactgcaactgcgacgccgactacaagcagtggagaaaggacgccggcttcctgagctacaaggaccacctgcccgtgagccaggtggtggtgggcgacaccgacagacagggcagcgaggccaagctgagcgtgggccccctgagatgccagggcgacagaaactactggaacgccgccagcttccccaaccccagcagctacctgcacttcagcaccttccagggcgagaccagcgccgacatcagcttctacttcaagaccctgaccccctggggcgtgttcctggagaacatgggcaaggaggacttcatcaagctggagctgaagagcgccaccgaggtgagcttcagcttcgacgtgggcaacggccccgtggagatcgtggtgagaagccccacccccctgaacgacgaccagtggcacagagtgaccgccgagagaaacgtgaagcaggccagcctgcaggtggacagactgccccagcagatcagaaaggcccccaccgagggccacaccagactggagctgtacagccagctgttcgtgggcggcgccggcggccagcagggcttcctgggctgcatcagaagcctgagaatgaacggcgtgaccctggacctggaggagagagccaaggtgaccagcggcttcatcagcggctgcagcggccactgcaccagctacggcaccaactgcgagaacggcggcaagtgcctggagagataccacggctacagctgcgactgcagcaacaccgcctacgacggcaccttctgcaacaaggacgtgggcgccttcttcgaggagggcatgtggctgagatacaacttccaggcccccgccaccaacgccagagacagcagcagcagagtggacaacgcccccgaccagcagaacagccaccccgacctggcccaggaggagatcagattcagcttcagcaccaccaaggccccctgcatcctgctgtacatcagcagcttcaccaccgacttcctggccgtgctggtgaagcccaccggcagcctgcagatcagatacaacctgggcggcaccagagagccctacaacatcgacgtggaccacagaaacatggccaacggccagccccacagcgtgaacatcaccagacacgagaagaccatcttcctgaagctggaccactaccccagcgtgagctaccacctgcccagcagcagcgacaccctgttcaacagccccaagagcctgttcctgggcaaggtgatcgagaccggcaagatcgaccaggagatccacaagtacaacacccccggcttcaccggctgcctgagcagagtgcagttcaaccagatcgcccccctgaaggccgccctgagacagaccaacgccagcgcccacgtgcacatccagggcgagctggtggagagcaactgcggcgccagccccctgaccctgagccccatgagcagcgccaccgacccctggcacctggaccacctggacagcgccagcgccgacttcccctacaaccccggccagggccaggccatcagaaacggcgtgaacagaaacagcgccatcatcggcggcgtgatcgccgtggtgatcttcaccatcctgtgcaccctggtgttcctgatcagatacatgttcagacacaagggcacctaccacaccaacgaggccaagggcgccgagagcgccgagagcgccgacgccgccatcatgaacaacgaccccaacttcaccgagaccatcgacgagagcaagaaggagtggctgatctag

SEQ ID NO: 77611 - DNA, 1173 bp, Artificial Sequence
  Description of Artificial Sequence: Synthetic coding sequence
atgaacggcgtgaccctggacctggaggagagagccaaggtgaccagcggcttcatcagcggctgcagcggccactgcaccagctacggcaccaactgcgagaacggcggcaagtgcctggagagataccacggctacagctgcgactgcagcaacaccgcctacgacggcaccttctgcaacaaggacgtgggcgccttcttcgaggagggcatgtggctgagatacaacttccaggcccccgccaccaacgccagagacagcagcagcagagtggacaacgcccccgaccagcagaacagccaccccgacctggcccaggaggagatcagattcagcttcagcaccaccaaggccccctgcatcctgctgtacatcagcagcttcaccaccgacttcctggccgtgctggtgaagcccaccggcagcctgcagatcagatacaacctgggcggcaccagagagccctacaacatcgacgtggaccacagaaacatggccaacggccagccccacagcgtgaacatcaccagacacgagaagaccatcttcctgaagctggaccactaccccagcgtgagctaccacctgcccagcagcagcgacaccctgttcaacagccccaagagcctgttcctgggcaaggtgatcgagaccggcaagatcgaccaggagatccacaagtacaacacccccggcttcaccggctgcctgagcagagtgcagttcaaccagatcgcccccctgaaggccgccctgagacagaccaacgccagcgcccacgtgcacatccagggcgagctggtggagagcaactgcggcgccagccccctgaccctgagccccatgagcagcgccaccgacccctggcacctggaccacctggacagcgccagcgccgacttcccctacaaccccggccagggccaggccatcagaaacggcgtgaacagaaacagcgccatcatcggcggcgtgatcgccgtggtgatcttcaccatcctgtgcaccctggtgttcctgatcagatacatgttcagacacaagggcacctaccacaccaacgaggccaagggcgccgagagcgccgagagcgccgacgccgccatcatgaacaacgaccccaacttcaccgagaccatcgacgagagcaagaaggagtggctgatctag

SEQ ID NO: 77612 - DNA, 1353 bp, Artificial Sequence
  Description of Artificial Sequence: Synthetic coding sequence
atgagcgacatggaggacgacttcatgtgcgacgacgaggaggactacgacctggagtacagcgaggacagcaacagcgagcccaacgtggacctggagaaccagtactacaacagcaaggccctgaaggaggacgaccccaaggccgccctgagcagcttccagaaggtgctggagctggagggcgagaagggcgagtggggcttcaaggccctgaagcagatgatcaagatcaacttcaagctgaccaacttccccgagatgatgaacagatacaagcagctgctgacctacatcagaagcgccgtgaccagaaactacagcgagaagagcatcaacagcatcctggactacatcagcaccagcaagcagaacagcgacttcctgtgccagatggacctgctgcaggagttctacgagaccaccctggaggccctgaaggacgccaagaacgacagactgtggttcaagaccaacaccaagctgggcaagctgtacctggagagagaggagtacggcaagctgcagaagatcctgagacagctgcaccagagctgccagaccgacgacggcgaggacgacctgaagaagggcacccagctgctggagatctacgccctggagatccagatgtacaccgcccagaagaacaacaagaagctgaaggccctgtacgagcagagcctgcacatcaagagcgccatcccccaccccctgatcatgggcgtgatcagagagtgcggcggcaagatgcacctgagagagggcgagttcgagaaggcccacaccgacttcttcgaggccttcaagaactacgacgagagcggcagccccagaagaaccacctgcctgaagtacctggtgctggccaacatgctgatgaagagcggcatcaaccccttcgacagccaggaggccaagccctacaagaacgaccccgagatcctggccatgaccaacctggtgagcgcctaccagaacaacgacatcaccgagttcgagaagatcctgaagaccaaccacagcaacatcatggacgaccccttcatcagagagcacatcgaggagctgctgagaaacatcagaacccaggtgctgatcaagctgatcaagccctacaccagaatccacatccccttcatcagcaaggagctgaacatcgacgtggccgacgtggagagcctgctggtgcagtgcatcctggacaacaccatccacggcagaatcgaccaggtgaaccagctgctggagctggaccaccagaagagaggcggcgccagatacaccgccctggacaagtggaccaaccagctgaacagcctgaaccaggccgtggtgagcaagctggcctag

SEQ ID NO: 77613 - DNA, 1332 bp, Artificial Sequence
  Description of Artificial Sequence: Synthetic coding sequence
atgagcgacatggaggacgacttcatgtgcgacgacgaggaggactacgacctggagtacagcgaggacagcaacagcgagcccaacgtggacctggagaaccagtactacaacagcaaggccctgaaggaggacgaccccaaggccgccctgagcagcttccagaaggtgctggagctggagggcgagaagggcgagtggggcttcaaggccctgaagcagatgatcaagatcaacttcaagctgaccaacttccccgagatgatgaacagatacaagcagctgctgacctacatcagaagcgccgtgaccagaaactacagcgagaagagcatcaacagcatcctggactacatcagcaccagcaagcagatggacctgctgcaggagttctacgagaccaccctggaggccctgaaggacgccaagaacgacagactgtggttcaagaccaacaccaagctgggcaagctgtacctggagagagaggagtacggcaagctgcagaagatcctgagacagctgcaccagagctgccagaccgacgacggcgaggacgacctgaagaagggcacccagctgctggagatctacgccctggagatccagatgtacaccgcccagaagaacaacaagaagctgaaggccctgtacgagcagagcctgcacatcaagagcgccatcccccaccccctgatcatgggcgtgatcagagagtgcggcggcaagatgcacctgagagagggcgagttcgagaaggcccacaccgacttcttcgaggccttcaagaactacgacgagagcggcagccccagaagaaccacctgcctgaagtacctggtgctggccaacatgctgatgaagagcggcatcaaccccttcgacagccaggaggccaagccctacaagaacgaccccgagatcctggccatgaccaacctggtgagcgcctaccagaacaacgacatcaccgagttcgagaagatcctgaagaccaaccacagcaacatcatggacgaccccttcatcagagagcacatcgaggagctgctgagaaacatcagaacccaggtgctgatcaagctgatcaagccctacaccagaatccacatccccttcatcagcaaggagctgaacatcgacgtggccgacgtggagagcctgctggtgcagtgcatcctggacaacaccatccacggcagaatcgaccaggtgaaccagctgctggagctggaccaccagaagagaggcggcgccagatacaccgccctggacaagtggaccaaccagctgaacagcctgaaccaggccgtggtgagcaagctggcctag

SEQ ID NO: 77614 - DNA, 1272 bp, Artificial Sequence
  Description of Artificial Sequence: Synthetic coding sequence
atggccagcgccctggagcagttcgtgaacagcgtgagacagctgagcgcccagggccagatgacccagctgtgcgagctgatcaacaagagcggcgagctgctggccaagaacctgagccacctggacaccgtgctgggcgccctggacgtgcaggagcacagcctgggcgtgctggccgtgctgttcgtgaagttcagcatgcccagcgtgcccgacttcgagaccctgttcagccaggtgcagctgttcatcagcacctgcaacggcgagcacatcagatacgccaccgacaccttcgccggcctgtgccaccagctgaccaacgccctggtggagagaaagcagcccctgagaggcatcggcatcctgaagcaggccatcgacaagatgcagatgaacaccaaccagctgaccagcatccacgccgacctgtgccagctgtgcctgctggccaagtgcttcaagcccgccctgccctacctggacgtggacatgatggacatctgcaaggagaacggcgcctacgacgccaagcacttcctgtgctactactactacggcggcatgatctacaccggcctgaagaacttcgagagagccctgtacttctacgagcaggccatcaccacccccgccatggccgtgagccacatcatgctggagagctacaagaagtacatcctggtgagcctgatcctgctgggcaaggtgcagcagctgcccaagtacaccagccagatcgtgggcagattcatcaagcccctgagcaacgcctaccacgagctggcccaggtgtacagcaccaacaaccccagcgagctgagaaacctggtgaacaagcacagcgagaccttcaccagagacaacaacatgggcctggtgaagcagtgcctgagcagcctgtacaagaagaacatccagagactgaccaagaccttcctgaccctgagcctgcaggacatggccagcagagtgcagctgagcggcccccaggaggccgagaagtacgtgctgcacatgatcgaggacggcgagatcttcgccagcatcaaccagaaggacggcatggtgagcttccacgacaaccccgagaagtacaacaaccccgccatgctgcacaacatcgaccaggagatgctgaagtgcatcgagctggacgagagactgaaggccatggaccaggagatcaccgtgaacccccagttcgtgcagaagagcatgggcagccaggaggacgacagcggcaacaagcccagcagctacagctag

SEQ ID NO: 77615 - DNA, 960 bp, Artificial Sequence
  Description of Artificial Sequence: Synthetic coding sequence
atggccagcgccctggagcagttcgtgaacagcgtgagacagctgagcgcccagggccagatgacccagctgtgcgagctgatcaacaagagcggcgagctgctggccaagaacctgagccacctggacaccgtgctgggcgccctggacgtgcaggagcacagcctgggcgtgctggccgtgctgttcgtgaagttcagcatgcccagcgtgcccgacttcgagaccctgttcagccaggtgcagctgttcatcagcacctgcaacggcgagcacatcagatacgccaccgacaccttcgccggcctgtgccaccagctgaccaacgccctggtggagagaaagcagcccctgagaggcatcggcatcctgaagcaggccatcgacaagatgcagatgaacaccaaccagctgaccagcatccacgccgacctgtgccagctgtgcctgctggccaagtgcttcaagcccgccctgccctacctggacgtggacatgatggacatctgcaaggagaacggcgcctacgacgccaagcacttcctgtgctactactactacggcggcatgatctacaccggcctgaagaacttcgagagagccctgtacttctacgagcaggccatcaccacccccgccatggccgtgagccacatcatgctggagagctacaagaagtacatcctggtgagcctgatcctgctgggcaaggtgcagcagctgcccaagtacaccagccagatcgtgggcagattcatcaagagacagagcctggccatgctggccagactggtgctgaacagctggccccaggccgtgctgctgagactgccccccagagtgctgggcctgcagcccctgagcaacgcctaccacgagctggcccaggtgtacagcaccaacaaccccagcgagctgagaaacctggtgaacaagcacagcgagaccttcaccagatag

SEQ ID NO: 77616 - DNA, 834 bp, Artificial Sequence
  Description of Artificial Sequence: Synthetic coding sequence
gccagccccttctgggtgagctggctgtacggcagccccctgcccgccccccccctgcccggcggcgccagaagcggcacctgcgcccccatcctggtgctgcagaacgccgccgaggccctggccagacagatgacccagctgtgcgagctgatcaacaagagcggcgagctgctggccaagaacctgagccacctggacaccgtgctgggcgccctggacgtgcaggagcacagcctgggcgtgctggccgtgctgttcgtgaagttcagcatgcccagcgtgcccgacttcgagaccctgttcagccaggtgcagctgttcatcagcacctgcaacggcgagcacatcagatacgccaccgacaccttcgccggcctgtgccaccagctgaccaacgccctggtggagagaaagcagcccctgagaggcatcggcatcctgaagcaggccatcgacaagatgcagatgaacaccaaccagctgaccagcatccacgccgacctgtgccagctgtgcctgctggccaagtgcttcaagcccgccctgccctacctggacgtggacatgatggacatctgcaaggagaacggcgcctacgacgccaagcacttcctgtgctactactactacggcggcatgatctacaccggcctgaagaacttcgagagagccctgtacttctacgagcaggccatcaccacccccgccatggccgtgagccacatcatgctggagagctacaagaagtacatcctggtgagcctgatcctgctgggcaaggtgcagcagctgcccaagtacaccagccagatcgtgggcagattcatctag

SEQ ID NO: 77617 - DNA, 1212 bp, Artificial Sequence
  Description of Artificial Sequence: Synthetic coding sequence
atgacccagctgtgcgagctgatcaacaagagcggcgagctgctggccaagaacctgagccacctggacaccgtgctgggcgccctggacgtgcaggagcacagcctgggcgtgctggccgtgctgttcgtgaagttcagcatgcccagcgtgcccgacttcgagaccctgttcagccaggtgcagctgttcatcagcacctgcaacggcgagcacatcagatacgccaccgacaccttcgccggcctgtgccaccagctgaccaacgccctggtggagagaaagcagcccctgagaggcatcggcatcctgaagcaggccatcgacaagatgcagatgaacaccaaccagctgaccagcatccacgccgacctgtgccagctgtgcctgctggccaagtgcttcaagcccgccctgccctacctggacgtggacatgatggacatctgcaaggagaacggcgcctacgacgccaagcacttcctgtgctactactactacggcggcatgatctacaccggcctgaagaacttcgagagagccctgtacttctacgagcaggccatcaccacccccgccatggccgtgagccacatcatgctggagagctacaagaagtacatcctggtgagcctgatcctgctgggcaaggtgcagcagctgcccaagtacaccagccagatcgtgggcagattcatcaagcccctgagcaacgcctaccacgagctggcccaggtgtacagcaccaacaaccccagcgagctgagaaacctggtgaacaagcacagcgagaccttcaccagagacaacaacatgggcctggtgaagcagtgcctgagcagcctgtacaagaagaacatccagagactgaccaagaccttcctgaccctgagcctgcaggacatggccagcagagtgcagctgagcggcccccaggaggccgagaagtacgtgctgcacatgatcgaggacggcgagatcttcgccagcatcaaccagaaggacggcatggtgagcttccacgacaaccccgagaagtacaacaaccccgccatgctgcacaacatcgaccaggagatgctgaagtgcatcgagctggacgagagactgaaggccatggaccaggagatcaccgtgaacccccagttcgtgcagaagagcatgggcagccaggaggacgacagcggcaacaagcccagcagctacagctag

SEQ ID NO: 77618 - DNA, 1614 bp, Artificial Sequence
  Description of Artificial Sequence: Synthetic coding sequence
atggccgcccagtgcgtgaccaaggtggccctgaacgtgagctgcgccaacctgctggacaaggacatcggcagcaagagcgaccccctgtgcgtgctgttcctgaacaccagcggccagcagtggtacgaggtggagagaaccgagagaatcaagaactgcctgaacccccagttcagcaagaccttcatcatcgactactacttcgaggtggtgcagaagctgaagttcggcgtgtacgacatcgacaacaagaccatcgagctgagcgacgacgacttcctgggcgagtgcgagtgcaccctgggccagatcgtgagcagcaagaagctgaccagacccctggtgatgaagaccggcagacccgccggcaagggcagcatcaccatcagcgccgaggagatcaaggacaacagagtggtgctgttcgagatggaggccagaaagctggacaacaaggacctgttcggcaagagcgacccctacctggagttccacaagcagaccagcgacggcaactggctgatggtgcacagaaccgaggtggtgaagaacaacctgaaccccgtgtggagacccttcaagatcagcctgaacagcctgtgctacggcgacatggacaagaccatcaaggtggagtgctacgactacgacaacgacggcagccacgacctgatcggcaccttccagaccaccatgaccaagctgaaggaggccagcagaagcagccccgtggagttcgagtgcatcaacgagaagaagagacagaagaagaagagctacaagaacagcggcgtgatcagcgtgaagcagtgcgagatcaccgtggagtgcaccttcctggactacatcatgggcggctgccagctgaacttcaccgtgggcgtggacttcaccggcagcaacggcgaccccagaagccccgacagcctgcactacatcagccccaacggcgtgaacgagtacctgaccgccctgtggagcgtgggcctggtgatccaggactacgacgccgacaagatgttccccgccttcggcttcggcgcccagatccccccccagtggcaggtgagccacgagttccccatgaacttcaaccccagcaacccctactgcaacggcatccagggcatcgtggaggcctacagaagctgcctgccccagatcaagctgtacggccccaccaacttcagccccatcatcaaccacgtggccagattcgccgccgccgccacccagcagcagaccgccagccagtacttcgtgctgctgatcatcaccgacggcgtgatcaccgacctggacgagaccagacaggccatcgtgaacgccagcagactgcccatgagcatcatcatcgtgggcgtgggcggcgccgacttcagcgccatggagttcctggacggcgacggcggcagcctgagaagccccctgggcgaggtggccatcagagacatcgtgcagttcgtgcccttcagacagttccagaacgcccccaaggaggccctggcccagtgcgtgctggccgagatcccccagcaggtggtgggctacttcaacacctacaagctgctgccccccaagaaccccgccaccaagcagcagaagcagtag

SEQ ID NO: 77619 - DNA, 420 bp, Artificial Sequence
  Description of Artificial Sequence: Synthetic coding sequence
atggccgcccagtgcgtgaccaaggtggccctgaacgtgagctgcgccaacctgctggacaaggacatcggcagcaagagcgaccccctgtgcgtgctgttcctgaacaccagcggccagcagtggtacgaggtggagagaaccgagagaatcaagaactgcctgaacccccagttcagcaagaccttcatcatcgactactacttcgaggtggtgcagaagctgaagttcggcgtgtacgacatcgacaacaagaccatcgagctgagcgacgacgacttcctgggcgagtgcgagtgcaccctgggccagatcgtgagcagcaagaagctgaccagacccctggtgatgaagaccggcagacccgccggcaagggcagcatcaccatcagcgccgaggagatcaaggacaacagatag

SEQ ID NO: 77620 - DNA, 30 bp, Artificial Sequence
  Description of Artificial Sequence: Synthetic coding sequence
atggccgcccagtgcgtgaccaaggtgtag

SEQ ID NO: 77621 - DNA, 1614 bp, Artificial Sequence; identical to SEQ ID NO: 77618
  Description of Artificial Sequence: Synthetic coding sequence

SEQ ID NO: 77622 - DNA, 240 bp, Artificial Sequence
  Description of Artificial Sequence: Synthetic coding sequence
atggccgcccagtgcgtgaccaaggtggccctgaacgtgagctgcgccaacctgctggacaaggacatcggcagcaagagcgaccccctgtgcgtgctgttcctgaacaccagcggccagcagtggtacgaggtggagagaaccgagagaatcaagaactgcctgaacccccagttcagcaagaccttcatcatcgactactacttcgaggtggtgcagaagctgaagttcggcgtgtag

SEQ ID NO: 77623 - DNA, 408 bp, Artificial Sequence
  Description of Artificial Sequence: Synthetic coding sequence
atggccgcccagtgcgtgaccaaggtggccctgaacgtgagctgcgccaacctgctggacaaggacatcggcagcaagagcgaccccctgtgcgtgctgttcctgaacaccagcggccagcagtggtacgaggtggagagaaccgagagaatcaagaactgcctgaacccccagttcagcaagaccttcatcatcgactactacttcgaggtggtgcagaagctgaagttcggcgtgtacgacatcgacaacaagaccatcgagctgagcgacgacgacttcctgggcgagtgcgagtgcaccctgggccagatcgtgagcagcaagaagctgaccagacccctggtgatgaagaccggcagacccgccggcaagggcagcatcaccatcagcgccgaggagatctag

SEQ ID NO: 77624 - DNA, 705 bp, Artificial Sequence
  Description of Artificial Sequence: Synthetic coding sequence
atggccgcccagtgcgtgaccaaggtggccctgaacgtgagctgcgccaacctgctggacaaggacatcggcagcaagagcgaccccctgtgcgtgctgttcctgaacaccagcggccagcagtggtacgaggtggagagaaccgagagaatcaagaactgcctgaacccccagttcagcaagaccttcatcatcgactactacttcgaggtggtgcagaagctgaagttcggcgtgtacgacatcgacaacaagaccatcgagctgagcgacgacgacttcctgggcgagtgcgagtgcaccctgggccagatcgtgagcagcaagaagctgaccagacccctggtgatgaagaccggcagacccgccggcaagggcagcatcaccatcagcgccgaggagatcaaggacaacagagtggtgctgttcgagatggaggccagaaagctggacaacaaggacctgttcggcaagagcgacccctacctggagttccacaagcagaccagcgacggcaactggctgatggtgcacagaaccgaggtggtgaagaacaacctgaaccccgtgtggagacccttcaagatcagcctgaacagcctgtgctacggcgacatggacaagaccatcaaggtggagtgctacgactacgacaacgacggcagccacgacctgatcggcaccttccagaccaccatgacctag

SEQ ID NO: 77625 - DNA, 462 bp, Artificial Sequence
  Description of Artificial Sequence: Synthetic coding sequence
atggccgcccagtgcgtgaccaaggtggccctgaacgtgagctgcgccaacctgctggacaaggacatcggcagcaagagcgaccccctgtgcgtgctgttcctgaacaccagcggccagcagtggtacgaggtggagagaaccgagagaatcaagaactgcctgaacccccagttcagcaagaccttcatcatcgactactacttcgaggtggtgcagaagctgaagttcggcgtgtacgacatcgacaacaagaccatcgagctgagcgacgacgacttcctgggcgagtgcgagtgcaccctgggccagatcgtgagcagcaagaagctgaccagacccctggtgatgaagaccggcagacccgccggcaagggcagcatcaccatcagcgccgaggagatcaaggacaacagagtggtgctgttcgagatggaggccagaaagctggacaacaagtag

SEQ ID NO: 77626 - DNA, 1782 bp, Artificial Sequence
  Description of Artificial Sequence: Synthetic coding sequence
atggagcagcccgaggacatggccagcctgagcgagttcgacagcctggccggcagcatccccgccaccaaggtggagatcaccgtgagctgcagaaacctgctggacaaggacatgttcagcaagagcgaccccctgtgcgtgatgtacacccagggcatggagaacaagcagtggagagagttcggcagaaccgaggtgatcgacaacaccctgaaccccgacttcgtgagaaagttcatcgtggactacttcttcgaggagaagcagaacctgagattcgacctgtacgacgtggacagcaagagccccgacctgagcaagcacgacttcctgggccaggccttctgcaccctgggcgagatcgtgggcagccccggcagcagactggagaagcccctgaccatcggcgccttcagcctgaacagcagaaccggcaagcccatgcccgccgtgagcaacggcggcgtgcccggcaagaagtgcggcaccatcatcctgagcgccgaggagctgagcaactgcagagacgtggccaccatgcagttctgcgccaacaagctggacaagaaggacttcttcggcaagagcgaccccttcctggtgttctacagaagcaacgaggacggcaccttcaccatctgccacaagaccgaggtgatgaagaacaccctgaaccccgtgtggcagaccttcagcatccccgtgagagccctgtgcaacggcgactacgacagaaccatcaaggtggaggtgtacgactgggacagagacggcagccacgacttcatcggcgagttcaccaccagctacagagagctggccagaggccagagccagttcaacatctacgaggtggtgaaccccaagaagaagatgaagaagaagaagtacgtgaacagcggcaccgtgaccctgctgagcttcgccgtggagagcgagtgcaccttcctggactacatcaagggcggcacccagatcaacttcaccgtggccatcgacttcaccgccagcaacggcaaccccagccagagcaccagcctgcactacatgagcccctaccagctgaacgcctacgccctggccctgaccgccgtgggcgagatcatccagcactacgacagcgacaagatgttccccgccctgggcttcggcgccaagctgccccccgacggcagagtgagccacgagttccccctgaacggcaaccaggagaaccccagctgctgcggcatcgacggcatcctggaggcctaccacagaagcctgagaaccgtgcagctgtacggccccaccaacttcgcccccgtggtgacccacgtggccagaaacgccgccgccgtgcaggacggcagccagtacagcgtgctgctgatcatcaccgacggcgtgatcagcgacatggcccagaccaaggaggccatcgtgaacgccgccaagctgcccatgagcatcatcatcgtgggcgtgggccaggccgagttcgacgccatggtggagctggacggcgacgacgtgagaatcagcagcagaggcaagctggccgagagagacatcgtgcagttcgtgcccttcagagactacgtggacagaaccggcaaccacgtgctgagcatggccagactggccagagacgtgctggccgagatccccgaccagctggtgagctacatgaaggcccagggcatcagacccagacccccccccgccgcccccacccacagccccagccagagccccgccagaaccccccccgccagccccctgcacacccacatctag

SEQ ID NO: 77627 - DNA, 906 bp, Artificial Sequence
  Description of Artificial Sequence: Synthetic coding sequence
atgaagaagaagaagtacgtgaacagcggcaccgtgaccctgctgagcttcgccgtggagagcgagtgcaccttcctggactacatcaagggcggcacccagatcaacttcaccgtggccatcgacttcaccgccagcaacggcaaccccagccagagcaccagcctgcactacatgagcccctaccagctgaacgcctacgccctggccctgaccgccgtgggcgagatcatccagcactacgacagcgacaagatgttccccgccctgggcttcggcgccaagctgccccccgacggcagagtgagccacgagttccccctgaacggcaaccaggagaaccccagctgctgcggcatcgacggcatcctggaggcctaccacagaagcctgagaaccgtgcagctgtacggccccaccaacttcgcccccgtggtgacccacgtggccagaaacgccgccgccgtgcaggacggcagccagtacagcgtgctgctgatcatcaccgacggcgtgatcagcgacatggcccagaccaaggaggccatcgtgaacgccgccaagctgcccatgagcatcatcatcgtgggcgtgggccaggccgagttcgacgccatggtggagctggacggcgacgacgtgagaatcagcagcagaggcaagctggccgagagagacatcgtgcagttcgtgcccttcagagactacgtggacagaaccggcaaccacgtgctgagcatggccagactggccagagacgtgctggccgagatccccgaccagctggtgagctacatgaaggcccagggcatcagacccagacccccccccgccgcccccacccacagccccagccagagccccgccagaaccccccccgccagccccctgcacacccacatctag

SEQ ID NO: 77628 - DNA, 1515 bp, Artificial Sequence
  Description of Artificial Sequence: Synthetic coding sequence
atggtgctggccgacctgggcagaaagatcaccagcgccctgagaagcctgagcaacgccaccatcatcaacgaggaggtgctgaacgccatgctgaaggaggtgtgcaccgccctgctggaggccgacgtgaacatcaagctggtgaagcagctgagagagaacgtgaagagcgccatcgacctggaggagatggccagcggcctgaacaagagaaagatgatccagcacgccgtgttcaaggagctggtgaagctggtggaccccggcgtgaaggcctggacccccaccaagggcaagcagaacgtgatcatgttcgtgggcctgcagggcagcggcaagaccaccacctgcagcaagctggcctactactaccagagaaagggctggaagacctgcctgatctgcgccgacaccttcagagccggcgccttcgaccagctgaagcagaacgccaccaaggccagaatccccttctacggcagctacaccgagatggaccccgtgatcatcgccagcgagggcgtggagaagttcaagaacgagaacttcgagatcatcatcgtggacaccagcggcagacacaagcaggaggacagcctgttcgaggagatgctgcaggtggccaacgccatccagcccgacaacatcgtgtacgtgatggacgccagcatcggccaggcctgcgaggcccaggccaaggccttcaaggacaaggtggacgtggccagcgtgatcgtgaccaagctggacggccacgccaagggcggcggcgccctgagcgccgtggccgccaccaagagccccatcatcttcatcggcaccggcgagcacatcgacgacttcgagcccttcaagacccagcccttcatcagcaagctgctgggcatgggcgacatcgagggcctgatcgacaaggtgaacgagctgaagctggacgacaacgaggccctgatcgagaagctgaagcacggccagttcaccctgagagacatgtacgagcagttccagaacatcatgaagatgggccccttcagccagatcctgggcatgatccccggcttcggcaccgacttcatgagcaagggcaacgagcaggagagcatggccagactgaagaagctgatgaccatcatggacagcatgaacgaccaggagctggacagcaccgacggcgccaaggtgttcagcaagcagcccggcagaatccagagagtggccagaggcagcggcgtgagcaccagagacgtgcaggagctgctgacccagtacaccaagttcgcccagatggtgaagaagatgggcggcatcaagggcctgttcaagggcggcgacatgagcaagaacgtgagccagagccagatggccaagctgaaccagcagatggccaagatgatggaccccagagtgctgcaccacatgggcggcatggccggcctgcagagcatgatgagacagttccagcagggcgccgccggcaacatgaagggcatgatgggcttcaacaacatgtag

SEQ ID NO: 77629 - DNA, 1674 bp, Artificial Sequence
  Description of Artificial Sequence: Synthetic coding sequence
atgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagcagtgggtggaggtggagagaaccgaggtgctgagaagctgcagcagccccgtgttcagcagagtgctggccctggagtacttcttcgaggagaagcagcccctgcagttccacgtgttcgacgccgaggacggcgccaccagccccagaaacgacaccttcctgggcagcaccgagtgcaccctgggccagatcgtgagccagaccaaggtgaccaagcccctgctgctgaagaacggcaagaccgccggcaagagcaccatcaccatcgtggccgaggaggtgagcggcaccaacgactacgtgcagctgaccttcagagcctacaagctggacaacaaggacctgttcagcaagagcgaccccttcatggagatctacaagaccaacgaggaccagagcgaccagctggtgtggagaaccgaggtggtgaagaacaacctgaaccccagctgggagcccttcagactgagcctgcacagcctgtgcagctgcgacgtgcacagacccctgaagttcctggtgtacgactacgacagcagcggcaagcacgacttcatcggcgagttcaccagcaccttccaggagatgcaggagggcaccgccaaccccggccaggagatgcagtgggactgcatcaaccccaagtacagagacaagaagaagaactacaagagcagcggcaccgtggtgctggcccagtgcaccgtggagaaggtgcacaccttcctggactacatcatgggcggctgccagatcagcttcaccgtggccatcgacttcaccgccagcaacggcgaccccagaagcagccagagcctgcactgcctgagccccagacagcccaaccactacctgcaggccctgagagccgtgggcggcatctgccaggactacgacagcgacaagagattccccgccttcggcttcggcgccagaatcccccccaacttcgaggtgagccacgacttcgccatcaacttcgaccccgagaaccccgagtgcgaggagatcagcggcgtgatcgccagctacagaagatgcctgccccagatccagctgtacggccccaccaacgtggcccccatcatcaacagagtggccgagcccgcccagagagagcagagcaccggccaggccaccaagtacagcgtgctgctggtgctgaccgacggcgtggtgagcgacatggccgagaccagaaccgccatcgtgagagccagcagactgcccatgagcatcatcatcgtgggcgtgggcaacgccgacttcagcgacatgagactgctggacggcgacgacggccccctgagatgccccagaggcgtgcccgccgccagagacatcgtgcagttcgtgcccttcagagacttcaaggacgccgcccccagcgccctggccaagtgcgtgctggccgaggtgcccagacaggtggtggagtactacgccagccagggcatcagccccggcgcccccagaccctgcaccctggccaccacccccagccccagcccctag

SEQ ID NO: 77630 - DNA, 1839 bp, Artificial Sequence
  Description of Artificial Sequence: Synthetic coding sequence
atggccttcaaggagcacggcaagatcaccagctgctgcatccccggccccatcaacagcagcagagccggcgccggcgccggcgccagcggctggagcagcaagggcgtgagagccagagccagagagcccgagagaggcgcccccgacagagagcccagcgacatgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagcagtgggtggaggtggagagaaccgaggtgctgagaagctgcagcagccccgtgttcagcagagtgctggccctggagtacttcttcgaggagaagcagcccctgcagttccacgtgttcgacgccgaggacggcgccaccagccccagaaacgacaccttcctgggcagcaccgagtgcaccctgggccagatcgtgagccagaccaaggtgaccaagcccctgctgctgaagaacggcaagaccgccggcaagagcaccatcaccatcgtggccgaggaggtgagcggcaccaacgactacgtgcagctgaccttcagagcctacaagctggacaacaaggacctgttcagcaagagcgaccccttcatggagatctacaagaccaacgaggaccagagcgaccagctggtgtggagaaccgaggtggtgaagaacaacctgaaccccagctgggagcccttcagactgagcctgcacagcctgtgcagctgcgacgtgcacagacccctgaagttcctggtgtacgactacgacagcagcggcaagcacgacttcatcggcgagttcaccagcaccttccaggagatgcaggagggcaccgccaaccccggccaggagatgcagtgggactgcatcaaccccaagtacagagacaagaagaagaactacaagagcagcggcaccgtggtgctggcccagtgcaccgtggagaaggtgcacaccttcctggactacatcatgggcggctgccagatcagcttcaccgtggccatcgacttcaccgccagcaacggcgaccccagaagcagccagagcctgcactgcctgagccccagacagcccaaccactacctgcaggccctgagagccgtgggcggcatctgccaggactacgacagcgacaagagattccccgccttcggcttcggcgccagaatcccccccaacttcgaggtgagccacgacttcgccatcaacttcgaccccgagaaccccgagtgcgaggagatcagcggcgtgatcgccagctacagaagatgcctgccccagatccagctgtacggccccaccaacgtggcccccatcatcaacagagtggccgagcccgcccagagagagcagagcaccggccaggccaccaagtacagcgtgctgctggtgctgaccgacggcgtggtgagcgacatggccgagaccagaaccgccatcgtgagagccagcagactgcccatgagcatcatcatcgtgggcgtgggcaacgccgacttcagcgacatgagactgctggacggcgacgacggccccctgagatgccccagaggcgtgcccgccgccagagacatcgtgcagttcgtgcccttcagagacttcaaggacgccgcccccagcgccctggccaagtgcgtgctggccgaggtgcccagacaggtggtggagtactacgccagccagggcatcagccccggcgcccccagaccctgcaccctggccaccacccccagccccagcccctag

SEQ ID NO: 77631 - DNA, 159 bp, Artificial Sequence
  Description of Artificial Sequence: Synthetic coding sequence
atgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagtag

SEQ ID NO: 77632 - DNA, 396 bp, Artificial Sequence
  Description of Artificial Sequence: Synthetic coding sequence
atgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagcagtgggtggaggtggagagaaccgaggtgctgagaagctgcagcagccccgtgttcagcagagtgctggccctggagtacttcttcgaggagaagcagcccctgcagttccacgtgttcgacgccgaggacggcgccaccagccccagaaacgacaccttcctgggcagcaccgagtgcaccctgggccagatcgtgagccagaccaaggtgaccaagcccctgctgctgaagaactag

SEQ ID NO: 77633 - DNA, 681 bp, Artificial Sequence
  Description of Artificial Sequence: Synthetic coding sequence
atgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagcagtgggtggaggtggagagaaccgaggtgctgagaagctgcagcagccccgtgttcagcagagtgctggccctggagtacttcttcgaggagaagcagcccctgcagttccacgtgttcgacgccgaggacggcgccaccagccccagaaacgacaccttcctgggcagcaccgagtgcaccctgggccagatcgtgagccagaccaaggtgaccaagcccctgctgctgaagaacggcaagaccgccggcaagagcaccatcaccatcgtggccgaggaggtgagcggcaccaacgactacgtgcagctgaccttcagagcctacaagctggacaacaaggacctgttcagcaagagcgaccccttcatggagatctacaagaccaacgaggaccagagcgaccagctggtgtggagaaccgaggtggtgaagaacaacctgaaccccagctgggagcccttcagactgagcctgcacagcctgtgcagctgcgacgtgcacagacccctgaagttcctgtag

SEQ ID NO: 77634 - DNA, 318 bp, Artificial Sequence
  Description of Artificial Sequence: Synthetic coding sequence
atgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagcagtgggtggaggtggagagaaccgaggtgctgagaagctgcagcagccccgtgttcagcagagtgctggccctggagtacttcttcgaggagaagcagcccctgcagttccacgtgttcgacgccgaggacggcgccaccagccccagaaacgacacctag

SEQ ID NO: 77635 - DNA, 426 bp, Artificial Sequence
  Description of Artificial Sequence: Synthetic coding sequence
atgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagcagtgggtggaggtggagagaaccgaggtgctgagaagctgcagcagccccgtgttcagcagagtgctggccctggagtacttcttcgaggagaagcagcccctgcagttccacgtgttcgacgccgaggacggcgccaccagccccagaaacgacaccttcctgggcagcaccgagtgcaccctgggccagatcgtgagccagaccaaggtgaccaagcccctgctgctgaagaacggcaagaccgccggcaagagcaccatcacctag

SEQ ID NO: 77636 - DNA, 450 bp, Artificial Sequence
  Description of Artificial Sequence: Synthetic coding sequence
atgagcgaccccgagatgggctgggtgcccgagccccccaccatgaccctgggcgccagcagagtggagctgagagtgagctgccacggcctgctggacagagacaccctgaccaagccccacccctgcgtgctgctgaagctgtacagcgacgagcagtgggtggaggtggagagaaccgaggtgctgagaagctgcagcagccccgtgttcagcagagtgctggccctggagtacttcttcgaggagaagcagcccctgcagttccacgtgttcgacgccgaggacggcgccaccagccccagaaacgacaccttcctgggcagcaccgagtgcaccctgggccagatcgtgagccagaccaaggtgaccaagcccctgctgctgaagaacggcaagaccgccggcaagagcaccatcaccatcgtggccgaggaggtgagcggctag

SEQ ID NO: 77637 - DNA, 1902 bp, Artificial Sequence
  Description of Artificial Sequence: Synthetic coding sequence
atgagcgccggcagcgagagaggcgccgccgccacccccggcggcctgcccgccccctgcgccagcaaggtggagctgagactgagctgcagacacctgctggacagagaccccctgaccaagagcgaccccagcgtggccctgctgcagcaggcccagggccagtgggtgcaggtgggcagaaccgaggtggtgagaagcagcctgcaccccgtgttcagcaaggtgttcaccgtggactactacttcgaggaggtgcagagactgagattcgaggtgtacgacacccacggccccagcggcttcagctgccaggaggacgacttcctgggcggcatggagtgcaccctgggccagcccgcccagaagtggctgctgcaggtggtgatgagagtgagcgtggacgtgctgggccccgccggccactgcgccaagcacttcctgtgctgcaccgagagcagccacctggccagaaccggccccagcttcctgctgagatacgacgacctgtgcctgccctgggccaccgccggcgccgtgagatggtggacctgcagaggcggccacacccagggctggcagatcgtggcccagaagaaggtgaccagacccctgctgctgaagttcggcagaaacgccggcaagagcaccatcaccgtgatcgccgaggacatcagcggcaacaacggctacgtggagctgagcttcagagccagaaagctggacgacaaggacctgttcagcaagagcgaccccttcctggagctgtacagagtgaacgacgaccagggcctgcagctggtgtacagaaccgaggtggtgaagaacaacctgaaccccgtgtgggaggccttcaaggtgagcctgagcagcctgtgcagctgcgaggagaccagacccctgaagtgcctggtgtgggactacgacagcagaggcaagcacgacttcatcggcgagttcagcaccaccttcgaggagatgcagaaggccttcgaggagggccaggcccagtgggactgcgtgaaccccaagtacaagcagaagagaagaagctacaagaacagcggcgtggtggtgctggccgacctgaagttccacagagtgtacagcttcctggactacatcatgggcggctgccagatccacttcaccgtggccatcgacttcaccgccagcaacggcgaccccagaaacagctgcagcctgcactacatcaacccctaccagcccaacgagtacctgaaggccctggtgagcgtgggcgagatctgccaggactacgacagcgacaagagattcagcgccctgggcttcggcgccagaatcccccccaagtacgaggtgagccacgacttcgccatcaacttcaaccccgaggacgacgagtgcgagggcatccagggcgtggtggaggcctaccagaactgcctgcccagagtgcagctgtacggccccaccaacgtggcccccatcatcagcaaggtggccagagtggccgccgccgaggagagcaccggcaaggccagccagtactacatcctgctgatcctgaccgacggcgtggtgaccgacatggccgacaccagagaggccatcgtgagagccagcagactgcccatgagcatcatcatcgtgggcgtgggcaacgccgacttcaccgacatgcaggtgctggacggcgacgacggcgtgctgagaagccccagaggcgagcccgccctgagagacatcgtgcagttcgtgcccttcagagagctgaagaacgccagccccgccgccctggccaagtgcgtgctggccgaggtgcccaagcaggtggtggagtactacagccacagaggcctgccccccagaagcctgggcgtgcccgccggcgaggccagccccggctgcaccccctag

SEQ ID NO: 77638 - DNA, 1677 bp, Artificial Sequence
  Description of Artificial Sequence: Synthetic coding sequence
atgagcgccggcagcgagagaggcgccgccgccacccccggcggcctgcccgccccctgcgccagcaaggtggagctgagactgagctgcagacacctgctggacagagaccccctgaccaagagcgaccccagcgtggccctgctgcagcaggcccagggccagtgggtgcaggtgggcagaaccgaggtggtgagaagcagcctgcaccccgtgttcagcaaggtgttcaccgtggactactacttcgaggaggtgcagagactgagattcgaggtgtacgacacccacggccccagcggcttcagctgccaggaggacgacttcctgggcggcatggagtgcaccctgggccagatcgtggcccagaagaaggtgaccagacccctgctgctgaagttcggcagaaacgccggcaagagcaccatcaccgtgatcgccgaggacatcagcggcaacaacggctacgtggagctgagcttcagagccagaaagctggacgacaaggacctgttcagcaagagcgaccccttcctggagctgtacagagtgaacgacgaccagggcctgcagctggtgtacagaaccgaggtggtgaagaacaacctgaaccccgtgtgggaggccttcaaggtgagcctgagcagcctgtgcagctgcgaggagaccagacccctgaagtgcctggtgtgggactacgacagcagaggcaagcacgacttcatcggcgagttcagcaccaccttcgaggagatgcagaaggccttcgaggagggccaggcccagtgggactgcgtgaaccccaagtacaagcagaagagaagaagctacaagaacagcggcgtggtggtgctggccgacctgaagttccacagagtgtacagcttcctggactacatcatgggcggctgccagatccacttcaccgtggccatcgacttcaccgccagcaacggcgaccccagaaacagctgcagcctgcactacatcaacccctaccagcccaacgagtacctgaaggccctggtgagcgtgggcgagatctgccaggactacgacagcgacaagagattcagcgccctgggcttcggcgccagaatcccccccaagtacgaggtgagccacgacttcgccatcaacttcaaccccgaggacgacgagtgcgagggcatccagggcgtggtggaggcctaccagaactgcctgcccagagtgcagctgtacggccccaccaacgtggcccccatcatcagcaaggtggccagagtggccgccgccgaggagagcaccggcaaggccagccagtactacatcctgctgatcctgaccgacggcgtggtgaccgacatggccgacaccagagaggccatcgtgagagccagcagactgcccatgagcatcatcatcgtgggcgtgggcaacgccgacttcaccgacatgcaggtgctggacggcgacgacggcgtgctgagaagccccagaggcgagcccgccctgagagacatcgtgcagttcgtgcccttcagagagctgaagaacgccagccccgccgccctggccaagtgcgtgctggccgaggtgcccaagcaggtggtggagtactacagccacagaggcctgccccccagaagcctgggcgtgcccgccggcgaggccagccccggctgcaccccctag

SEQ ID NO: 77639 - DNA, 825 bp, Artificial Sequence
  Description of Artificial Sequence: Synthetic coding sequence
atggccagcgacagcggcaaccagggcaccctgtgcaccctggagttcgccgtgcagatgacctgccagagctgcgtggacgccgtgagaaagagcctgcagggcgtggccggcgtgcaggacgtggaggtgcacctggaggaccagatggtgctggtgcacaccaccctgcccagccaggaggtgcaggccctgctggagggcaccggcagacaggccgtgctgaagggcatgggcagcggccagctgcagaacctgggcgccgccgtggccatcctgggcggccccggcaccgtgcagggcgtggtgagattcctgcagctgacccccgagagatgcctgatcgagggcaccatcgacggcctggagcccggcctgcacggcctgcacgtgcaccagtacggcgacctgaccaacaactgcaacagctgcggcaaccacttcaaccccgacggcgccagccacggcggcccccaggacagcgacagacacagaggcgacctgggcaacgtgagagccgacgccgacggcagagccatcttcagaatggaggacgagcagctgaaggtgtgggacgtgatcggcagaagcctgatcatcgacgagggcgaggacgacctgggcagaggcggccaccccctgagcaagatcaccggcaacagcggcgagagactggcctgcggcatcatcgccagaagcgccggcctgttccagaaccccaagcagatctgcagctgcgacggcctgaccatctgggaggagagaggcagacccatcgccggcaagggcagaaaggagagcgcccagccccccgcccacctgtag

SEQ ID NO: 77640 - DNA, 1365 bp, Artificial Sequence
  Description of Artificial Sequence: Synthetic coding sequence
atggccctgcagctgggcagactgagcagcggcccctgctggctggtggccagaggcggctgcggcggccccagagcctggagccagtgcggcggcggcggcctgagagcctggagccagagaagcgccgccggcagagtgtgcagaccccccggccccgccggcaccgagcagagcagaggcctgggccacggcagcaccagcagaggcggcccctgggtgggcaccggcctggccgccgccctggccggcctggtgggcctggccaccgccgccttcggccacgtgcagagagccgagatgctgcccaagaccagcggcaccagagccaccagcctgggcagacccgaggaggaggaggacgagctggcccacagatgcagcagcttcatggccccccccgtgaccgacctgggcgagctgagaagaagacccggcgacatgaagaccaagatggagctgctgatcctggagacccaggcccaggtgtgccaggccctggcccaggtggacggcggcgccaacttcagcgtggacagatgggagagaaaggagggcggcggcggcatcagctgcgtgctgcaggacggctgcgtgttcgagaaggccggcgtgagcatcagcgtggtgcacggcaacctgagcgaggaggccgccaagcagatgagaagcagaggcaaggtgctgaagaccaaggacggcaagctgcccttctgcgccatgggcgtgagcagcgtgatccaccccaagaacccccacgcccccaccatccacttcaactacagatacttcgaggtggaggaggccgacggcaacaagcagtggtggttcggcggcggctgcgacctgacccccacctacctgaaccaggaggacgccgtgcacttccacagaaccctgaaggaggcctgcgaccagcacggccccgacctgtaccccaagttcaagaagtggtgcgacgactacttcttcatcgcccacagaggcgagagaagaggcatcggcggcatcttcttcgacgacctggacagccccagcaaggaggaggtgttcagattcgtgcagagctgcgccagagccgtggtgcccagctacatccccctggtgaagaagcactgcgacgacagcttcaccccccaggagaagctgtggcagcagctgagaagaggcagatacgtggagttcaacctgctgtacgacagaggcaccaagttcggcctgttcacccccggcagcagaatcgagagcatcctgatgagcctgcccctgaccgccagatgggagtacatgcacagccccagcgagaacagcaaggaggccgagatcctggaggtgctgagacaccccagagactgggtgagatag

SEQ ID NO: 77641 - DNA, 1026 bp, Artificial Sequence
  Description of Artificial Sequence: Synthetic coding sequence
atgggcgtggccaccaccctgcagccccccaccaccagcaagaccctgcagaagcagcacctggaggccgtgggcgcctaccagtacgtgctgaccttcctgttcatgggccccttcttcagcctgctggtgttcgtgctgctgttcaccagcctgtggcccttcagcgtgttctacctggtgtggctgtacgtggactgggacacccccaaccagggcggcagaagaagcgagtggatcagaaacagagccatctggagacagctgagagactactaccccgtgaagctggtgaagaccgccgagctgccccccgacagaaactacgtgctgggcgcccacccccacggcatcatgtgcaccggcttcctgtgcaacttcagcaccgagagcaacggcttcagccagctgttccccggcctgagaccctggctggccgtgctggccggcctgttctacctgcccgtgtacagagactacatcatgagcttcggcctgtgccccgtgagcagacagagcctggacttcatcctgagccagccccagctgggccaggccgtggtgatcatggtgggcggcgcccacgaggccctgtacagcgtgcccggcgagcactgcctgaccctgcagaagagaaagggcttcgtgagactggccctgagacacggcgccagcctggtgcccgtgtacagcttcggcgagaacgacatcttcagactgaaggccttcgccaccggcagctggcagcactggtgccagctgaccttcaagaagctgatgggcttcagcccctgcatcttctggggcagaggcctgttcagcgccaccagctggggcctgctgcccttcgccgtgcccatcaccaccgtggtgggcagacccatccccgtgccccagagactgcaccccaccgaggaggaggtgaaccactaccacgccctgtacatgaccgccctggagcagctgttcgaggagcacaaggagagctgcggcgtgcccgccagcacctgcctgaccttcatctag

SEQ ID NO: 77642 - DNA, 930 bp, Artificial Sequence
  Description of Artificial Sequence: Synthetic coding sequence
atggccagcaagagctggctgaacttcctgaccttcctgtgcggcagcgccatcggcttcctgctgtgcagccagctgttcagcatcctgctgggcgagaaggtggacacccagcccaacgtgctgcacaacgacccccacgccagacacagcgacgacaacggccagaaccacctggagggccagatgaacttcaacgccgacagcagccagcacaaggacgagaacaccgacatcgccgagaacctgtaccagaaggtgagaatcctgtgctgggtgatgaccggcccccagaacctggagaagaaggccaagcacgtgaaggccacctgggcccagagatgcaacaaggtgctgttcatgagcagcgaggagaacaaggacttccccgccgtgggcctgaagaccaaggagggcagagaccagctgtactggaagaccatcaaggccttccagtacgtgcacgagcactacctggaggacgccgactggttcctgaaggccgacgacgacacctacgtgatcctggacaacctgagatggctgctgagcaagtacgaccccgaggagcccatctacttcggcagaagattcaagccctacgtgaagcagggctacatgagcggcggcgccggctacgtgctgagcaaggaggccctgaagagattcgtggacgccttcaagaccgacaagtgcacccacagcagcagcatcgaggacctggccctgggcagatgcatggagatcatgaacgtggaggccggcgacagcagagacaccatcggcaaggagaccttccaccccttcgtgcccgagcaccacctgatcaagggctacctgcccagaaccttctggtactggaactacaactactacccccccgtggaggtgagcctggagatcctgctgctgtgccagtacctggactag

SEQ ID NO: 77643 - DNA, 303 bp, Artificial Sequence
  Description of Artificial Sequence: Synthetic coding sequence
atggccagcaagagctggctgaacttcctgaccttcctgtgcggcagcgccatcggcttcctgctgtgcagccagctgttcagcatcctgctgggcgagaaggtggacacccagcccaacgtgctgcacaacgacccccacgccagacacagcgacgacaacggccagaaccacctggagggccagatgaacttcaacgccgacagcagccagcacaaggacgagaacaccgacatcgccgagaacctgtaccagaaggtgagaatcctgtgctgggtgatgaccggcccccagaacctgtag

SEQ ID NO: 77644 - DNA, 396 bp, Artificial Sequence
  Description of Artificial Sequence: Synthetic coding sequence
atggccagcaagagctggctgaacttcctgaccttcctgtgcggcagcgccatcggcttcctgctgtgcagccagctgttcagcatcctgctgggcgagaaggtggacacccagcccaacgtgctgcacaacgacccccacgccagacacagcgacgacaacggccagaaccacctggagggccagatgaacttcaacgccgacagcagccagcacaaggacgagaacaccgacatcgccgagaacctgtaccagaaggtgagaatcctgtgctgggtgatgaccggcccccagaacctggagaagaaggccaagcacgtgaaggccacctgggcccagagatgcaacaaggtgctgttcatgagcagcgaggagaacaaggacttccccgcctag

SEQ ID NO: 77645 - DNA, 1092 bp, Artificial Sequence
  Description of Artificial Sequence: Synthetic coding sequence
atggccagcaagagctggctgaacttcctgaccttcctgtgcggcagcgccatcggcttcctgctgtgcagccagctgttcagcatcctgctgggcgagaaggtggacacccagcccaacgtgctgcacaacgacccccacgccagacacagcgacgacaacggccagaaccacctggagggccagatgaacttcaacgccgacagcagccagcacaaggacgagaacaccgacatcgccgagaacctgtaccagaaggtgagaatcctgtgctgggtgatgaccggcccccagaacctggagaagaaggccaagcacgtgaaggccacctgggcccagagatgcaacaaggtgctgttcatgagcagcgaggagaacaaggacttccccgccgtgggcctgaagaccaaggagggcagagaccagctgtactggaagaccatcaaggccttccagtacgtgcacgagcactacctggaggacgccgactggttcctgaaggccgacgacgacacctacgtgatcctggacaacctgagatggctgctgagcaagtacgaccccgaggagcccatctacttcggcagaagattcaagccctacgtgaagcagggctacatgagcggcggcgccggctacgtgctgagcaaggaggccctgaagagattcgtggacgccttcaagaccgacaagtgcacccacagcagcagcatcgaggacctggccctgggcagatgcatggagatcatgaacgtggaggccggcgacagcagagacaccatcggcaaggagaccttccaccccttcgtgcccgagcaccacctgatcaagggctacctgcccagaaccttctggtactggaactacaactactacccccccgtggagggccccggctgctgcagcgacctggccgtgagcttccactacgtggacagcaccaccatgtacgagctggagtacctggtgtaccacctgagaccctacggctacctgtacagataccagcccaccctgcccgagagaatcctgaaggagatcagccaggccaacaagaacgaggacaccaaggtgaagctgggcaacccctag

SEQ ID NO: 77646 - DNA, 549 bp, Artificial Sequence
  Description of Artificial Sequence: Synthetic coding sequence
atgcccagagtggtgcccgaccagagaagcaagttcgagaacgaggagttcttcagaaagctgagcagagagtgcgagatcaagtacaccggcttcagagacagaccccacgaggagagacaggccagattccagaacgcctgcagagacggcagaagcgagatcgccttcgtggccaccggcaccaacctgagcctgcagttcttccccgccagctggcagggcgagcagagacagacccccagcagagagtacgtggacctggagagagaggccggcaaggtgtacctgaaggcccccatgatcctgaacggcgtgtgcgtgatctggaagggctggatcgacctgcagagactggacggcatgggctgcctggagttcgacgaggagagagcccagcaggaggacgccctggcccagcaggccttcgaggaggccagaagaagaaccagagagttcgaggacagagacagaagccacagagaggagatggaggtgagagtgagccagctgctggccgtgaccggcaagaagaccaccagaccctag

SEQ ID NO: 77647 - DNA, 564 bp, Artificial Sequence
  Description of Artificial Sequence: Synthetic coding sequence
atgcccagagtggtgcccgaccagagaagcaagttcgagaacgaggagttcttcagaaagctgagcagagagtgcgagatcaagtacaccggcttcagagacagaccccacgaggagagacaggccagattccagaacgcctgcagagacggcagaagcgagatcgccttcgtggccaccggcaccaacctgagcctgcagttcttccccgccagctggcagggcgagcagagacagacccccagcagagagtacgtggacctggagagagaggccggcaaggtgtacctgaaggcccccatgatcctgaacggcgtgtgcgtgatctggaagggctggatcgacctgcagagactggacggcatgggctgcctggagttcgacgaggagagagcccagcaggaggacgccctggcccagcaggccttcgaggaggccagaagaagaaccagagagttcgaggacagagacagaagccacagagaggagatggaggccagaagacagcaggaccccagccccggcagcaacctgggcggcggcgacgacctgaagctgagatag

SEQ ID NO: 77648 - DNA, 1788 bp, Artificial Sequence
  Description of Artificial Sequence: Synthetic coding sequence
atggtgggcgtgcccggcgccgccgccttccagctgggccccgagaagagagtgcccgccatgcccggcagccccgtggaggtgaagatccagagcagaagcagcccccccaccatgccccccctgccccccatcaaccccggcggccccagacccgtgagcttcacccccaccgccctgagcaacggcatcaaccacagcccccccaccctgaacggcgcccccagccccccccagagattcagcaacggccccgccagcagcaccagcagcgccctgaccaaccagcagctgcccgccacctgcggcgccagacagctgagcaagctgaagagattcctgaccaccctgcagcagttcggcaacgacatcagccccgagatcggcgagaaggtgagaaccctggtgctggccctggtgaacagcaccgtgaccatcgaggagttccactgcaagctgcaggaggccaccaacttccccctgagacccttcgtgatccccttcctgaaggccaacctgcccctgctgcagagagagctgctgcactgcgccagagccgccaagcagacccccagccagtacctggcccagcacgagcacctgctgctgaacaccagcatcgccagccccgccgacagcagcgagctgctgatggaggtgcacggcaacggcaagagacccagccccgagagaagagaggagaacagcttcgacagagacaccatcgcccccgagccccccgccaagagagtgtgcaccatcagccccgcccccagacacagccccgccctgaccgtgcccctgatgaaccccggcggccagttccaccccacccccccccccctgcagcactacaccctggaggacatcgccaccagccacctgtacagagagcccaacaagatgctggagcacagagaggtgagagacagacaccacagcctgggcctgaacggcggctaccaggacgagctggtggaccacagactgaccgagagagagtgggccgacgagtggaagcacctggaccacgccctgaactgcatcatggagatggtggagaagaccagaagaagcatggccgtgctgagaagatgccaggagagcgacagagaggagctgaactactggaagagaagatacaacgagaacaccgagctgagaaagaccggcaccgagctggtgagcagacagcacagccccggcagcgccgacagcctgagcaacgacagccagagagagttcaacagcagacccggcaccggctacgtgcccgtggagttctggaagaagaccgaggaggccgtgaacaaggtgaagatccaggccatgagcgaggtgcagaaggccgtggccgaggccgagcagaaggccttcgaggtgatcgccaccgagagagccagaatggagcagaccatcgccgacgtgaagagacaggccgccgaggacgccttcctggtgatcaacgagcaggaggagagcaccgagaactgctggaactgcggcagaaaggccagcgagacctgcagcggctgcaacatcgccagatactgcggcagcttctgccagcacaaggactgggagagacaccacagactgtgcggccagaacctgcacggccagagcccccacggccagggcagacccctgctgcccgtgggcagaggcagcagcgccagaagcgccgactgcagcgtgcccagccccgccctggacaagaccagcgccaccaccagcagaagcagcacccccgccagcgtgaccgccatcgacaccaacggcctgtag

SEQ ID NO: 77649 - DNA, 1815 bp, Artificial Sequence
  Description of Artificial Sequence: Synthetic coding sequence
atggccaaggagagcggcatcagcctgaaggagatccaggtgctggccagacagtggaaggtgggccccgagaagagagtgcccgccatgcccggcagccccgtggaggtgaagatccagagcagaagcagcccccccaccatgccccccctgccccccatcaaccccggcggccccagacccgtgagcttcacccccaccgccctgagcaacggcatcaaccacagcccccccaccctgaacggcgcccccagccccccccagagattcagcaacggccccgccagcagcaccagcagcgccctgaccaaccagcagctgcccgccacctgcggcgccagacagctgagcaagctgaagagattcctgaccaccctgcagcagttcggcaacgacatcagccccgagatcggcgagaaggtgagaaccctggtgctggccctggtgaacagcaccgtgaccatcgaggagttccactgcaagctgcaggaggccaccaacttccccctgagacccttcgtgatccccttcctgaaggccaacctgcccctgctgcagagagagctgctgcactgcgccagagccgccaagcagacccccagccagtacctggcccagcacgagcacctgctgctgaacaccagcatcgccagccccgccgacagcagcgagctgctgatggaggtgcacggcaacggcaagagacccagccccgagagaagagaggagaacagcttcgacagagacaccatcgcccccgagccccccgccaagagagtgtgcaccatcagccccgcccccagacacagccccgccctgaccgtgcccctgatgaaccccggcggccagttccaccccacccccccccccctgcagcactacaccctggaggacatcgccaccagccacctgtacagagagcccaacaagatgctggagcacagagaggtgagagacagacaccacagcctgggcctgaacggcggctaccaggacgagctggtggaccacagactgaccgagagagagtgggccgacgagtggaagcacctggaccacgccctgaactgcatcatggagatggtggagaagaccagaagaagcatggccgtgctgagaagatgccaggagagcgacagagaggagctgaactactggaagagaagatacaacgagaacaccgagctgagaaagaccggcaccgagctggtgagcagacagcacagccccggcagcgccgacagcctgagcaacgacagccagagagagttcaacagcagacccggcaccggctacgtgcccgtggagttctggaagaagaccgaggaggccgtgaacaaggtgaagatccaggccatgagcgaggtgcagaaggccgtggccgaggccgagcagaaggccttcgaggtgatcgccaccgagagagccagaatggagcagaccatcgccgacgtgaagagacaggccgccgaggacgccttcctggtgatcaacgagcaggaggagagcaccgagaactgctggaactgcggcagaaaggccagcgagacctgcagcggctgcaacatcgccagatactgcggcagcttctgccagcacaaggactgggagagacaccacagactgtgcggccagaacctgcacggccagagcccccacggccagggcagacccctgctgcccgtgggcagaggcagcagcgccagaagcgccgactgcagcgtgcccagccccgccctggacaagaccagcgccaccaccagcagaagcagcacccccgccagcgtgaccgccatcgacaccaacggcctgtag

SEQ ID NO: 77650 - DNA, 1815 bp, Artificial Sequence; identical to SEQ ID NO: 77649
  Description of Artificial Sequence: Synthetic coding sequence

SEQ ID NO: 77651 - DNA, 792 bp, Artificial Sequence
  Description of Artificial Sequence: Synthetic coding sequence
atgcccggcagccccgtggaggtgaagatccagagcagaagcagcccccccaccatgccccccctgccccccatcaaccccggcggccccagacccgtgagcttcacccccaccgccctgagcaacggcatcaaccacagcccccccaccctgaacggcgcccccagccccccccagagattcagcaacggccccgccagcagcaccagcagcgccctgaccaaccagcagctgcccgccacctgcggcgccagacagctgagcaagctgaagagattcctgaccaccctgcagcagttcggcaacgacatcagccccgagatcggcgagaaggtgagaaccctggtgctggccctggtgaacagcaccgtgaccatcgaggagttccactgcaagctgcaggaggccaccaacttccccctgagacccttcgtgatccccttcctgaaggccaacctgcccctgctgcagagagagctgctgcactgcgccagagccgccaagcagacccccagccagtacctggcccagcacgagcacctgctgctgaacaccagcatcgccagccccgccgacagcagcgagctgctgatggaggtgcacggcaacggcaagagacccagccccgagagctgcatcatccacctgaagagcatgggcgtggccagcagacacgagtacttcagcggcaccctgcagatgcccgcccaccccgtgagaaacagcaccctggagaacctgtgggtggactgcagcagaagcctgagaagcaccgtgctgcccttcccctag

SEQ ID NO: 77652 - DNA, 1728 bp, Artificial Sequence
  Description of Artificial Sequence: Synthetic coding sequence
atgcccggcagccccgtggaggtgaagatccagagcagaagcagcccccccaccatgccccccctgccccccatcaaccccggcggccccagacccgtgagcttcacccccaccgccctgagcaacggcatcaaccacagcccccccaccctgaacggcgcccccagccccccccagagattcagcaacggccccgccagcagcaccagcagcgccctgaccaaccagcagctgcccgccacctgcggcgccagacagctgagcaagctgaagagattcctgaccaccctgcagcagttcggcaacgacatcagccccgagatcggcgagaaggtgagaaccctggtgctggccctggtgaacagcaccgtgaccatcgaggagttccactgcaagctgcaggaggccaccaacttccccctgagacccttcgtgatccccttcctgaaggccaacctgcccctgctgcagagagagctgctgcactgcgccagagccgccaagcagacccccagccagtacctggcccagcacgagcacctgctgctgaacaccagcatcgccagccccgccgacagcagcgagctgctgatggaggtgcacggcaacggcaagagacccagccccgagagaagagaggagaacagcttcgacagagacaccatcgcccccgagccccccgccaagagagtgtgcaccatcagccccgcccccagacacagccccgccctgaccgtgcccctgatgaaccccggcggccagttccaccccacccccccccccctgcagcactacaccctggaggacatcgccaccagccacctgtacagagagcccaacaagatgctggagcacagagaggtgagagacagacaccacagcctgggcctgaacggcggctaccaggacgagctggtggaccacagactgaccgagagagagtgggccgacgagtggaagcacctggaccacgccctgaactgcatcatggagatggtggagaagaccagaagaagcatggccgtgctgagaagatgccaggagagcgacagagaggagctgaactactggaagagaagatacaacgagaacaccgagctgagaaagaccggcaccgagctggtgagcagacagcacagccccggcagcgccgacagcctgagcaacgacagccagagagagttcaacagcagacccggcaccggctacgtgcccgtggagttctggaagaagaccgaggaggccgtgaacaaggtgaagatccaggccatgagcgaggtgcagaaggccgtggccgaggccgagcagaaggccttcgaggtgatcgccaccgagagagccagaatggagcagaccatcgccgacgtgaagagacaggccgccgaggacgccttcctggtgatcaacgagcaggaggagagcaccgagaactgctggaactgcggcagaaaggccagcgagacctgcagcggctgcaacatcgccagatactgcggcagcttctgccagcacaaggactgggagagacaccacagactgtgcggccagaacctgcacggccagagcccccacggccagggcagacccctgctgcccgtgggcagaggcagcagcgccagaagcgccgactgcagcgtgcccagccccgccctggacaagaccagcgccaccaccagcagaagcagcacccccgccagcgtgaccgccatcgacaccaacggcctgtag

SEQ ID NO: 77653 - DNA, 1137 bp, Artificial Sequence
  Description of Artificial Sequence: Synthetic coding sequence
atggaggtgcacggcaacggcaagagacccagccccgagagaagagaggagaacagcttcgacagagacaccatcgcccccgagccccccgccaagagagtgtgcaccatcagccccgcccccagacacagccccgccctgaccgtgcccctgatgaaccccggcggccagttccaccccacccccccccccctgcagcactacaccctggaggacatcgccaccagccacctgtacagagagcccaacaagatgctggagcacagagaggtgagagacagacaccacagcctgggcctgaacggcggctaccaggacgagctggtggaccacagactgaccgagagagagtgggccgacgagtggaagcacctggaccacgccctgaactgcatcatggagatggtggagaagaccagaagaagcatggccgtgctgagaagatgccaggagagcgacagagaggagctgaactactggaagagaagatacaacgagaacaccgagctgagaaagaccggcaccgagctggtgagcagacagcacagccccggcagcgccgacagcctgagcaacgacagccagagagagttcaacagcagacccggcaccggctacgtgcccgtggagttctggaagaagaccgaggaggccgtgaacaaggtgaagatccaggccatgagcgaggtgcagaaggccgtggccgaggccgagcagaaggccttcgaggtgatcgccaccgagagagccagaatggagcagaccatcgccgacgtgaagagacaggccgccgaggacgccttcctggtgatcaacgagcaggaggagagcaccgagaactgctggaactgcggcagaaaggccagcgagacctgcagcggctgcaacatcgccagatactgcggcagcttctgccagcacaaggactgggagagacaccacagactgtgcggccagaacctgcacggccagagcccccacggccagggcagacccctgctgcccgtgggcagaggcagcagcgccagaagcgccgactgcagcgtgcccagccccgccctggacaagaccagcgccaccaccagcagaagcagcacccccgccagcgtgaccgccatcgacaccaacggcctgtag

SEQ ID NO: 77654 - DNA, 546 bp, Artificial Sequence
  Description of Artificial Sequence: Synthetic coding sequence
atggtgggcgtgcccggcgccgccgccttccagctgggccccgagaagagagtgcccgccatgcccggcagccccgtggaggtgaagatccagagcagaagcagcccccccaccatgccccccctgccccccatcaaccccggcggccccagacccgtgagcttcacccccaccgccctgagcaacggcatcaaccacagcccccccaccctgaacggcgcccccagccccccccagagattcagcaacggccccgccagcagcaccagcagcgccctgaccaaccagcagctgcccgccacctgcggcgccagacagctgagcaagctgaagagattcctgaccaccctgcagcagttcggcaacgacatcagccccgagatcggcgagaaggtgagaaccctggtgctggccctggtgaacagcaccgtgaccatcgaggagttccactgcaagctgcaggaggccaccaacttccccctgagacccttcgtgatccccttcctgaaggccaacctgcccctgctgcagagagagctgctgtag

SEQ ID NO: 77655 - DNA, 243 bp, Artificial Sequence
  Description of Artificial Sequence: Synthetic coding sequence
atggccaaggagagcggcatcagcctgaaggagatccaggtgctggccagacagtggaaggtgggccccgagaagagagtgcccgccatgcccggcagccccgtggaggtgaagatccagagcagaagcagcccccccaccatgccccccctgccccccatcaaccccggcggccccagacccgtgagcttcacccccaccgccctgagcaacggcatcaaccacagcccccccaccctgtag

SEQ ID NO: 77656 - DNA, 459 bp, Artificial Sequence
  Description of Artificial Sequence: Synthetic coding sequence
atgagcgaggtgcagaaggccgtggccgaggccgagcagaaggccttcgaggtgatcgccaccgagagagccagaatggagcagaccatcgccgacgtgaagagacaggccgccgaggacgccttcctggtgatcaacgagcaggaggagagcaccgagaactgctggaactgcggcagaaaggccagcgagacctgcagcggctgcaacatcgccagatactgcggcagcttctgccagcacaaggactgggagagacaccacagactgtgcggccagaacctgcacggccagagcccccacggccagggcagacccctgctgcccgtgggcagaggcagcagcgccagaagcgccgactgcagcgtgcccagccccgccctggacaagaccagcgccaccaccagcagaagcagcacccccgccagcgtgaccgccatcgacaccaacggcctgtag

SEQ ID NO: 77657 - DNA, 1962 bp, Artificial Sequence
  Description of Artificial Sequence: Synthetic coding sequence
atgcccgccagcagactgagagacagagccgccagcagcgccagcggcagcacctgcggcagcatgagccagacccaccccgtgctggagagcggcctgctggccagcgccggctgcagcgcccccagaggccccagaaagggcggccccgcccccgtggacagaaaggccaaggccagcgccatgcccgacagccccgccgaggtgaagacccagcccagaagcaccccccccagcatgcccccccccccccccgccgccagccagggcgccaccagaccccccagcttcaccccccacacccacagagaggacggccccgccaccctgccccacggcagattccacggctgcctgaagtggagcatggtgtgcctgctgatgaacggcagcagccacagccccaccgccatcaacggcgccccctgcacccccaacggcttcagcaacggccccgccaccagcagcaccgccagcctgagcacccagcacctgccccccgcctgcggcgccagacagctgagcaagctgaagagattcctgaccaccctgcagcagttcggcagcgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagacccccgcccagtacctggcccagcacgagcagctgctgctggacgccagcgccagcagccccatcgacagcagcgagctgctgctggaggtgaacgagaacggcaagagaagaacccccgacagaaccaaggagaacggcagcgacagagaccccctgcaccccgagcacctgagcaagagaccctgcaccctgaaccccgcccagagatacagccccagcaacggccccccccagcccaccccccccccccactacagactggaggacatcgccatggcccaccacttcagagacgcctacagacaccccgaccccagagagctgagagagagacacagacccctggtggtgcccggcagcagacaggaggaggtgatcgaccacaagctgaccgagagagagtgggccgaggagtggaagcacctgaacaacctgctgaactgcatcatggacatggtggagaagaccagaagaagcctgaccgtgctgagaagatgccaggaggccgacagagaggagctgaaccactgggccagaagatacagcgacgccgaggacaccaagaagggccccgcccccgccgccgccagacccagaagcagcagcgccggccccgagggcccccagctggacgtgcccagagagttcctgcccagaaccctgaccggctacgtgcccgaggacatctggagaaaggccgaggaggccgtgaacgaggtgaagagacaggccatgagcgagctgcagaaggccgtgagcgacgccgagagaaaggcccacgagctgatcaccaccgagagagccaagatggagagagccctggccgaggccaagagacaggccagcgaggacgccctgaccgtgatcaaccagcaggaggacagcagcgagagctgctggaactgcggcagaaaggccagcgagacctgcagcggctgcaacgccgccagatactgcggcagcttctgccagcacagagactgggagaagcaccaccacgtgtgcggccagagcctgcagggccccaccgccgtggtggccgaccccgtgcccggcccccccgaggccgcccacagcctgggccccagcctgcccgtgggcgccgccagccccagcgaggccggcagcgccggccccagcagacccggcagccccagcccccccggccccctggacaccgtgcccagatag

SEQ ID NO: 77658 - DNA, 1704 bp, Artificial Sequence
  Description of Artificial Sequence: Synthetic coding sequence
atgcccgacagccccgccgaggtgaagacccagcccagaagcaccccccccagcatgcccccccccccccccgccgccagccagggcgccaccagaccccccagcttcaccccccacaccctgatgaacggcagcagccacagccccaccgccatcaacggcgccccctgcacccccaacggcttcagcaacggccccgccaccagcagcaccgccagcctgagcacccagcacctgccccccgcctgcggcgccagacagctgagcaagctgaagagattcctgaccaccctgcagcagttcggcagcgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagacccccgcccagtacctggcccagcacgagcagctgctgctggacgccagcgccagcagccccatcgacagcagcgagctgctgctggaggtgaacgagaacggcaagagaagaacccccgacagaaccaaggagaacggcagcgacagagaccccctgcaccccgagcacctgagcaagagaccctgcaccctgaaccccgcccagagatacagccccagcaacggccccccccagcccaccccccccccccactacagactggaggacatcgccatggcccaccacttcagagacgcctacagacaccccgaccccagagagctgagagagagacacagacccctggtggtgcccggcagcagacaggaggaggtgatcgaccacaagctgaccgagagagagtgggccgaggagtggaagcacctgaacaacctgctgaactgcatcatggacatggtggagaagaccagaagaagcctgaccgtgctgagaagatgccaggaggccgacagagaggagctgaaccactgggccagaagatacagcgacgccgaggacaccaagaagggccccgcccccgccgccgccagacccagaagcagcagcgccggccccgagggcccccagctggacgtgcccagagagttcctgcccagaaccctgaccggctacgtgcccgaggacatctggagaaaggccgaggaggccgtgaacgaggtgaagagacaggccatgagcgagctgcagaaggccgtgagcgacgccgagagaaaggcccacgagctgatcaccaccgagagagccaagatggagagagccctggccgaggccaagagacaggccagcgaggacgccctgaccgtgatcaaccagcaggaggacagcagcgagagctgctggaactgcggcagaaaggccagcgagacctgcagcggctgcaacgccgccagatactgcggcagcttctgccagcacagagactgggagaagcaccaccacgtgtgcggccagagcctgcagggccccaccgccgtggtggccgaccccgtgcccggcccccccgaggccgcccacagcctgggccccagcctgcccgtgggcgccgccagccccagcgaggccggcagcgccggccccagcagacccggcagccccagcccccccggccccctggacaccgtgcccagatag

SEQ ID NO: 77659 - DNA, 1704 bp, Artificial Sequence; identical to SEQ ID NO: 77658
  Description of Artificial Sequence: Synthetic coding sequence

SEQ ID NO: 77660 - DNA, 1848 bp, Artificial Sequence
  Description of Artificial Sequence: Synthetic coding sequence
atgcccgccagcagactgagagacagagccgccagcagcgccagcggcagcacctgcggcagcatgagccagacccaccccgtgctggagagcggcctgctggccagcgccggctgcagcgcccccagaggccccagaaagggcggccccgcccccgtggacagaaaggccaaggccagcgccatgcccgacagccccgccgaggtgaagacccagcccagaagcaccccccccagcatgcccccccccccccccgccgccagccagggcgccaccagaccccccagcttcaccccccacaccctgatgaacggcagcagccacagccccaccgccatcaacggcgccccctgcacccccaacggcttcagcaacggccccgccaccagcagcaccgccagcctgagcacccagcacctgccccccgcctgcggcgccagacagctgagcaagctgaagagattcctgaccaccctgcagcagttcggcagcgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagacccccgcccagtacctggcccagcacgagcagctgctgctggacgccagcgccagcagccccatcgacagcagcgagctgctgctggaggtgaacgagaacggcaagagaagaacccccgacagaaccaaggagaacggcagcgacagagaccccctgcaccccgagagatacagccccagcaacggccccccccagcccaccccccccccccactacagactggaggacatcgccatggcccaccacttcagagacgcctacagacaccccgaccccagagagctgagagagagacacagacccctggtggtgcccggcagcagacaggaggaggtgatcgaccacaagctgaccgagagagagtgggccgaggagtggaagcacctgaacaacctgctgaactgcatcatggacatggtggagaagaccagaagaagcctgaccgtgctgagaagatgccaggaggccgacagagaggagctgaaccactgggccagaagatacagcgacgccgaggacaccaagaagggccccgcccccgccgccgccagacccagaagcagcagcgccggccccgagggcccccagctggacgtgcccagagagttcctgcccagaaccctgaccggctacgtgcccgaggacatctggagaaaggccgaggaggccgtgaacgaggtgaagagacaggccatgagcgagctgcagaaggccgtgagcgacgccgagagaaaggcccacgagctgatcaccaccgagagagccaagatggagagagccctggccgaggccaagagacaggccagcgaggacgccctgaccgtgatcaaccagcaggaggacagcagcgagagctgctggaactgcggcagaaaggccagcgagacctgcagcggctgcaacgccgccagatactgcggcagcttctgccagcacagagactgggagaagcaccaccacgtgtgcggccagagcctgcagggccccaccgccgtggtggccgaccccgtgcccggcccccccgaggccgcccacagcctgggccccagcctgcccgtgggcgccgccagccccagcgaggccggcagcgccggccccagcagacccggcagccccagcccccccggccccctggacaccgtgcccagatag

SEQ ID NO: 77661 - DNA, 1734 bp, Artificial Sequence
  Description of Artificial Sequence: Synthetic coding sequence
atgcccgccagcagactgagagacagagccgccagcagcgccagcggcagcacctgcggcagcatgagccagacccaccccgtgctggagagcggcctgctggccagcgccggctgcagcgcccccagaggccccagaaagggcggccccgtgatgaacggcagcagccacagccccaccgccatcaacggcgccccctgcacccccaacggcttcagcaacggccccgccaccagcagcaccgccagcctgagcacccagcacctgccccccgcctgcggcgccagacagctgagcaagctgaagagattcctgaccaccctgcagcagttcggcagcgacatcagccccgagatcggcgagagagtgagaaccctggtgctgggcctggtgaacagcaccctgaccatcgaggagttccacagcaagctgcaggaggccaccaacttccccctgagacccttcgtgatccccttcctgaaggccaacctgcccctgctgcagagagagctgctgcactgcgccagactggccaagcagacccccgcccagtacctggcccagcacgagcagctgctgctggacgccagcgccagcagccccatcgacagcagcgagctgctgctggaggtgaacgagaacggcaagagaagaacccccgacagaaccaaggagaacggcagcgacagagaccccctgcaccccgagcacctgagcaagagaccctgcaccctgaaccccgcccagagatacagccccagcaacggccccccccagcccaccccccccccccactacagactggaggacatcgccatggcccaccacttcagagacgcctacagacaccccgaccccagagagctgagagagagacacagacccctggtggtgcccggcagcagacaggaggaggtgatcgaccacaagctgaccgagagagagtgggccgaggagtggaagcacctgaacaacctgctgaactgcatcatggacatggtggagaagaccagaagaagcctgaccgtgctgagaagatgccaggaggccgacagagaggagctgaaccactgggccagaagatacagcgacgccgaggacaccaagaagggccccgcccccgccgccgccagacccagaagcagcagcgccggccccgagggcccccagctggacgtgcccagagagttcctgcccagaaccctgaccggctacgtgcccgaggacatctggagaaaggccgaggaggccgtgaacgaggtgaagagacaggccatgagcgagctgcagaaggccgtgagcgacgccgagagaaaggcccacgagctgatcaccaccgagagagccaagatggagagagccctggccgaggccaagagacaggccagcgaggacgccctgaccgtgatcaaccagcaggaggacagcagcgagagctgctggaactgcggcagaaaggccagcgagacctgcagcggctgcaacgccgccagatactgcggcagcttctgccagcacagagactgggagaagcaccaccacgtgtgcggccagagcctgcagggccccaccgccgtggtggccgaccccgtgcccggcccccccgaggccgcccacagcctgggccccagcctgcccgtgggcgccgccagccccagcgaggccggcagcgccggccccagcagacccggcagccccagcccccccggccccctggacaccgtgcccagatag

SEQ ID NO: 77662 - DNA, 558 bp, Artificial Sequence
  Description of Artificial Sequence: Synthetic coding sequence
atggccgcccagaaggaccagcagaaggacgccgaggccgagggcctgagcggcaccaccctgctgcccaagctgatccccagcggcgccggcagagagtggctggagagaagaagagccaccatcagaccctggagcaccttcgtggaccagcagagattcagcagacccagaaacctgggcgagctgtgccagagactggtgagaaacgtggagtactaccagagcaactacgtgttcgtgttcctgggcctgatcctgtactgcgtggtgaccagccccatgctgctggtggccctggccgtgttcttcggcgcctgctacatcctgtacctgagaaccctggagagcaagctggtgctgttcggcagagaggtgagccccgcccaccagtacgccctggccggcggcatcagcttccccttcttctggctggccggcgccggcagcgccgtgttctgggtgctgggcgccaccctggtggtgatcggcagccacgccgccttccaccagatcgaggccgtggacggcgaggagctgcagatggagcccgtgtag

SEQ ID NO: 77663 - DNA, 3147 bp, Artificial Sequence
  Description of Artificial Sequence: Synthetic coding sequence
atgaacagattcagagtgagcaagttcagacacaccgaggccagaccccccagaagagagagctggatcagcgacatcagagccggcaccgcccccagctgcagaaaccacatcaagagcagctgcagcctgatcgccttcaacagcgacagacccggcgtgctgggcatcgtgcccctgcagggccagggcgaggacaagagaagagtggcccacctgggctgccacagcgacctggtgaccgacctggacttcagccccttcgacgacttcctgctggccaccggcagcgccgacagaaccgtgaagctgtggagactgcccggccccggccaggccctgcccagcgcccccggcgtggtgctgggccccgaggacctgcccgtggaggtgctgcagttccaccccaccagcgacggcatcctggtgagcgccgccggcaccaccgtgaaggtgtgggacgccgccaagcagcagcccctgaccgagctggccgcccacggcgacctggtgcagagcgccgtgtggagcagagacggcgccctggtgggcaccgcctgcaaggacaagcagctgagaatcttcgaccccagaaccaagcccagagccagccagagcacccaggcccacgagaacagcagagacagcagactggcctggatgggcacctgggagcacctggtgagcaccggcttcaaccagatgagagagagagaggtgaagctgtgggacaccagattcttcagcagcgccctggccagcctgaccctggacaccagcctgggctgcctggtgcccctgctggaccccgacagcggcctgctggtgctggccggcaagggcgagagacagctgtactgctacgaggtggtgccccagcagcccgccctgagccccgtgacccagtgcgtgctggagagcgtgctgagaggcgccgccctggtgcccagacaggccctggccgtgatgagctgcgaggtgctgagagtgctgcagctgagcgacaccgccatcgtgcccatcggctaccacgtgcccagaaaggccgtggagttccacgaggacctgttccccgacaccgccggctgcgtgcccgccaccgacccccacagctggtgggccggcgacaaccagcaggtgcagaaggtgagcctgaaccccgcctgcagaccccaccccagcttcaccagctgcctggtgccccccgccgagcccctgcccgacaccgcccagcccgccgtgatggagacccccgtgggcgacgccgacgccagcgagggcttcagcagcccccccagcagcctgaccagccccagcacccccagcagcctgggccccagcctgagcagcaccagcggcatcggcaccagccccagcctgagaagcctgcagagcctgctgggccccagcagcaagttcagacacgcccagggcaccgtgctgcacagagacagccacatcaccaacctgaagggcctgaacctgaccacccccggcgagagcgacggcttctgcgccaacaagctgagagtggccgtgcccctgctgagcagcggcggccaggtggccgtgctggagctgagaaagcccggcagactgcccgacaccgccctgcccaccctgcagaacggcgccgccgtgaccgacctggcctgggaccccttcgacccccacagactggccgtggccggcgaggacgccagaatcagactgtggagagtgcccgccgagggcctggaggaggtgctgaccacccccgagaccgtgctgaccggccacaccgagaagatctgcagcctgagattccaccccctggccgccaacgtgctggccagcagcagctacgacctgaccgtgagaatctgggacctgcaggccggcgccgacagactgaagctgcagggccaccaggaccagatcttcagcctggcctggagccccgacggccagcagctggccaccgtgtgcaaggacggcagagtgagagtgtacagacccagaagcggccccgagcccctgcaggagggccccggccccaagggcggcagaggcgccagaatcgtgtgggtgtgcgacggcagatgcctgctggtgagcggcttcgacagccagagcgagagacagctgctgctgtacgaggccgaggccctggccggcggccccctggccgtgctgggcctggacgtggcccccagcaccctgctgcccagctacgaccccgacaccggcctggtgctgctgaccggcaagggcgacaccagagtgttcctgtacgagctgctgcccgagagccccttcttcctggagtgcaacagcttcaccagccccgacccccacaagggcctggtgctgctgcccaagaccgagtgcgacgtgagagaggtggagctgatgagatgcctgagactgagacagagcagcctggagcccgtggccttcagactgcccagagtgagaaaggagttcttccaggacgacgtgttccccgacaccgccgtgatctgggagcccgtgctgagcgccgaggcctggctgcagggcgccaacggccagccctggctgctgagcctgcagccccccgacatgagccccgtgagccaggcccccagagaggcccccgccagaagagcccccagcagcgcccagtacctggaggagaagagcgaccagcagaagaaggaggagctgctgaacgccatggtggccaagctgggcaacagagaggaccccctgccccaggacagcttcgagggcgtggacgaggacgagtgggccaagtacctggcccagatcatcgtgatgggcgtgcaggtggtgggcagagccttcgccagagccctgagacaggagttcgccgccagcagagccgccgccgacgccagaggcagagccggccacagaagcgccgccgccagcaacctgagcggcctgagcctgcaggaggcccagcagatcctgaacgtgagcaagctgagccccgaggaggtgcagaagaactacgagcacctgttcaaggtgaacgacaagagcgtgggcggcagcttctacctgcagagcaaggtggtgagagccaaggagagactggacgaggagctgaagatccaggcccaggaggacagagagaagggccagatgccccacacctag

SEQ ID NO: 77664 - DNA, 2778 bp, Artificial Sequence
  Description of Artificial Sequence: Synthetic coding sequence
atgaacagattcagagtgagcaagttcagacacaccgaggccagaccccccagaagagagagctggatcagcgacatcagagccggcaccgcccccagctgcagaaaccacatcaagagcagctgcagcctgatcgccttcaacagcgacagacccggcgtgctgggcatcgtgcccctgcagggccagggcgaggacaagagaagagtggcccacctgggctgccacagcgacctggtgaccgacctggacttcagccccttcgacgacttcctgctggccaccggcagcgccgacagaaccgtgaagctgtggagactgcccggccccggccaggccctgcccagcgcccccggcgtggtgctgggccccgaggacctgcccgtggaggtgctgcagttccaccccaccagcgacggcatcctggtgagcgccgccggcaccaccgtgaaggtgtgggacgccgccaagcagcagcccctgaccgagctggccgcccacggcgacctggtgcagagcgccgtgtggagcagagacggcgccctggtgggcaccgcctgcaaggacaagcagctgagaatcttcgaccccagaaccaagcccagagccagccagagcacccaggcccacgagaacagcagagacagcagactggcctggatgggcacctgggagcacctggtgagcaccggcttcaaccagatgagagagagagaggtgaagctgtgggacaccagattcttcagcagcgccctggccagcctgaccctggacaccagcctgggctgcctggtgcccctgctggaccccgacagcggcctgctggtgctggccggcaagggcgagagacagctgtactgctacgaggtggtgccccagcagcccgccctgagccccgtgacccagtgcgtgctggagagcgtgctgagaggcgccgccctggtgcccagacaggccctggccgtgatgagctgcgaggtgctgagagtgctgcagctgagcgacaccgccatcgtgcccatcggctaccacgtgcccagaaaggccgtggagttccacgaggacctgttccccgacaccgccggctgcgtgcccgccaccgacccccacagctggtgggccggcgacaaccagcaggtgcagaaggtgagcctgaaccccgcctgcagaccccaccccagcttcaccagctgcctggtgccccccgccgagcccctgcccgacaccgcccagcccgccgtgatggagacccccgtgggcgacgccgacgccagcgagggcttcagcagcccccccagcagcctgaccagccccagcacccccagcagcctgggccccagcctgagcagcaccagcggcatcggcaccagccccagcctgagaagcctgcagagcctgctgggccccagcagcaagttcagacacgcccagggcaccgtgctgcacagagacagccacatcaccaacctgaagggcctgaacctgaccacccccggcgagagcgacggcttctgcgccaacaagctgagagtggccgtgcccctgctgagcagcggcggccaggtggccgtgctggagctgagaaagcccggcagactgcccgacaccgccctgcccaccctgcagaacggcgccgccgtgaccgacctggcctgggaccccttcgacccccacagactggccgtggccggcgaggacgccagaatcagactgtggagagtgcccgccgagggcctggaggaggtgctgaccacccccgagaccgtgctgaccggccacaccgagaagatctgcagcctgagattccaccccctggccgccaacgtgctggccagcagcagctacgacctgaccgtgagaatctgggacctgcaggccggcgccgacagactgaagctgcagggccaccaggaccagatcttcagcctggcctggagccccgacggccagcagctggccaccgtgtgcaaggacggcagagtgagagtgtacagacccagaagcggccccgagcccctgcaggagggccccggccccaagggcggcagaggcgccagaatcgtgtgggtgtgcgacggcagatgcctgctggtgagcggcttcgacagccagagcgagagacagctgctgctgtacgaggccgaggccctggccggcggccccctggccgtgctgggcctggacgtggcccccagcaccctgctgcccagctacgaccccgacaccggcctggtgctgctgaccggcaagggcgacaccagagtgttcctgtacgagctgctgcccgagagccccttcttcctggagtgcaacagcttcaccagccccgacccccacaagggcctggtgctgctgcccaagaccgagtgcgacgtgagagaggtggagctgatgagatgcctgagactgagacagagcagcctggagcccgtggccttcagactgcccagagtgagaaaggagttcttccaggacgacgtgttccccgacaccgccgtgatctgggagcccgtgctgagcgccgaggcctggctgcagggcgccaacggccagccctggctgctgagcctgcagccccccgacatgagccccgtgagccaggcccccagagaggcccccgccagaagagcccccagcagcgcccagtacctggaggagaagagcgaccagcagaagaaggaggagctgctgaacgccatggtggccaagctgggcaacagagaggaccccctgccccaggacagcttcgagggcgtggacgaggacgagtgggactag

SEQ ID NO: 77665 - DNA, 1104 bp, Artificial Sequence
  Description of Artificial Sequence: Synthetic coding sequence
atgaacagattcagagtgagcaagttcagacacaccgaggccagaccccccagaagagaggacaagcagctgagaatcttcgaccccagaaccaagcccagagccagccagagcacccaggcccacgagaacagcagagacagcagactggcctggatgggcacctgggagcacctggtgagcaccggcttcaaccagatgagagagagagaggtgaagctgtgggacaccagattcttcagcagcgccctggccagcctgaccctggacaccagcctgggctgcctggtgcccctgctggaccccgacagcggcctgctggtgctggccggcaagggcgagagacagctgtactgctacgaggtggtgccccagcagcccgccctgagccccgtgacccagtgcgtgctggagagcgtgctgagaggcgccgccctggtgcccagacaggccctggccgtgatgagctgcgaggtgctgagagtgctgcagctgagcgacaccgccatcgtgcccatcggctaccacgtgcccagaaaggccgtggagttccacgaggacctgttccccgacaccgccggctgcgtgcccgccaccgacccccacagctggtgggccggcgacaaccagcaggtgcagaaggtgagcctgaaccccgcctgcagaccccaccccagcttcaccagctgcctggtgccccccgccgagcccctgcccgacaccgcccagcccgccgtgatggagacccccgtgggcgacgccgacgccagcgagggcttcagcagcccccccagcagcctgaccagccccagcacccccagcagcctgggccccagcctgagcagcaccagcggcatcggcaccagccccagcctgagaagcctgcagagcctgctgggccccagcagcaagttcagacacgcccagggcaccgtgctgcacagagacagccacatcaccaacctgaagggcctgaacctgaccacccccggcgagagcgacggcttctgcgccaacaagctgagagtggccgtgcccctgctgagcagcggcggccaggtggccgtgctggagatgagagagaagagacacagagaggtgtag

SEQ ID NO: 77666 - DNA, 2523 bp, Artificial Sequence
  Description of Artificial Sequence: Synthetic coding sequence
atgaacagattcagagtgagcaagttcagacacaccgaggccagaccccccagaagagagagctggatcagcgacatcagagccggcaccgcccccagctgcagaaaccacatcaagagcagctgcagcctgatcgccttcaacagcgacagacccggcgtgctgggcatcgtgcccctgcagggccagggcgaggacaagagaagagtggcccacctgggctgccacagcgagctggccgcccacggcgacctggtgcagagcgccgtgtggagcagagacggcgccctggtgggcaccgcctgcaaggacaagcagctgagaatcttcgaccccagaaccaagcccagagccagccagagcacccaggcccacgagaacagcagagacagcagactggcctggatgggcacctgggagcacctggtgagcaccggcttcaaccagatgagagagagagaggtgaagctgtgggacaccagattcttcagcagcgccctggccagcctgaccctggacaccagcctgggctgcctggtgcccctgctggaccccgacagcggcctgctggtgctggccggcaagggcgagagacagctgtactgctacgaggtggtgccccagcagcccgccctgagccccgtgacccagtgcgtgctggagagcgtgctgagaggcgccgccctggtgcccagacaggccctggccgtgatgagctgcgaggtgctgagagtgctgcagctgagcgacaccgccatcgtgcccatcggctaccacgtgcccagaaaggccgtggagttccacgaggacctgttccccgacaccgccggctgcgtgcccgccaccgacccccacagctggtgggccggcgacaaccagcaggtgcagaaggtgagcctgaaccccgcctgcagaccccaccccagcttcaccagctgcctggtgccccccgccgagcccctgcccgacaccgcccagcccgccgtgatggagacccccgtgggcgacgccgacgccagcgagggcttcagcagcccccccagcagcctgaccagccccagcacccccagcagcctgggccccagcctgagcagcaccagcggcatcggcaccagccccagcctgagaagcctgcagagcctgctgggccccagcagcaagttcagacacgcccagggcaccgtgctgcacagagacagccacatcaccaacctgaagggcctgaacctgaccacccccggcgagagcgacggcttctgcgccaacaagctgagagtggccgtgcccctgctgagcagcggcggccaggtggccgtgctggagctgagaaagcccggcagactgcccgacaccgccctgcccaccctgcagaacggcgccgccgtgaccgacctggcctgggaccccttcgacccccacagactggccgtggccggcgaggacgccagaatcagactgtggagagtgcccgccgagggcctggaggaggtgctgaccacccccgagaccgtgctgaccggccacaccgagaagatctgcagcctgagattccaccccctggccgccaacgtgctggccagcagcagctacgacctgaccgtgagaatctgggacctgcaggccggcgccgacagactgaagctgcagggccaccaggaccagatcttcagcctggcctggagccccgacggccagcagctggccaccgtgtgcaaggacggcagagtgagagtgtacagacccagaagcggccccgagcccctgcaggagggccccggccccaagggcggcagaggcgccagaatcgtgtgggtgtgcgacggcagatgcctgctggtgagcggcttcgacagccagagcgagagacagctgctgctgtacgaggccgaggccctggccggcggccccctggccgtgctgggcctggacgtggcccccagcaccctgctgcccagctacgaccccgacaccggcctggtgctgctgaccggcaagggcgacaccagagtgttcctgtacgagctgctgcccgagagccccttcttcctggagtgcaacagcttcaccagccccgacccccacaagggcctggtgctgctgcccaagaccgagtgcgacgtgagagaggtggagctgatgagatgcctgagactgagacagagcagcctggagcccgtggccttcagactgcccagagtgagaaaggagttcttccaggacgacgtgttccccgacaccgccgtgatctgggagcccgtgctgagcgccgaggcctggctgcagggcgccaacggccagccctggctgctgagcctgcagccccccgacatgagccccgtgagccaggcccccagagaggcccccgccagaagagcccccagcagcgcccagtacctggaggagaagagcgaccagcagaagaaggaggagctgctgaacgccatggtggccaagctgggcaacagagaggaccccctgccccaggacagcttcgagggcgtggacgaggacgagtgggactag

SEQ ID NO: 77667 - DNA, 2118 bp, Artificial Sequence
  Description of Artificial Sequence: Synthetic coding sequence
atgggcacctgggagcacctggtgagcaccggcttcaaccagatgagagagagagaggtgaagctgtgggacaccagattcttcagcagcgccctggccagcctgaccctggacaccagcctgggctgcctggtgcccctgctggaccccgacagcggcctgctggtgctggccggcaagggcgagagacagctgtactgctacgaggtggtgccccagcagcccgccctgagccccgtgacccagtgcgtgctggagagcgtgctgagaggcgccgccctggtgcccagacaggccctggccgtgatgagctgcgaggtgctgagagtgctgcagctgagcgacaccgccatcgtgcccatcggctaccacgtgcccagaaaggccgtggagttccacgaggacctgttccccgacaccgccggctgcgtgcccgccaccgacccccacagctggtgggccggcgacaaccagcaggtgcagaaggtgagcctgaaccccgcctgcagaccccaccccagcttcaccagctgcctggtgccccccgccgagcccctgcccgacaccgcccagcccgccgtgatggagacccccgtgggcgacgccgacgccagcgagggcttcagcagcccccccagcagcctgaccagccccagcacccccagcagcctgggccccagcctgagcagcaccagcggcatcggcaccagccccagcctgagaagcctgcagagcctgctgggccccagcagcaagttcagacacgcccagggcaccgtgctgcacagagacagccacatcaccaacctgaagggcctgaacctgaccacccccggcgagagcgacggcttctgcgccaacaagctgagagtggccgtgcccctgctgagcagcggcggccaggtggccgtgctggagctgagaaagcccggcagactgcccgacaccgccctgcccaccctgcagaacggcgccgccgtgaccgacctggcctgggaccccttcgacccccacagactggccgtggccggcgaggacgccagaatcagactgtggagagtgcccgccgagggcctggaggaggtgctgaccacccccgagaccgtgctgaccggccacaccgagaagatctgcagcctgagattccaccccctggccgccaacgtgctggccagcagcagctacgacctgaccgtgagaatctgggacctgcaggccggcgccgacagactgaagctgcagggccaccaggaccagatcttcagcctggcctggagccccgacggccagcagctggccaccgtgtgcaaggacggcagagtgagagtgtacagacccagaagcggccccgagcccctgcaggagggccccggccccaagggcggcagaggcgccagaatcgtgtgggtgtgcgacggcagatgcctgctggtgagcggcttcgacagccagagcgagagacagctgctgctgtacgaggccgaggccctggccggcggccccctggccgtgctgggcctggacgtggcccccagcaccctgctgcccagctacgaccccgacaccggcctggtgctgctgaccggcaagggcgacaccagagtgttcctgtacgagctgctgcccgagagccccttcttcctggagtgcaacagcttcaccagccccgacccccacaagggcctggtgctgctgcccaagaccgagtgcgacgtgagagaggtggagctgatgagatgcctgagactgagacagagcagcctggagcccgtggccttcagactgcccagagtgagaaaggagttcttccaggacgacgtgttccccgacaccgccgtgatctgggagcccgtgctgagcgccgaggcctggctgcagggcgccaacggccagccctggctgctgagcctgcagccccccgacatgagccccgtgagccaggcccccagagaggcccccgccagaagagcccccagcagcgcccagtacctggaggagaagagcgaccagcagaagaaggaggagctgctgaacgccatggtggccaagctgggcaacagagaggaccccctgccccaggacagcttcgagggcgtggacgaggacgagtgggactag

SEQ ID NO: 77668 - DNA, 1386 bp, Artificial Sequence; identical to SEQ ID NO: 71717
  Description of Artificial Sequence: Synthetic coding sequence

SEQ ID NO: 77669 - DNA, 1443 bp, Artificial Sequence
  Description of Artificial Sequence: Synthetic coding sequence
atgaccgtgaccaagatgagctggagaccccagtacagaagcagcaagttcagaaacgtgtacggcaaggtggccaacagagagcactgcttcgacggcatccccatcaccaagaacgtgcacgacaaccacttctgcgccgtgaacaccagattcctggccatcgtgaccgagagcgccggcggcggcagcttcctggtgatccccctggagcagaccggcagaatcgagcccaactaccccaaggtgtgcggccaccagggcaacgtgctggacatcaagtggaaccccttcatcgacaacatcatcgccagctgcagcgaggacaccagcgtgagaatctgggagatccccgagggcggcctgaagagaaacatgaccgaggccctgctggagctgcacggccacagcagaagagtgggcctggtggagtggcaccccaccaccaacaacatcctgttcagcgccggctacgactacaaggtgctgatctggaacctggacgtgggcgagcccgtgaagatgatcgactgccacaccgacgtgatcctgtgcatgagcttcaacaccgacggcagcctgctgaccaccacctgcaaggacaagaagctgagagtgatcgagcccagaagcggcagagtgctgcaggaggccaactgcaagaaccacagagtgaacagagtggtgttcctgggcaacatgaagagactgctgaccaccggcgtgagcagatggaacaccagacagatcgccctgtgggaccaggaggacctgagcatgcccctgatcgaggaggagatcgacggcctgagcggcctgctgttccccttctacgacgccgacacccacatgctgtacctggccggcaagggcgacggcaacatcagatactacgagatcagcaccgagaagccctacctgagctacctgatggagttcagaagccccgccccccagaagggcctgggcgtgatgcccaagcacggcctggacgtgagcgcctgcgaggtgttcagattctacaagctggtgaccctgaagggcctgatcgagcccatcagcatgatcgtgcccagaagaagcgacagctaccaggaggacatctaccccatgacccccggcaccgagcccgccctgacccccgacgagtggctgggcggcatcaacagagaccccgtgctgatgagcctgaaggagggctacaagaagagcagcaagatggtgttcaaggcccccatcaaggagaagaagagcgtggtggtgaacggcatcgacctgctggagaacgtgccccccagaaccgagaacgagctgctgagaatgttcttcagacagcaggacgagatcagaagactgaaggaggagctggcccagaaggacatcagaatcagacagctgcagctggagctgaagaacctgagaaacagccccaagaactgctag

SEQ ID NO: 77670 - DNA, 1269 bp, Artificial Sequence
  Description of Artificial Sequence: Synthetic coding sequence
atgctggacctggaggtggtgcccgagagaagcctgggcaacgagcagtgggagttcaccctgggcatgcccctggcccaggccgtggccatcctgcagaagcactgcagaatcatcaagaacgtgcaggtgctgtacagcgagcagagccccctgagccacgacctgatcctgaacctgacccaggacggcatcaagctgatgttcgacgccttcaaccagagactgaaggtgatcgaggtgtgcgacctgaccaaggtgaagctgaagtactgcggcgtgcacttcaacagccaggccatcgcccccaccatcgagcagatcgaccagagcttcggcgccacccaccccggcgtgtacaacagcgccgagcagctgttccacctgaacttcagaggcctgagcttcagcttccagctggacagctggaccgaggcccccaagtacgagcccaacttcgcccacggcctggccagcctgcagatcccccacggcgccaccgtgaagagaatgtacatctacagcggcaacagcctgcaggacaccaaggcccccatgatgcccctgagctgcttcctgggcaacgtgtacgccgagagcgtggacgtgctgagagacggcaccggccccgccggcctgagactgagactgctggccgccggctgcggccccggcctgctggccgacgccaagatgagagtgttcgagagaagcgtgtacttcggcgacagctgccaggacgtgctgagcatgctgggcagcccccacaaggtgttctacaagagcgaggacaagatgaagatccacagccccagcccccacaagcaggtgcccagcaagtgcaacgactacttcttcaactacttcaccctgggcgtggacatcctgttcgacgccaacacccacaaggtgaagaagttcgtgctgcacaccaactaccccggccactacaacttcaacatctaccacagatgcgagttcaagatccccctggccatcaagaaggagaacgccgacggccagaccgagacctgcaccacctacagcaagtgggacaacatccaggagctgctgggccaccccgtggagaagcccgtggtgctgcacagaagcagcagccccaacaacaccaaccccttcggcagcaccttctgcttcggcctgcagagaatgatcttcgaggtgatgcagaacaaccacatcgccagcgtgaccctgtacggcccccccagacccggcagccacctgagaaccgccgagctgccctag

SEQ ID NO: 77671 - DNA, 1470 bp, Artificial Sequence
  Description of Artificial Sequence: Synthetic coding sequence
atgagcttcagaaaggtggtgagacagagcaagttcagacacgtgttcggccagcccgtgaagaacgaccagtgctacgaggacatcagagtgagcagagtgacctgggacagcaccttctgcgccgtgaaccccaagttcctggccgtgatcgtggaggccagcggcggcggcgccttcctggtgctgcccctgagcaagaccggcagaatcgacaaggcctaccccaccgtgtgcggccacaccggccccgtgctggacatcgactggtgcccccacaacgacgaggtgatcgccagcggcagcgaggactgcaccgtgatggtgtggcagatccccgagaacggcctgaccagccccctgaccgagcccgtggtggtgctggagggccacaccaagagagtgggcatcatcgcctggcaccccaccgccagaaacgtgctgctgagcgccggctgcgacaacgtggtgctgatctggaacgtgggcaccgccgaggagctgtacagactggacagcctgcaccccgacctgatctacaacgtgagctggaaccacaacggcagcctgttctgcagcgcctgcaaggacaagagcgtgagaatcatcgaccccagaagaggcaccctggtggccgagagagagaaggcccacgagggcgccagacccatgagagccatcttcctggccgacggcaaggtgttcaccaccggcttcagcagaatgagcgagagacagctggccctgtgggaccccgagaacctggaggagcccatggccctgcaggagctggacagcagcaacggcgccctgctgcccttctacgaccccgacaccagcgtggtgtacgtgtgcggcaagggcgacagcagcatcagatacttcgagatcaccgaggagcccccctacatccacttcctgaacaccttcaccagcaaggagccccagagaggcatgggcagcatgcccaagagaggcctggaggtgagcaagtgcgagatcgccagattctacaagctgcacgagagaaagtgcgagcccatcgtgatgaccgtgcccagaaagagcgacctgttccaggacgacctgtaccccgacaccgccggccccgaggccgccctggaggccgaggagtgggtgagcggcagagacgccgaccccatcctgatcagcctgagagaggcctacgtgcccagcaagcagagagacctgaagatcagcagaagaaacgtgctgagcgacagcagacccgccatggcccccggcagcagccacctgggcgcccccgccagcaccaccaccgccgccgacgccacccccagcggcagcctggccagagccggcgaggccggcaagctggaggaggtgatgcaggagctgagagccctgagagccctggtgaaggagcagggcgacagaatctgcagactggaggagcagctgggcagaatggagaacggcgacgcctag

SEQ ID NO: 77672 - DNA, 864 bp, Artificial Sequence
  Description of Artificial Sequence: Synthetic coding sequence
tgcttcctgctgcccagaggcagagaccccgagccccccgaggccggcgccgccgccccctgcgcccccggcgcccccgacatgagcttcagaaaggtggtgagacagagcaagttcagacacgtgttcggccagcccgtgaagaacgaccagtgctacgaggacatcagagtgagcagagtgacctgggacagcaccttctgcgccgtgaaccccaagttcctggccgtgatcgtggaggccagcggcggcggcgccttcctggtgctgcccctgagcaagaccggcagaatcgacaaggcctaccccaccgtgtgcggccacaccggccccgtgctggacatcgactggtgcccccacaacgacgaggtgatcgccagcggcagcgaggactgcaccgtgatggtgtggcagatccccgagaacggcctgaccagccccctgaccgagcccgtggtggtgctggagggccacaccaagagagtgggcatcatcgcctggcaccccaccgccagaaacgtgctgctgagcgccggctgcgacaacgtggtgctgatctggaacgtgggcaccgccgaggagctgtacagactggacagcctgcaccccgacctgatctacaacgtgagctggaaccacaacggcagcctgttctgcagcgcctgcaaggacaagagcgtgagaatcatcgaccccagaagaggcaccctggtggccgagagagagaaggcccacgagggcgccagacccatgagagccatcttcctggccgacggcaaggtgttcaccaccggcttcagcagaatgagcgagagacagctggccctgtgggaccccggcgtgagaagattctgcctggcctag

SEQ ID NO: 77673 - DNA, 1470 bp, Artificial Sequence; identical to SEQ ID NO: 77671
  Description of Artificial Sequence: Synthetic coding sequence

SEQ ID NO: 77674 - DNA, 870 bp, Artificial Sequence
  Description of Artificial Sequence: Synthetic coding sequence
atgagcttcagaaaggtggtgagacagagcaagttcagacacgtgttcggccagcccgtgaagaacgaccagtgctacgaggacatcagagtgagcagagtgacctgggacagcaccttctgcgccgtgaaccccaagttcctggccgtgatcgtggaggccagcggcggcggcgccttcctggtgctgcccctgagcaagaccggcagaatcgacaaggcctaccccaccgtgtgcggccacaccggccccgtgctggacatcgactggtgcccccacaacgacgaggtgatcgccagcggcagcgaggactgcaccgtgatggtgtggcagatccccgagaacggcctgaccagccccctgaccgagcccgtggtggtgctggagggccacaccaagagagtgggcatcatcgcctggcaccccaccgccagaaacgtgctgctgagcgccggctgcgacaacgtggtgctgatctggaacgtgggcaccgccgaggagctgtacagactggacagcctgcaccccgacctgatctacaacgtgagctggaaccacaacggcagcctgttctgcagcgcctgcaaggacaagagcgtgagaatcatcgaccccagaagaggcaccctggtggccgagagagagaaggcccacgagggcgccagacccatgagagccatcttcctggccgacggcaaggtgttcaccaccggcttcagcagaatgagcgagagacagctggccctgtgggaccccgtgagcggccagcccgagggcgccaacctgagactgggcccccaccccggccccggcagacagggcagcccctggggcggcctgtggttcctggccagcctgcccggcacctag

SEQ ID NO: 77675 - DNA, 552 bp, Artificial Sequence
  Description of Artificial Sequence: Synthetic coding sequence
atgagcttcagaaaggtggtgagacagagcaagttcagacacgtgttcggccagcccgtgaagaacgaccagtgctacgaggacatcagagtgagcagagtgacctgggacagcaccttctgcgccgtgaaccccaagttcctggccgtgatcgtggaggccagcggcggcggcgccttcctggtgctgcccctgagcaagaccggcagaatcgacaaggcctaccccaccgtgtgcggccacaccggccccgtgctggacatcgactggtgcccccacaacgacgaggtgatcgccagcggcagcgaggactgcaccgtgatggtgtggcagatccccgagaacggcctgaccagccccctgaccgagcccgtggtggtgctggagggccacaccaagagagtgggcatcatcgcctggcaccccaccgccagaaacgtgctgctgagcgccggcctgcacagaccccccttctgcgccccccccccccacggccccctgcacaccagccagcagcccctgcagggcccccacgacaagtgggagagctag

SEQ ID NO: 77676 - DNA, 1425 bp, Artificial Sequence
  Description of Artificial Sequence: Synthetic coding sequence
atgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggctgcgacaacgccatcatcatctggaacgtgggcaccggcgaggccctgatcaacctggacgacatgcacagcgacatgatctacaacgtgagctggaacagaaacggcagcctgatctgcaccgccagcaaggacaagaaggtgagagtgatcgaccccagaaagcaggagatcgtggccgagaaggagaaggcccacgagggcgccagacccatgagagccatcttcctggccgacggcaacgtgttcaccaccggcttcagcagaatgagcgagagacagctggccctgtggaaccccaagaacatgcaggagcccatcgccctgcacgagatggacaccagcaacggcgtgctgctgcccttctacgaccccgacaccagcatcatctacctgtgcggcaagggcgacagcagcatcagatacttcgagatcaccgacgagagcccctacgtgcactacctgaacaccttcagcagcaaggagccccagagaggcatgggctacatgcccaagagaggcctggacgtgaacaagtgcgagatcgccagattcttcaagctgcacgagagaaagtgcgagcccatcatcatgaccgtgcccagaaagagcgacctgttccaggacgacctgtaccccgacaccgccggccccgaggccgccctggaggccgaggagtggttcgagggcaagaacgccgaccccatcctgatcagcctgaagcacggctacatccccggcaagaacagagacctgaaggtggtgaagaagaacatcctggacagcaagcccaccgccaacaagaagtgcgacctgatcagcatccccaagaagaccaccgacaccgccagcgtgcagaacgaggccaagctggacgagatcctgaaggagatcaagagcatcaaggacaccatctgcaaccaggacgagagaatcagcaagctggagcagcagatggccaagatcgccgcctag

SEQ ID NO: 77677 - DNA, 1584 bp, Artificial Sequence
  Description of Artificial Sequence: Synthetic coding sequence
atgtacggccccggcagccagctgggcaagagcggcaacaacagctgggccaaggagagaggctgcagcatcgcctgccagggcagcctgaccagcgccagactgcacgcccccagcatcggcgagagacccctgagccacatgagatggaaggacaccatgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggctgcgacaacgccatcatcatctggaacgtgggcaccggcgaggccctgatcaacctggacgacatgcacagcgacatgatctacaacgtgagctggaacagaaacggcagcctgatctgcaccgccagcaaggacaagaaggtgagagtgatcgaccccagaaagcaggagatcgtggccgagaaggagaaggcccacgagggcgccagacccatgagagccatcttcctggccgacggcaacgtgttcaccaccggcttcagcagaatgagcgagagacagctggccctgtggaaccccaagaacatgcaggagcccatcgccctgcacgagatggacaccagcaacggcgtgctgctgcccttctacgaccccgacaccagcatcatctacctgtgcggcaagggcgacagcagcatcagatacttcgagatcaccgacgagagcccctacgtgcactacctgaacaccttcagcagcaaggagccccagagaggcatgggctacatgcccaagagaggcctggacgtgaacaagtgcgagatcgccagattcttcaagctgcacgagagaaagtgcgagcccatcatcatgaccgtgcccagaaagagcgacctgttccaggacgacctgtaccccgacaccgccggccccgaggccgccctggaggccgaggagtggttcgagggcaagaacgccgaccccatcctgatcagcctgaagcacggctacatccccggcaagaacagagacctgaaggtggtgaagaagaacatcctggacagcaagcccaccgccaacaagaagtgcgacctgatcagcatccccaagaagaccaccgacaccgccagcgtgcagaacgaggccaagctggacgagatcctgaaggagatcaagagcatcaaggacaccatctgcaaccaggacgagagaatcagcaagctggagcagcagatggccaagatcgccgcctag

SEQ ID NO: 77678 - DNA, 1425 bp, Artificial Sequence; identical to SEQ ID NO: 77676
  Description of Artificial Sequence: Synthetic coding sequence

SEQ ID NO: 77679 - DNA, 489 bp, Artificial Sequence
  Description of Artificial Sequence: Synthetic coding sequence
atgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggctgcgacaacgccatcatcatctggaacgtgggcacctag

SEQ ID NO: 77680 - DNA, 498 bp, Artificial Sequence
  Description of Artificial Sequence: Synthetic coding sequence
agcaaggagccccagagaggcatgggctacatgcccaagagaggcctggacgtgaacaagtgcgagatcgccagattcttcaagctgcacgagagaaagtgcgagcccatcatcatgaccgtgcccagaaagagcgacctgttccaggacgacctgtaccccgacaccgccggccccgaggccgccctggaggccgaggagtggttcgagggcaagaacgccgaccccatcctgatcagcctgaagcacggctacatccccggcaagaacagagacctgaaggtggtgaagaagaacatcctggacagcaagcccaccgccaacaagaagtgcgacctgatcagcatccccaagaagaccaccgacaccgccagcgtgcagaacgaggccaagctggacgagatcctgaaggagatcaagagcatcaaggacaccatctgcaaccaggacgagagaatcagcaagctggagcagcagatggccaagatcgccgcctag

SEQ ID NO: 77681 - DNA, 546 bp, Artificial Sequence
  Description of Artificial Sequence: Synthetic coding sequence
atgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggctgcgacaacgccatcatcatctggaacgtgggcaccggcgaggccctgatcaacctggacgacatgcacagcgacatgatctacaacgtgagctag

SEQ ID NO: 77682 - DNA, 1443 bp, Artificial Sequence
  Description of Artificial Sequence: Synthetic coding sequence
atgagatggaaggacaccatgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggctgcgacaacgccatcatcatctggaacgtgggcaccggcgaggccctgatcaacctggacgacatgcacagcgacatgatctacaacgtgagctggaacagaaacggcagcctgatctgcaccgccagcaaggacaagaaggtgagagtgatcgaccccagaaagcaggagatcgtggccgagaaggagaaggcccacgagggcgccagacccatgagagccatcttcctggccgacggcaacgtgttcaccaccggcttcagcagaatgagcgagagacagctggccctgtggaaccccaagaacatgcaggagcccatcgccctgcacgagatggacaccagcaacggcgtgctgctgcccttctacgaccccgacaccagcatcatctacctgtgcggcaagggcgacagcagcatcagatacttcgagatcaccgacgagagcccctacgtgcactacctgaacaccttcagcagcaaggagccccagagaggcatgggctacatgcccaagagaggcctggacgtgaacaagtgcgagatcgccagattcttcaagctgcacgagagaaagtgcgagcccatcatcatgaccgtgcccagaaagagcgacctgttccaggacgacctgtaccccgacaccgccggccccgaggccgccctggaggccgaggagtggttcgagggcaagaacgccgaccccatcctgatcagcctgaagcacggctacatccccggcaagaacagagacctgaaggtggtgaagaagaacatcctggacagcaagcccaccgccaacaagaagtgcgacctgatcagcatccccaagaagaccaccgacaccgccagcgtgcagaacgaggccaagctggacgagatcctgaaggagatcaagagcatcaaggacaccatctgcaaccaggacgagagaatcagcaagctggagcagcagatggccaagatcgccgcctag

SEQ ID NO: 77683 - DNA, 510 bp, Artificial Sequence
  Description of Artificial Sequence: Synthetic coding sequence
atgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggctgcgacaacgccatcatcatctggaacgtgggcaccggcgaggccctgatcaacctgtag

SEQ ID NO: 77684 - DNA, 456 bp, Artificial Sequence
  Description of Artificial Sequence: Synthetic coding sequence
atgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggcggctag

SEQ ID NO: 77685 - DNA, 492 bp, Artificial Sequence
  Description of Artificial Sequence: Synthetic coding sequence
atgagaagagtggtgagacagagcaagttcagacacgtgttcggccaggccgtgaagaacgaccagtgctacgacgacatcagagtgagcagagtgacctgggacagcagcttctgcgccgtgaaccccagattcgtggccatcatcatcgaggccagcggcggcggcgccttcctggtgctgcccctgcacaagaccggcagaatcgacaagagctaccccaccgtgtgcggccacaccggccccgtgctggacatcgactggtgcccccacaacgaccaggtgatcgccagcggcagcgaggactgcaccgtgatggtgtggcagatccccgagaacggcctgaccctgagcctgaccgagcccgtggtgatcctggagggccacagcaagagagtgggcatcgtggcctggcaccccaccgccagaaacgtgctgctgagcgccggctgcgacaacgccatcatcatctggaacgtgggcaccggctag

SEQ ID NO: 77686 - DNA, 1578 bp, Artificial Sequence
  Description of Artificial Sequence: Synthetic coding sequence
atgagctggcacccccagtacagaagcagcaagttcagacacgtgttcggcaagcccgccagcaaggagaactgctacgacagcgtgcccatcaccagaagcgtgcacgacaaccacttctgcgccgtgaacccccacttcatcgccgtggtgaccgagtgcgccggcggcggcgccttcctggtgatccccctgcaccagaccggcaagctggacccccactaccccaaggtgtgcggccacagaggcaacgtgctggacgtgaagtggaaccccttcgacgacttcgagatcgccagctgcagcgaggacgccaccatcaagatctggagcatccccaagcagctgctgaccagaaacctgaccgcctacagaaaggagctggtgggccacgccagaagagtgggcctggtggagtggcaccccaccgccgccaacatcctgttcagcgccggctacgactacaaggtgatgatctggaacctggacaccaaggagagcgtgatcaccagccccatgagcaccatcagctgccaccaggacgtgatcctgagcatgagcttcaacaccaacggcagcctgctggccaccacctgcaaggacagaaagatcagagtgatcgaccccagagccggcaccgtgctgcaggaggccagctacaagggccacagagccagcaaggtgctgttcctgggcaacctgaagaagctgatgagcaccggcaccagcagatggaacaacagacaggtggccctgtgggaccaggacaacctgagcgtgcccctgatggaggaggacctggacggcagcagcggcgtgctgttccccttctacgacgccgacaccagcatgctgtacgtggtgggcaagggcgacggcaacatcagatactacgaggtgagcgccgacaagccccacctgagctacctgaccgagtacagaagctacaacccccagaagggcatcggcgtgatgcccaagagaggcctggacgtgagcagctgcgagatcttcagattctacaagctgatcaccaccaagagcctgatcgagcccatcagcatgatcgtgcccagaagaagcgagagctaccaggaggacatctacccccccaccgccggcgcccagcccagcctgaccgcccaggagtggctgagcggcatgaacagagaccccatcctggtgagcctgagacccggcagcgagctgctgagaccccaccccctgcccgccgagagacccatcttcaacagcatggcccccgccagccccagactgctgaaccagaccgagaagctggccgccgaggacggctggagaagcagcagcctgctggaggagaagatgcccagatgggccgccgagcacagactggaggagaagaagacctggctgaccaacggcttcgacgtgttcgagtgccccccccccaagaccgagaacgagctgctgcagatgttctacagacagcaggaggagatcagaagactgagagagctgctgacccagagagaggtgcaggccaagcagctggagctggagatcaagaacctgagaatgggcagcgagcagctgtag

SEQ ID NO: 77687 - DNA, 1578 bp, Artificial Sequence; identical to SEQ ID NO: 77686
  Description of Artificial Sequence: Synthetic coding sequence

SEQ ID NO: 77688 - DNA, 1443 bp, Artificial Sequence; identical to SEQ ID NO: 77669
  Description of Artificial Sequence: Synthetic coding sequence

SEQ ID NO: 77689 - DNA, 1428 bp, Artificial Sequence
  Description of Artificial Sequence: Synthetic coding sequence
atgagctggagaccccagtacagaagcagcaagttcagaaacgtgtacggcaaggtggccaacagagagcactgcttcgacggcatccccatcaccaagaacgtgcacgacaaccacttctgcgccgtgaacaccagattcctggccatcgtgaccgagagcgccggcggcggcagcttcctggtgatccccctggagcagaccggcagaatcgagcccaactaccccaaggtgtgcggccaccagggcaacgtgctggacatcaagtggaaccccttcatcgacaacatcatcgccagctgcagcgaggacaccagcgtgagaatctgggagatccccgagggcggcctgaagagaaacatgaccgaggccctgctggagctgcacggccacagcagaagagtgggcctggtggagtggcaccccaccaccaacaacatcctgttcagcgccggctacgactacaaggtgctgatctggaacctggacgtgggcgagcccgtgaagatgatcgactgccacaccgacgtgatcctgtgcatgagcttcaacaccgacggcagcctgctgaccaccacctgcaaggacaagaagctgagagtgatcgagcccagaagcggcagagtgctgcaggaggccaactgcaagaaccacagagtgaacagagtggtgttcctgggcaacatgaagagactgctgaccaccggcgtgagcagatggaacaccagacagatcgccctgtgggaccaggaggacctgagcatgcccctgatcgaggaggagatcgacggcctgagcggcctgctgttccccttctacgacgccgacacccacatgctgtacctggccggcaagggcgacggcaacatcagatactacgagatcagcaccgagaagccctacctgagctacctgatggagttcagaagccccgccccccagaagggcctgggcgtgatgcccaagcacggcctggacgtgagcgcctgcgaggtgttcagattctacaagctggtgaccctgaagggcctgatcgagcccatcagcatgatcgtgcccagaagaagcgacagctaccaggaggacatctaccccatgacccccggcaccgagcccgccctgacccccgacgagtggctgggcggcatcaacagagaccccgtgctgatgagcctgaaggagggctacaagaagagcagcaagatggtgttcaaggcccccatcaaggagaagaagagcgtggtggtgaacggcatcgacctgctggagaacgtgccccccagaaccgagaacgagctgctgagaatgttcttcagacagcaggacgagatcagaagactgaaggaggagctggcccagaaggacatcagaatcagacagctgcagctggagctgaagaacctgagaaacagccccaagaactgctag

SEQ ID NO: 77690 - DNA, 1428 bp, Artificial Sequence; identical to SEQ ID NO: 77689
  Description of Artificial Sequence: Synthetic coding sequence

SEQ ID NO: 77691 - DNA, 4992 bp, Artificial Sequence
  Description of Artificial Sequence: Synthetic coding sequence
atggccaccgacggcgccagctgcgagcccgacctgagcagagcccccgaggacgccgccggcgccgccgccgaggccgccaagaaggagttcgacgtggacaccctgagcaagagcgagctgagaatgctgctgagcgtgatggagggcgagctggaggccagagacctggtgatcgaggccctgagagccagaagaaaggaggtgttcatccaggagagatacggcagattcaacctgaacgaccccttcctggccctgcagagagactacgaggccggcgccggcgacaaggagaagaagcccgtgtgcaccaaccccctgagcatcctggaggccgtgatggcccactgcaagaagatgcaggagagaatgagcgcccagctggccgccgccgagagcagacagaagaagctggagatggagaagctgcagctgcaggccctggagcaggagcacaagaagctggccgccagactggaggaggagagaggcaagaacaagcaggtggtgctgatgctggtgaaggagtgcaagcagctgagcggcaaggtgatcgaggaggcccagaagctggaggacgtgatggccaagctggaggaggagaagaagaagaccaacgagctggaggaggagctgagcgccgagaagagaagaagcaccgagatggaggcccagatggagaagcagctgagcgagttcgacaccgagagagagcagctgagagccaagctgaacagagaggaggcccacaccaccgacctgaaggaggagatcgacaagatgagaaagatgatcgagcagctgaagagaggcagcgacagcaagcccagcctgagcctgcccagaaagaccaaggacagaagactggtgagcatcagcgtgggcaccgagggcaccgtgaccagaagcgtggcctgccagaccgacctggtgaccgagaacgccgaccacatgaagaagctgcccctgaccatgcccgtgaagcccagcaccggcagccccctggtgagcgccaacgccaagggcagcgtgtgcaccagcgccaccatggccagacccggcatcgacagacaggccagctacggcgacctgatcggcgccagcgtgcccgccttccccccccccagcgccaacaagatcgaggagaacggccccagcaccggcagcacccccgaccccaccagcagcaccccccccctgcccagcaacgccgccccccccaccgcccagacccccggcatcgccccccagaacagccaggccccccccatgcacagcctgcacagcccctgcgccaacaccagcctgcaccccggcctgaaccccagaatccaggccgccagattcagattccagggcaacgccaacgaccccgaccagaacggcaacaccacccagagcccccccagcagagacgtgagccccaccagcagagacaacctggtggccaagcagctggccagaaacaccgtgacccaggccctgagcagattcaccagcccccaggccggcgcccccagcagacccggcgtgccccccaccggcgacgtgggcacccacccccccgtgggcagaaccagcctgaagacccacggcgtggccagagtggacagaggcaaccccccccccatcccccccaagaagcccggcctgagccagacccccagccccccccacccccagctgaaggtgatcatcgacagcagcagagccagcaacaccggcgccaaggtggacaacaagaccgtggccagcacccccagcagcctgccccagggcaacagagtgatcaacgaggagaacctgcccaagagcagcagcccccagctgccccccaagcccagcatcgacctgaccgtggcccccgccggctgcgccgtgagcgccctggccaccagccaggtgggcgcctggcccgccgccacccccggcctgaaccagcccgcctgcagcgacagcagcctggtgatccccaccaccatcgccttctgcagcagcatcaaccccgtgagcgccagcagctgcagacccggcgccagcgacagcctgctggtgaccgccagcggctggagccccagcctgacccccctgctgatgagcggcggccccgcccccctggccggcagacccaccctgctgcagcaggccgccgcccagggcaacgtgaccctgctgagcatgctgctgaacgaggagggcctggacatcaactacagctgcgaggacggccacagcgccctgtacagcgccgccaagaacggccacaccgactgcgtgagactgctgctgagcgccgaggcccaggtgaacgccgccgacaagaacggcttcacccccctgtgcgccgccgccgcccagggccacttcgagtgcgtggagctgctgatcagctacgacgccaacatcaaccacgccgccgacggcggccagacccccctgtacctggcctgcaagaacggcaacaaggagtgcatcaagctgctgctggaggccggcaccaacagaagcgtgaagaccaccgacggctggacccccgtgcacgccgccgtggacaccggcaacgtggacagcctgaagctgctgatgtaccacagaatccccgcccacggcaacagcttcaacgaggaggagagcgagagcagcgtgttcgacctggacggcggcgaggagagccccgagggcatcagcaagcccgtggtgcccgccgacctgatcaaccacgccaacagagagggctggaccgccgcccacatcgccgccagcaagggcttcaagaactgcctggagatcctgtgcagacacggcggcctggagcccgagagaagagacaagtgcaacagaaccgtgcacgacgtggccaccgacgactgcaagcacctgctggagaacctgaacgccctgaagatccccctgagaatcagcgtgggcgagatcgagcccagcaactacggcagcgacgacctggagtgcgagaacaccatctgcgccctgaacatcagaaagcagaccagctgggacgacttcagcaaggccgtgagccaggccctgaccaaccacttccaggccatcagcagcgacggctggtggagcctggaggacgtgacctgcaacaacaccaccgacagcaacatcggcctgagcgccagaagcatcagaagcatcaccctgggcaacgtgccctggagcgtgggccagagcttcgcccagagcccctgggacttcatgagaaagaacaaggccgagcacatcaccgtgctgctgagcggcccccaggagggctgcctgagcagcgtgacctacgccagcatgatccccctgcagatgatgcagaactacctgagactggtggagcagtaccacaacgtgatcttccacggccccgagggcagcctgcaggactacatcgtgcaccagctggccctgtgcctgaagcacagacagatggccgccggcttcagctgcgagatcgtgagagccgaggtggacgccggcttcagcaaggagcagctgctggacctgttcatcagcagcgcctgcctgatccccgtgaagcagagccccagcaagaagaagatcatcatcatcctggagaacctggagaagagcagcctgagcgagctgctgagagacttcctggcccccctggagaacagaagcaccgagagcccctgcaccttccagaagggcaacggcctgagcgagtgctactacttccacgagaactgcttcctgatgggcaccatcgccaaggcctgcctgcagggcagcgacctgctggtgcagcagcacttcagatgggtgcagctgagatgggacggcgagcccatgcagggcctgctgcagagattcctgagaagaaaggtggtgaacaagttcaagggccaggcccccagcccctgcgaccccgtgtgcaagatcgtggactgggccctgagcgtgtggagacagctgaacagctgcctggccagactgggcacccccgaggccctgctgggccccaagtacttcctgagctgccccgtggtgcccggccacgcccaggtgaccgtgaagtggatgagcaagctgtggaacggcgtgatcgcccccagagtgcaggaggccatcctgagcagagccagcgtgaagagacagcccggcttcggccagaccaccgccaagagacaccccagccagggccagcaggccgtggtgaaggccgccctgagcatcctgctgaacaaggccgtgctgcacggctgccccctgcccagagccgagctggaccagcacaccgccgacttcaagggcggcagcttccccctgagcatcgtgagcagctacaacacctgcaacaagaagaagggcgagagcggcgcctggagaaaggtgaacaccagccccagaagaaagagcggcagattcagcctgcccacctggaacaagcccgacctgagcaccgagggcatgaagaacaagaccatcagccagctgaactgcaacagaaacgccagcctgagcaagcagaagagcctggagaacgacctgagcctgaccctgaacctggaccagagactgagcctgggcagcgacgacgaggccgacctggtgaaggagctgcagagcatgtgcagcagcaagagcgagagcgacatcagcaagatcgccgacagcagagacgacctgagaatgttcgacagcagcggcaacaaccccgtgctgagcgccaccatcaacaacctgagaatgcccgtgagccagaaggaggtgagccccctgagcagccaccagaccaccgagtgcagcaacagcaagagcaagaccgagctgggcgtgagcagagtgaagagcttcctgcccgtgcccagaagcaaggtgacccagtgcagccagaacaccaagagaagcagcagcagcagcaacaccagacagatcgagatcaacaacaacagcaaggaggtgaactggaacctgcacaagaacgagcacctggagaagcccaacaagtag

SEQ ID NO: 77692 - DNA, 249 bp, Artificial Sequence
  Description of Artificial Sequence: Synthetic coding sequence
atgagcgccacctggaccctgagccccgagcccctgccccccagcaccggcccccccgtgggcgccggcctggacgccgagcagagaaccgtgttcgccttcgtgctgtgcctgctggtggtgctggtgctgctgatggtgagatgcgtgagaatcctgctggacccctacagcagaatgcccgccagcagctggaccgaccacaaggaggccctggagagaggccagttcgactacgccctggtgtag

SEQ ID NO: 77693 - DNA, 969 bp, Artificial Sequence
  Description of Artificial Sequence: Synthetic coding sequence
atgagccccaacttcaagctgcagtgccacttcatcctgatcttcctgaccgccctgagaggcgagagcagatacctggagctgagagaggccgccgactacgaccccttcctgctgttcagcgccaacctgaagagagagctggccggcgagcagccctacagaagagccctgagatgcctggacatgctgagcctgcagggccagttcaccttcaccgccgacagaccccagctgcactgcgccgccttcttcatcagcgagcccgaggagttcatcaccatccactacgaccaggtgagcatcgactgccagggcggcgacttcctgaaggtgttcgacggctggatcctgaagggcgagaagttccccagcagccaggaccaccccctgcccagcgccgagagatacatcgacttctgcgagagcggcctgagcagaagaagcatcagaagcagccagaacgtggccatgatcttcttcagagtgcacgagcccggcaacggcttcaccctgaccatcaagaccgaccccaacctgttcccctgcaacgtgatcagccagacccccaacggcaagttcaccctggtggtgccccaccagcacagaaactgcagcttcagcatcatctaccccgtggtgatcaagatcagcgacctgaccctgggccacgtgaacggcctgcagctgaagaagagcagcgccggctgcgagggcatcggcgacttcgtggagctgctgggcggcaccggcctggaccccagcaagatgacccccctggccgacctgtgctaccccttccacggccccgcccagatgaaggtgggctgcgacaacaccgtggtgagaatggtgagcagcggcaagcacgtgaacagagtgaccttcgagtacagacagctggagccctacgagctggagaaccccaacggcaacagcatcggcgagttctgcctgagcggcctgtag

SEQ ID NO: 77694 - DNA, 723 bp, Artificial Sequence
  Description of Artificial Sequence: Synthetic coding sequence
atgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 77695 - DNA, 1248 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcggcctgcagtgcaacgccagcgtggacctgatcggcacctgctggcccagaagccccgccggccagctggtggtgagaccctgccccgccttcttctacggcgtgagatacaacaccaccaacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 77696 - DNA, 858 bp, Artificial Sequence
  Description of Artificial Sequence: Synthetic coding sequence
atggtgagcgccaccatcccccagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagagccagcctgtgcctgtgcagcaccgtgagcagcatcgtgagaagcgtgctgcccagcggcagaggcggcaccggcggcagaaccagcaccagaagcgtgcccgagtggcccgtgccctgccccagcccccccccccagcccgtgagcgccttcaccgccagcagcagcccccagcagagcgagctggccggccacggcgccgcccccaaggagctgtggctgggcggctag

SEQ ID NO: 77697 - DNA, 1206 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcggcctgcagtgcaacgccagcgtggacctgatcggcacctgctggcccagaagccccgccggccagctggtggtgagaccctgccccgccttcttctacggcgtgagatacaacaccaccaacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 77698 - DNA, 1128 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcgacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 77699 - DNA, 1335 bp, Artificial Sequence
  Description of Artificial Sequence: Synthetic coding sequence
atgggcggccacccccagctgagactggtgaaggccctgctgctgctgggcctgaaccccgtgagcgccagcctgcaggaccagcactgcgagagcctgagcctggccagcaacatcagcggcctgcagtgcaacgccagcgtggacctgatcggcacctgctggcccagaagccccgccggccagctggtggtgagaccctgccccgccttcttctacggcgtgagatacaacaccaccaacaacggctacagagagtgcctggccaacggcagctgggccgccagagtgaactacagcgagtgccaggagatcctgaacgaggagaagaagagcaaggtgcactaccacgtggccgtgatcatcaactacctgggccactgcatcagcctggtggccctgctggtggccttcgtgctgttcctgagactgagacccggctgcacccactggggcgaccaggccgacggcgccctggaggtgggcgccccctggagcggcgcccccttccaggtgagaagaagcatcagatgcctgagaaacatcatccactggaacctgatcagcgccttcatcctgagaaacgccacctggttcgtggtgcagctgaccatgagccccgaggtgcaccagagcaacgtgggctggtgcagactggtgaccgccgcctacaactacttccacgtgaccaacttcttctggatgttcggcgagggctgctacctgcacaccgccatcgtgctgacctacagcaccgacagactgagaaagtggatgttcatctgcatcggctggggcgtgcccttccccatcatcgtggcctgggccatcggcaagctgtactacgacaacgagaagtgctggttcggcaagagacccggcgtgtacaccgactacatctaccagggccccatgatcctggtgctgctgatcaacttcatcttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgaggtgagcagagtggtgttcatctacttcaacagcttcctggagagcttccagggcttcttcgtgagcgtgttctactgcttcctgaacagcgaggtgagaagcgccatcagaaagagatggcacagatggcaggacaagcacagcatcagagccagagtggccagagccatgagcatccccaccagccccaccagagtgagcttccacagcatcaagcagagcaccgccgtgtag

SEQ ID NO: 77700 - DNA, 114 bp, Artificial Sequence
  Description of Artificial Sequence: Synthetic coding sequence
gtgtacaccgactacatctacttcaacagcttcctggagagcttccagggcttcttcgtgagcgtgttctactgcttcctgaacagcgaggtgagaagcgccatcagaaagtag

SEQ ID NO: 77701 - DNA, 1206 bp, Artificial Sequence; identical to SEQ ID NO: 77697
  Description of Artificial Sequence: Synthetic coding sequence

SEQ ID NO: 77702 - DNA, 1194 bp, Artificial Sequence
  Description of Artificial Sequence: Synthetic coding sequence
atgggcagagagccctggcccgaggacagagacctgggcttcccccagctgttctgccagggcccctacagctactgcaacaccaccctggaccagatcggcacctgctggcccagaagcgccgccggcgccctggtggagagaccctgccccgagtacttcaacggcgtgaagtacaacaccaccagaaacgcctacagagagtgcctggagaacggcacctgggccagcaagatcaactacagccagtgcgagcccatcctggacgacaagcagagaaagtacgacctgcactacagaatcgccctggtggtgaactacctgggccactgcgtgagcgtggccgccctggtggccgccttcctgctgttcctggccctgagaagcatcagatgcctgagaaacgtgatccactggaacctgatcaccaccttcatcctgagaaacgtgatgtggttcctgctgcagctggtggaccacgaggtgcacgagagcaacgaggtgtggtgcagatgcatcaccaccatcttcaactacttcgtggtgaccaacttcttctggatgttcgtggagggctgctacctgcacaccgccatcgtgatgacctacagcaccgagagactgagaaagtgcctgttcctgttcatcggctggtgcatccccttccccatcatcgtggcctgggccatcggcaagctgtactacgagaacgagcagtgctggttcggcaaggagcccggcgacctggtggactacatctaccagggccccatcatcctggtgctgctgatcaacttcgtgttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgacctgagccagatcatgttcatctacttcaacagcttcctgcagagcttccagggcttcttcgtgagcgtgttctactgcttcttcaacggcgaggtgagaagcgccgtgagaaagagatggcacagatggcaggaccaccacagcctgagagtgcccatggccagagccatgagcatccccaccagccccaccagaatcagcttccacagcatcaagcagaccgccgccgtgtag

SEQ ID NO: 77703 - DNA, 1317 bp, Artificial Sequence
  Description of Artificial Sequence: Synthetic coding sequence
atgagaggccccagcggcccccccggcctgctgtacgtgccccacctgctgctgtgcctgctgtgcctgctgcccccccccctgcagtacgccgccggccagagccagatgcccaaggaccagcccctgtgggccctgctggagcagtactgccacaccatcatgaccctgaccaacctgagcggcccctacagctactgcaacaccaccctggaccagatcggcacctgctggcccagaagcgccgccggcgccctggtggagagaccctgccccgagtacttcaacggcgtgaagtacaacaccaccagaaacgcctacagagagtgcctggagaacggcacctgggccagcaagatcaactacagccagtgcgagcccatcctggacgacaagcagagaaagtacgacctgcactacagaatcgccctggtggtgaactacctgggccactgcgtgagcgtggccgccctggtggccgccttcctgctgttcctggccctgagaagcatcagatgcctgagaaacgtgatccactggaacctgatcaccaccttcatcctgagaaacgtgatgtggttcctgctgcagctggtggaccacgaggtgcacgagagcaacgaggtgtggtgcagatgcatcaccaccatcttcaactacttcgtggtgaccaacttcttctggatgttcgtggagggctgctacctgcacaccgccatcgtgatgacctacagcaccgagagactgagaaagtgcctgttcctgttcatcggctggtgcatccccttccccatcatcgtggcctgggccatcggcaagctgtactacgagaacgagcagtgctggttcggcaaggagcccggcgacctggtggactacatctaccagggccccatcatcctggtgctgctgatcaacttcgtgttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgacctgagccagatcatgttcatctacttcaacagcttcctgcagagcttccagggcttcttcgtgagcgtgttctactgcttcttcaacggcgaggtgagaagcgccgtgagaaagagatggcacagatggcaggaccaccacagcctgagagtgcccatggccagagccatgagcatccccaccagccccaccagaatcagcttccacagcatcaagcagaccgccgccgtgtag

SEQ ID NO: 77704 - DNA, 1236 bp, Artificial Sequence
  Description of Artificial Sequence: Synthetic coding sequence
atggacgccgccctgctgcacagcctgctggaggccaactgcagcctggccctggccgaggagctgctgctggacggctggggcccccccctggaccccgagggcccctacagctactgcaacaccaccctggaccagatcggcacctgctggcccagaagcgccgccggcgccctggtggagagaccctgccccgagtacttcaacggcgtgaagtacaacaccaccagaaacgcctacagagagtgcctggagaacggcacctgggccagcaagatcaactacagccagtgcgagcccatcctggacgacaagcagagaaagtacgacctgcactacagaatcgccctggtggtgaactacctgggccactgcgtgagcgtggccgccctggtggccgccttcctgctgttcctggccctgagaagcatcagatgcctgagaaacgtgatccactggaacctgatcaccaccttcatcctgagaaacgtgatgtggttcctgctgcagctggtggaccacgaggtgcacgagagcaacgaggtgtggtgcagatgcatcaccaccatcttcaactacttcgtggtgaccaacttcttctggatgttcgtggagggctgctacctgcacaccgccatcgtgatgacctacagcaccgagagactgagaaagtgcctgttcctgttcatcggctggtgcatccccttccccatcatcgtggcctgggccatcggcaagctgtactacgagaacgagcagtgctggttcggcaaggagcccggcgacctggtggactacatctaccagggccccatcatcctggtgctgctgatcaacttcgtgttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgacctgagccagatcatgttcatctacttcaacagcttcctgcagagcttccagggcttcttcgtgagcgtgttctactgcttcttcaacggcgaggtgagaagcgccgtgagaaagagatggcacagatggcaggaccaccacagcctgagagtgcccatggccagagccatgagcatccccaccagccccaccagaatcagcttccacagcatcaagcagaccgccgccgtgtag

SEQ ID NO: 77705 - DNA, 1113 bp, Artificial Sequence
  Description of Artificial Sequence: Synthetic coding sequence
atggacgccgccctgctgcacagcctgctggaggccaactgcagcctggccctggccgaggagctgctgctggacggctggggcccccccctggaccccgagggcccctacagctactgcaacaccaccctggaccagatcggcacctgctggcccagaagcgccgccggcgccctggtggagagaccctgccccgagtacttcaacggcgtgaagtacaacaccaccagaaacgcctacagagagtgcctggagaacggcacctgggccagcaagatcaactacagccagtgcgagcccatcctggacgacaagcagagaaagtacgacctgcactacagaatcgccctggtggtgaactacctgggccactgcgtgagcgtggccgccctggtggccgccttcctgctgttcctggccctgagaagcatcagatgcctgagaaacgtgatccactggaacctgatcaccaccttcatcctgagaaacgtgatgtggttcctgctgcagctggtggaccacgaggtgcacgagagcaacgaggtgtggtgcagatgcatcaccaccatcttcaactacttcgtggtgaccaacttcttctggatgttcgtggagggctgctacctgcacaccgccatcgtgatgacctacagcaccgagagactgagaaagtgcctgttcctgttcatcggctggtgcatccccttccccatcatcgtggcctgggccatcggcaagctgtactacgagaacgagcagtgctggttcggcaaggagcccggcgacctggtggactacatctaccagggccccatcatcctggtgctgctgatcaacttcgtgttcctgttcaacatcgtgagaatcctgatgaccaagctgagagccagcaccaccagcgagaccatccagtacagaaaggccgtgaaggccaccctggtgctgctgcccctgctgggcatcacctacatgctgttcttcgtgaaccccggcgaggacgacctgagccagatcatgttcatctacttcaacagcttcctgcagagcttccagggcttcttcgtgagcgtgttctactgcttcttcaacggcgagggcctggagcccgtgtag

SEQ ID NO: 77706 - DNA, 468 bp, Artificial Sequence
  Description of Artificial Sequence: Synthetic coding sequence
atgtacagacacaagaacagctggagactgggcctgaagtacccccccagcagcaaggaggagacccaggtgcccaagaccctgatcagcggcctgcccggcagaaagagcagcagcagagtgggcgagaagctgcagagcgcccacaagatgcccctgagccccggcctgctgctgctgctgctgagcggcgccaccgccaccgccgccctgcccctggagggcggccccaccggcagagacagcgagcacatgcaggaggccgccggcatcagaaagagcagcctgctgaccttcctggcctggtggttcgagtggaccagccaggccagcgccggccccctgatcggcgaggaggccagagaggtggccagaagacaggagggcgcccccccccagcagagcgccagaagagacagaatgccctgcagaaacttcttctggaagaccttcagcagctgcaagtag

SEQ ID NO: 77707 - DNA, 318 bp, Artificial Sequence
  Description of Artificial Sequence: Synthetic coding sequence
atgcccctgagccccggcctgctgctgctgctgctgagcggcgccaccgccaccgccgccctgcccctggagggcggccccaccggcagagacagcgagcacatgcaggaggccgccggcatcagaaagagcagcctgctgaccttcctggcctggtggttcgagtggaccagccaggccagcgccggccccctgatcggcgaggaggccagagaggtggccagaagacaggagggcgcccccccccagcagagcgccagaagagacagaatgccctgcagaaacttcttctggaagaccttcagcagctgcaagtag

SEQ ID NO: 77708 - DNA, 1332 bp, Artificial Sequence
  Description of Artificial Sequence: Synthetic coding sequence
atggccgccagcccccacaccctgagcagcagactgctgaccggctgcgtgggcggcagcgtgtggtacctggagagaagaaccatccaggacagcccccacaagttcctgcacctgctgagaaacgtgaacaagcagtggatcaccttccagcacttcagcttcctgaagagaatgtacgtgacccagctgaacagaagccacaaccagcaggtgagacccaagcccgagcccgtggccagccccttcctggagaagaccagcagcggccaggccaaggccgagatctacgagatgagacccctgagcccccccagcctgagcctgagcagaaagcccaacgagaaggagctgatcgagctggagcccgacagcgtgatcgaggacagcatcgacgtgggcaaggagaccaaggaggagaagagatggaaggagatgaagctgcaggtgtacgacctgcccggcatcctggccagactgagcaagatcaagctgaccgccctggtggtgagcaccaccgccgccggcttcgccctggcccccggccccttcgactggccctgcttcctgctgaccagcgtgggcaccggcctggccagctgcgccgccaacagcatcaaccagttcttcgaggtgcccttcgacagcaacatgaacagaaccaagaacagacccctggtgagaggccagatcagccccctgctggccgtgagcttcgccacctgctgcgccgtgcccggcgtggccatcctgaccctgggcgtgaaccccctgaccggcgccctgggcctgttcaacatcttcctgtacacctgctgctacacccccctgaagagaatcagcatcgccaacacctgggtgggcgccgtggtgggcgccatcccccccgtgatgggctggaccgccgccaccggcagcctggacgccggcgccttcctgctgggcggcatcctgtacagctggcagttcccccacttcaacgccctgagctggggcctgagagaggactacagcagaggcggctactgcatgatgagcgtgacccaccccggcctgtgcagaagagtggccctgagacactgcctggccctgctggtgctgagcgccgccgcccccgtgctggacatcaccacctggaccttccccatcatggccctgcccatcaacgcctacatcagctacctgggcttcagattctacgtggacgccgacagaagaagcagcagaagactgttcttctgcagcctgtggcacctgcccctgctgctgctgctgatgctgacctgcaagagacccagcggcggcggcgacgccggccccccccccagctag

SEQ ID NO: 77709 - DNA, 399 bp, Artificial Sequence
  Description of Artificial Sequence: Synthetic coding sequence
tgaagaaacgtgaacaagcagtggatcaccttccagcacttcagcttcctgaagagaatgtacgtgacccagctgaacagaagccacaaccagcaggtgagacccaagcccgagcccgtggccagccccttcctggagaagaccagcagcggccaggccaaggccgagatctacgagatgagacccctgagcccccccagcctgagcctgagcagaaagcccaacgagaaggagctgatcgagctggagcccgacagcgtgatcgaggacagcatcgacgtgggcaaggagaccaaggaggagaagagatggaaggagatgaagctgcaggtgtacgacctgcccggcatcctggccagactgagcaagatcaagctgaccggcaccctgttcttctag

SEQ ID NO: 77710 - DNA, 756 bp, Artificial Sequence
  Description of Artificial Sequence: Synthetic coding sequence
atgatctgccaggagttctggctggactaccccaagagcaacagccagttcttcgaggtgcccttcgacagcaacatgaacagaaccaagaacagacccctggtgagaggccagatcagccccctgctggccgtgagcttcgccacctgctgcgccgtgcccggcgtggccatcctgaccctgggcgtgaaccccctgaccggcgccctgggcctgttcaacatcttcctgtacacctgctgctacacccccctgaagagaatcagcatcgccaacacctgggtgggcgccgtggtgggcgccatcccccccgtgatgggctggaccgccgccaccggcagcctggacgccggcgccttcctgctgggcggcatcctgtacagctggcagttcccccacttcaacgccctgagctggggcctgagagaggactacagcagaggcggctactgcatgatgagcgtgacccaccccggcctgtgcagaagagtggccctgagacactgcctggccctgctggtgctgagcgccgccgcccccgtgctggacatcaccacctggaccttccccatcatggccctgcccatcaacgcctacatcagctacctgggcttcagattctacgtggacgccgacagaagaagcagcagaagactgttcttctgcagcctgtggcacctgcccctgctgctgctgctgatgctgacctgcaagagacccagcggcggcggcgacgccggccccccccccagctag

SEQ ID NO: 77711 - DNA, 681 bp, Artificial Sequence
  Description of Artificial Sequence: Synthetic coding sequence
atgaacagaaccaagaacagacccctggtgagaggccagatcagccccctgctggccgtgagcttcgccacctgctgcgccgtgcccggcgtggccatcctgaccctgggcgtgaaccccctgaccggcgccctgggcctgttcaacatcttcctgtacacctgctgctacacccccctgaagagaatcagcatcgccaacacctgggtgggcgccgtggtgggcgccatcccccccgtgatgggctggaccgccgccaccggcagcctggacgccggcgccttcctgctgggcggcatcctgtacagctggcagttcccccacttcaacgccctgagctggggcctgagagaggactacagcagaggcggctactgcatgatgagcgtgacccaccccggcctgtgcagaagagtggccctgagacactgcctggccctgctggtgctgagcgccgccgcccccgtgctggacatcaccacctggaccttccccatcatggccctgcccatcaacgcctacatcagctacctgggcttcagattctacgtggacgccgacagaagaagcagcagaagactgttcttctgcagcctgtggcacctgcccctgctgctgctgctgatgctgacctgcaagagacccagcggcggcggcgacgccggccccccccccagctag

SEQ ID NO: 77712 - DNA, 831 bp, Artificial Sequence
  Description of Artificial Sequence: Synthetic coding sequence
atgggcggcctgtggagacccggctggagatgcgtgcccttctgcggctggagatggatccaccccggcagccccaccagagccgccgagagagtggagcccttcctgagacccgagtggagcggcaccggcggcgccgagagaggcctgagatggctgggcacctggaagagatgcagcctgagagccagacaccccgccctgcagccccccagaagacccaagagcagcaaccccttcaccagagcccaggaggaggagagaagaagacagaacaagaccaccctgacctacgtggccgccgtggccgtgggcatgctgggcgccagctacgccgccgtgcccctgtacagactgtactgccagaccaccggcctgggcggcagcgccgtggccggccacgccagcgacaagatcgagaacatggtgcccgtgaaggacagaatcatcaagatcagcttcaacgccgacgtgcacgccagcctgcagtggaacttcagaccccagcagaccgagatctacgtggtgcccggcgagaccgccctggccttctacagagccaagaaccccaccgacaagcccgtgatcggcatcagcacctacaacatcgtgcccttcgaggccggccagtacttcaacaagatccagtgcttctgcttcgaggagcagagactgaacccccaggaggaggtggacatgcccgtgttcttctacatcgaccccgagttcgccgaggaccccagaatgatcaaggtggacctgatcaccctgagctacaccttcttcgaggccaaggagggccacaagctgcccgtgcccggctacaactag

SEQ ID NO: 77713 - DNA, 1233 bp, Artificial Sequence
  Description of Artificial Sequence: Synthetic coding sequence
atgcagagactgctgttcccccccctgagagccctgaagggcagacagtacctgcccctgctggcccccagagccgcccccagagcccagtgcgactgcatcagaagacccctgagacccggccagtacagcaccatcagcgaggtggccctgcagagcggcagaggcaccgtgagcctgcccagcaaggccgccgagagagtggtgggcagatggctgctggtgtgcagcggcaccgtggccggcgccgtgatcctgggcggcgtgaccagactgaccgagagcggcctgagcatggtggactggcacctgatcaaggagatgaagccccccaccagccaggaggagtgggaggccgagttccagagataccagcagttccccgagttcaagatcctgaaccacgacatgaccctgaccgagttcaagttcatctggtacatggagtacagccacagaatgtggggcagactggtgggcctggtgtacatcctgcccgccgcctacttctggagaaagggctggctgagcagaggcatgaagggcagagtgctggccctgtgcggcctggtgtgcttccagggcctgctgggctggtacatggtgaagagcggcctggaggagaagagcgacagccacgacatccccagagtgagccagtacagactggccgcccacctgggcagcgccctggtgctgtactgcgccagcctgtggaccagcctgagcctgctgctgcccccccacaagctgcccgagacccaccagctgctgcagctgagaagattcgcccacggcaccgccggcctggtgttcctgaccgccctgagcggcgccttcgtggccggcctggacgccggcctggtgtacaacagcttccccaagatgggcgagagctggatccccgaggacctgttcaccttcagccccatcctgagaaacgtgttcgagaaccccaccatggtgcagttcgaccacagaatcctgggcatcaccagcgtgaccgccatcaccgtgctgtacttcctgagcagaagaatccccctgcccagaagaaccaagatggccgccgtgaccctgctggccctggcctacacccaggtgggcctgggcatcagcaccctgctgatgtacgtgcccacccccctggccgccacccaccagagcggcagcctggccctgctgaccggcgccctgtggctgatgaacgagctgagaagagtgcccaagtag

SEQ ID NO: 77714 - DNA, 1167 bp, Artificial Sequence
  Description of Artificial Sequence: Synthetic coding sequence
atgcagagactgctgttcccccccctgagagccctgaagggcagacagtacctgcccctgctggcccccagagccgcccccagagcccagtgcgactgcatcagaagacccctgagacccggccagtacagcaccatcagcgaggtggccctgcagagcggcagaggcaccgtgagcctgcccagcaaggccgccgagagagtggtgggcagatggctgctggtgtgcagcggcaccgtggccggcgccgtgatcctgggcggcgtgaccagactgaccgagagcggcctgagcatggtggactggcacctgatcaaggagatgaagccccccaccagccaggaggagtgggaggccgagttccagagataccagcagttccccgagttcaagatcctgaaccacgacatgaccctgaccgagttcaagttcatctggtacatggagtacagccacagaatgtggggcagactggtgggcctggtgtacatcctgcccgccgcctacttctggagaaagggctggctgagcagaggcatgaagggcagagtgctggccctgtgcggcctggtgtgcttccagggcctgctgggctggtacatggtgaagagcggcctggaggagaagagcgacagccacgacatccccagagtgagccagtacagactggccgcccacctgggcagcgccctggtgctgtactgcgccagcctgtggaccagcctgagcctgctgctgcccccccacaagctgcccgagacccaccagctgctgcagctgagaagattcgcccacggcaccgccggcctggtgttcctgaccgccctgagcggcgccttcgtggccggcctggacgccggcctggtgtacaacagcttccccaagatgggcgagagctggatccccgaggacctgttcaccttcagccccatcctgagaaacgtgttcgagaaccccaccatggtgcagttcgaccacagaatcctgggcatcaccagcgtgaccgccatcaccgtgctgtacttcctgagcagaagaatccccctgcccagaagaaccaagatggccgccgtgaccctgctggccctggcctacacccagggccccgtgctgttcaacttcaccttcaagatcagcgacctggacgagggcatcagaaacatctag

SEQ ID NO: 77715 - DNA, 192 bp, Artificial Sequence
  Description of Artificial Sequence: Synthetic coding sequence
atgcccggcctggtggacagcaaccccgccccccccgagagccaggagaagaagcccctgaagccctgctgcgcctgccccgagaccaagaaggccagagacgcctgcatcatcgagaagggcgaggagcactgcggccacctgatcgaggcccacaaggagtgcatgagagccctgggcttcaagatctag

SEQ ID NO: 77716 - DNA, 192 bp, Artificial Sequence; identical to SEQ ID NO: 77715
  Description of Artificial Sequence: Synthetic coding sequence

SEQ ID NO: 77717 - DNA, 297 bp, Artificial Sequence
  Description of Artificial Sequence: Synthetic coding sequence
atgcccggcctggtggacagcaaccccgccccccccgagagccaggagaagaagcccctgaagccctgctgcgcctgccccgagaccaagaaggccagagacgcctggttcagaggcagagtgagcgtggacctgagcagaagcctggtgcccggcaacgacggcgagagaggcgagagacaggccagcaccacccacagcttcctgcagatcatcatcgagaagggcgaggagcactgcggccacctgatcgaggcccacaaggagtgcatgagagccctgggcttcaagatctag

SEQ ID NO: 77718 - DNA, 192 bp, Artificial Sequence; identical to SEQ ID NO: 77715
  Description of Artificial Sequence: Synthetic coding sequence

SEQ ID NO: 77719 - DNA, 1098 bp, Artificial Sequence
  Description of Artificial Sequence: Synthetic coding sequence
atggccctgctgctgtgcttcgtgctgctgtgcggcgtggtggacttcgccagaagcctgagcatcaccacccccgaggagatgatcgagaaggccaagggcgagaccgcctacctgccctgcaagttcaccctgagccccgaggaccagggccccctggacatcgagtggctgatcagccccgccgacaaccagaaggtggaccaggtgatcatcctgtacagcggcgacaagatctacgacgactactaccccgacctgaagggcagagtgcacttcaccagcaacgacctgaagagcggcgacgccagcatcaacgtgaccaacctgcagctgagcgacatcggcacctaccagtgcaaggtgaagaaggcccccggcgtggccaacaagaagatccacctggtggtgctggtgaagcccagcggcgccagatgctacgtggacggcagcgaggagatcggcagcgacttcaagatcaagtgcgagcccaaggagggcagcctgcccctgcagtacgagtggcagaagctgagcgacagccagaagatgcccaccagctggctggccgagatgaccagcagcgtgatcagcgtgaagaacgccagcagcgagtacagcggcacctacagctgcaccgtgagaaacagagtgggcagcgaccagtgcctgctgagactgaacgtggtgccccccagcaacaaggccggcctgatcgccggcgccatcatcggcaccctgctggccctggccctgatcggcctgatcatcttctgctgcagaaagaagagaagagaggagaagtacgagaaggaggtgcaccacgacatcagagaggacgtgcccccccccaagagcagaaccagcaccgccagaagctacatcggcagcaaccacagcagcctgggcagcatgagccccagcaacatggagggctacagcaagacccagtacaaccaggtgcccagcgaggacttcgagagaaccccccagagccccaccctgccccccgccaaggtggccgcccccaacctgagcagaatgggcgccatccccgtgatgatccccgcccagagcaaggacggcagcatcgtgtag

SEQ ID NO: 77720 - DNA, 975 bp, Artificial Sequence
  Description of Artificial Sequence: Synthetic coding sequence
atggccctgctgctgtgcttcgtgctgctgtgcggcgtggtggacttcgccagaagcctgagcatcaccacccccgaggagatgatcgagaaggccaagggcgagaccgcctacctgccctgcaagttcaccctgagccccgaggaccagggccccctggacatcgagtggctgatcagccccgccgacaaccagaaggtggaccaggtgatcatcctgtacagcggcgacaagatctacgacgactactaccccgacctgaagggcagagtgcacttcaccagcaacgacctgaagagcggcgacgccagcatcaacgtgaccaacctgcagctgagcgacatcggcacctaccagtgcaaggtgaagaaggcccccggcgtggccaacaagaagatccacctggtggtgctggtgaagcccagcggcgccagatgctacgtggacggcagcgaggagatcggcagcgacttcaagatcaagtgcgagcccaaggagggcagcctgcccctgcagtacgagtggcagaagctgagcgacagccagaagatgcccaccagctggctggccgccagcaacaaggccggcctgatcgccggcgccatcatcggcaccctgctggccctggccctgatcggcctgatcatcttctgctgcagaaagaagagaagagaggagaagtacgagaaggaggtgcaccacgacatcagagaggacgtgcccccccccaagagcagaaccagcaccgccagaagctacatcggcagcaaccacagcagcctgggcagcatgagccccagcaacatggagggctacagcaagacccagtacaaccaggtgcccagcgaggacttcgagagaaccccccagagccccaccctgccccccgccaaggtggccgcccccaacctgagcagaatgggcgccatccccgtgatgatccccgcccagagcaaggacggcagcatcgtgtag

SEQ ID NO: 77721 - DNA, 603 bp, Artificial Sequence
  Description of Artificial Sequence: Synthetic coding sequence
atggccctgctgctgtgcttcgtgctgctgtgcggcgtggtggacttcgccagaagcctgagcatcaccacccccgaggagatgatcgagaaggccaagggcgagaccgcctacctgccctgcaagttcaccctgagccccgaggaccagggccccctggacatcgagtggctgatcagccccgccgacaaccagaaggtggaccaggtgatcatcctgtacagcggcgacaagatctacgacgactactaccccgacctgaagggcagagtgcacttcaccagcaacgacctgaagagcggcgacgccagcatcaacgtgaccaacctgcagctgagcgacatcggcacctaccagtgcaaggtgaagaaggcccccggcgtggccaacaagaagatccacctggtggtgctgggcaagatgtgccacctgcagagagccgtgagacccctgcccgaggccaccagcgccgtgatcatccacccctggggcccctgcctgctgcccacctggaaggacatccccagactgagcatcaccaagtaccaggtgaagaccctgaacgccctgctgagagtgagactgagccacctgctgagatag

SEQ ID NO: 77722 - DNA, 759 bp, Artificial Sequence
  Description of Artificial Sequence: Synthetic coding sequence
atggccctgctgctgtgcttcgtgctgctgtgcggcgtggtggacttcgccagaagcctgagcatcaccacccccgaggagatgatcgagaaggccaagggcgagaccgcctacctgccctgcaagttcaccctgagccccgaggaccagggccccctggacatcgagtggctgatcagccccgccgacaaccagaaggtggaccaggtgatcatcctgtacagcggcgacaagatctacgacgactactaccccgacctgaagggcagagtgcacttcaccagcaacgacctgaagagcggcgacgccagcatcaacgtgaccaacctgcagctgagcgacatcggcacctaccagtgcaaggtgaagaaggcccccggcgtggccaacaagaagatccacctggtggtgctggtgaagcccagcggcgccagatgctacgtggacggcagcgaggagatcggcagcgacttcaagatcaagtgcgagcccaaggagggcagcctgcccctgcagtacgagtggcagaagctgagcgacagccagaagatgcccaccagctggctggccggcaagatgtgccacctgcagagagccgtgagacccctgcccgaggccaccagcgccgtgatcatccacccctggggcccctgcctgctgcccacctggaaggacatccccagactgagcatcaccaagtaccaggtgaagaccctgaacgccctgctgagagtgagactgagccacctgctgagatag

SEQ ID NO: 77723 - DNA, 1059 bp, Artificial Sequence
  Description of Artificial Sequence: Synthetic coding sequence
atggccctgctgctgtgcttcgtgctgctgtgcggcgtggtggacttcgccagaagcctgagcatcaccacccccgaggagatgatcgagaaggccaagggcgagaccgcctacctgccctgcaagttcaccctgagccccgaggaccagggccccctggacatcgagtggctgatcagccccgccgacaaccagaaggtggaccaggtgatcatcctgtacagcggcgacaagatctacgacgactactaccccgacctgaagggcagagtgcacttcaccagcaacgacctgaagagcggcgacgccagcatcaacgtgaccaacctgcagctgagcgacatcggcacctaccagtgcaaggtgaagaaggcccccggcgtggccaacaagaagatccacctggtggtgctggtgaagcccagcggcgccagatgctacgtggacggcagcgaggagatcggcagcgacttcaagatcaagtgcgagcccaaggagggcagcctgcccctgcagtacgagtggcagaagctgagcgacagccagaagatgcccaccagctggctggccgagatgaccagcagcgtgatcagcgtgaagaacgccagcagcgagtacagcggcacctacagctgcaccgtgagaaacagagtgggcagcgaccagtgcctgctgagactgaacgtggtgccccccagcaacaaggccggcctgatcgccggcgccatcatcggcaccctgctggccctggccctgatcggcctgatcatcttctgctgcagaaagaagagaagagaggagaagtacgagaaggaggtgcaccacgacatcagagaggacgtgcccccccccaagagcagaaccagcaccgccagaagctacatcggcagcaaccacagcagcctgggcagcatgagccccagcaacatggagggctacagcaagacccagtacaaccaggtgcccagcgaggacttcgagagaaccccccagagccccaccctgccccccgccaagttcaagtacccctacaagaccgacggcatcaccgtggtgtag

SEQ ID NO: 77724 - DNA, 270 bp, Artificial Sequence
  Description of Artificial Sequence: Synthetic coding sequence
atggccctgctgctgtgcttcgtgctgctgtgcggcgtggtggacttcgccagaagcctgagcatcaccacccccgaggagatgatcgagaaggccaagggcgagaccgcctacctgccctgcaagttcaccctgagccccgaggaccagggccccctggacatcgagtggctgatcagccccgccgacaaccagaaggtggaccaggtgggcagatgcgccaccagcaaggagccctacgtgcactgccagaagctgcacagacagtag

SEQ ID NO: 77725 - DNA, 900 bp, Artificial Sequence
  Description of Artificial Sequence: Synthetic coding sequence
atggaggagttcgacagcgaggacttcagcaccagcgaggaggacgaggactacgtgcccagcggcggcgagtacagcgaggacgacgtgaacgagctggtgaaggaggacgaggtggacggcgaggagcagacccagaagacccagggcaagaagagaaaggcccagagcatccccgccagaaagagaagacagggcggcctgagcctggaggaggaggaggaggaggacgccaacagcgagagcgagggcagcagcagcgaggaggaggacgacgccgccgagcaggagaagggcatcggcagcgaggacgccagaaagaagaaggaggacgagctgtgggccagcttcctgaacgacgtgggccccaagagcaaggtgccccccagcacccaggtgaagaagggcgaggagaccgaggagaccagcagcagcaagctgctggtgaaggccgaggagctggagaagcccaaggagaccgagaaggtgaagatcaccaaggtgttcgacttcgccggcgaggaggtgagagtgaccaaggaggtggacgccaccagcaaggaggccaagagcttcttcaagcagaacgagaaggagaagccccaggccaacgtgcccagcgccctgcccagcctgcccgccggcagcggcctgaagagaagcagcggcatgagcagcctgctgggcaagatcggcgccaagaagcagaagatgagcaccctggagaagagcaagctggactgggagagcttcaaggaggaggagggcatcggcgaggagctggccatccacaacagaggcaaggagggctacatcgagagaaaggccttcctggacagagtggaccacagacagttcgagatcgagagagacctgagactgagcaagatgaagccctag

SEQ ID NO: 77726 - DNA, 675 bp, Artificial Sequence
  Description of Artificial Sequence: Synthetic coding sequence
atggagaagctgctgtgcttcctggtgctgaccagcctgagccacgccttcggccagaccgacatgagcagaaaggccttcgtgttccccaaggagagcgacaccagctacgtgagcctgaaggcccccctgaccaagcccctgaaggccttcaccgtgtgcctgcacttctacaccgagctgagcagcaccagaggctacagcatcttcagctacgccaccaagagacaggacaacgagatcctgatcttctggagcaaggacatcggctacagcttcaccgtgggcggcagcgagatcctgttcgaggtgcccgaggtgaccgtggcccccgtgcacatctgcaccagctgggagagcgccagcggcatcgtggagttctgggtggacggcaagcccagagtgagaaagagcctgaagaagggctacaccgtgggcgccgaggccagcatcatcctgggccaggagcaggacagcttcggcggcaacttcgagggcagccagagcctggtgggcgacatcggcaacgtgaacatgtgggacttcgtgctgagccccgacgagatcaacaccatctacctgggcggccccttcagccccaacgtgctgaactggagagccctgaagtacgaggtgcagggcgaggtgttcaccaagccccagctgtggccctag

SEQ ID NO: 77727 - DNA, 309 bp, Artificial Sequence
  Description of Artificial Sequence: Synthetic coding sequence
atggagaagctgctgtgcttcctggtgctgaccagcctgagccacgccttcggccagaccgacatgagcagaaaggccttcgtgttccccaaggagagcgacaccagctacgtgagcctgaaggcccccctgaccaagcccctgaaggccttcaccgtgtgcctgcacttctacaccgagctgagcagcacccacgagatcaacaccatctacctgggcggccccttcagccccaacgtgctgaactggagagccctgaagtacgaggtgcagggcgaggtgttcaccaagccccagctgtggccctag

SEQ ID NO: 77728 - DNA, 309 bp, Artificial Sequence; identical to SEQ ID NO: 77727
  Description of Artificial Sequence: Synthetic coding sequence

SEQ ID NO: 77729 - DNA, 309 bp, Artificial Sequence; identical to SEQ ID NO: 77727
  Description of Artificial Sequence: Synthetic coding sequence

SEQ ID NO: 77730 - DNA, 276 bp, Artificial Sequence
  Description of Artificial Sequence: Synthetic coding sequence
atggagaagctgctgtgcttcctggtgctgaccagcctgagccacgccttcggccagaccgacatgagcagaaaggccttcgtgttccccaaggagagcgacaccagctacgtgagcctgaaggcccccctgaccaagcccctgaaggccttcaccgtgtgcctgcacttctacaccgagctgagcagcaccagaggccccaacgtgctgaactggagagccctgaagtacgaggtgcagggcgaggtgttcaccaagccccagctgtggccctag

SEQ ID NO: 77731 - DNA, 141 bp, Artificial Sequence
  Description of Artificial Sequence: Synthetic coding sequence
atgtgggacttcgtgctgagccccgacgagatcaacaccatctacctgggcggccccttcagccccaacgtgctgaactggagagccctgaagtacgaggtgcagggcgaggtgttcaccaagccccagctgtggccctag

SEQ ID NO: 77732 - DNA, 1146 bp, Artificial Sequence
  Description of Artificial Sequence: Synthetic coding sequence
atgcccttcagcaacagccacaacgccctgaagctgagattccccgccgaggacgagttccccgacctgagcgcccacaacaaccacatggccaaggtgctgacccccgagctgtacgccgagctgagagccaagagcacccccagcggcttcaccctggacgacgtgatccagaccggcgtggacaaccccggccacccctacatcatgaccgtgggctgcgtggccggcgacgaggagagctacgaggtgttcaaggacctgttcgaccccatcatcgaggacagacacggcggctacaagcccagcgacgagcacaagaccgacctgaaccccgacaacctgcagggcggcgacgacctggaccccaactacgtgctgagcagcagagtgagaaccggcagaagcatcagaggcttctgcctgcccccccactgcagcagaggcgagagaagagccatcgagaagctggccgtggaggccctgagcagcctggacggcgacctggccggcagatactacgccctgaagagcatgaccgaggccgagcagcagcagctgatcgacgaccacttcctgttcgacaagcccgtgagccccctgctgctggccagcggcatggccagagactggcccgacgccagaggcatctggcacaacgacaacaagaccttcctggtgtgggtgaacgaggaggaccacctgagagtgatcagcatgcagaagggcggcaacatgaaggaggtgttcaccagattctgcaccggcctgacccagatcgagaccctgttcaagagcaaggactacgagttcatgtggaacccccacctgggctacatcctgacctgccccagcaacctgggcaccggcctgagagccggcgtgcacatcaagctgcccaacctgggcaagcacgagaagttcagcgaggtgctgaagagactgagactgcagaagagaggcaccggcggcgtggacaccgccgccgtgggcggcgtgttcgacgtgagcaacgccgacagactgggcttcagcgaggtggagctggtgcagatggtggtggacggcgtgaagctgctgatcgagatggagcagagactggagcagggccaggccatcgacgacctgatgcccgcccagaagtag

SEQ ID NO: 77733 - DNA, 1041 bp, Artificial Sequence
  Description of Artificial Sequence: Synthetic coding sequence
atgcccttcagcaacagccacaacgccctgaagctgagattccccgccgaggacgagttccccgacctgagcgcccacaacaaccacatggccaaggtgctgacccccgagctgtacgccgagctgagagccaagagcacccccagcggcttcaccctggacgacgtgatccagaccggcgtggacaaccccggccacccctacatcatgaccgtgggctgcgtggccggcgacgaggagagctacgaggtgttcaaggacctgttcgaccccatcatcgaggacagacacggcggctacaagcccagcgacgagcacaagaccgacctgaacccccccagaggcgcccccagaatcgagaagctggccgtggaggccctgagcagcctggacggcgacctggccggcagatactacgccctgaagagcatgaccgaggccgagcagcagcagctgatcgacgaccacttcctgttcgacaagcccgtgagccccctgctgctggccagcggcatggccagagactggcccgacgccagaggcatctggcacaacgacaacaagaccttcctggtgtgggtgaacgaggaggaccacctgagagtgatcagcatgcagaagggcggcaacatgaaggaggtgttcaccagattctgcaccggcctgacccagatcgagaccctgttcaagagcaaggactacgagttcatgtggaacccccacctgggctacatcctgacctgccccagcaacctgggcaccggcctgagagccggcgtgcacatcaagctgcccaacctgggcaagcacgagaagttcagcgaggtgctgaagagactgagactgcagaagagaggcaccggcggcgtggacaccgccgccgtgggcggcgtgttcgacgtgagcaacgccgacagactgggcttcagcgaggtggagctggtgcagatggtggtggacggcgtgaagctgctgatcgagatggagcagagactggagcagggccaggccatcgacgacctgatgcccgcccagaagtag

SEQ ID NO: 77734 - DNA, 654 bp, Artificial Sequence
  Description of Artificial Sequence: Synthetic coding sequence
atgcccttcagcaacagccacaacgccctgaagctgagattccccgccgaggacgagttccccgacctgagcgcccacaacaaccacatggccaaggtgctgacccccgagctgtacgccgagctgagagccaagagcacccccagcggcttcaccctggacgacgtgatccagaccggcgtggacaaccccggccacccctacatcatgaccgtgggctgcgtggccggcgacgaggagagctacgaggtgttcaaggacctgttcgaccccatcatcgaggacagacacggcggctacaagcccagcgacgagcacaagaccgacctgaaccccgacaacctgcagggcggcgacgacctggaccccaactacgtgctgagcagcagagtgagaaccggcagaagcatcagaggcttctgcctgcccccccactgcagcagaggcgagagaagagccatcgagaagctggccgtggaggccctgagcagcctggacggcgacctggccggcagatactacgccctgaagagcatgaccgaggccgagcagcagcagctgatcgacgaccacttcctgttcgacaagcccgtgagccccctgctgctggccagcggcatggccagagactggcccgacgccagaggcatctag

SEQ ID NO: 77735 - DNA, 447 bp, Artificial Sequence
  Description of Artificial Sequence: Synthetic coding sequence
atggccggccccttcagcagactgctgagcgccagacccggcctgagactgctggccctggccggcgccggcagcctggccgccggcttcctgctgagacccgagcccgtgagagccgccagcgagagaagaagactgtacccccccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatccaggagagacacaacggctacgaccccagaaccatgaagcacaccaccgacctggacgccagcaagtag

SEQ ID NO: 77736 - DNA, 1254 bp, Artificial Sequence
  Description of Artificial Sequence: Synthetic coding sequence
atggccggccccttcagcagactgctgagcgccagacccggcctgagactgctggccctggccggcgccggcagcctggccgccggcttcctgctgagacccgagcccgtgagagccgccagcgagagaagaagactgtacccccccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatccaggagagacacaacggctacgaccccagaaccatgaagcacaccaccgacctggacgccagcaagatcagaagcggctacttcgacgagagatacgtgctgagcagcagagtgagaaccggcagaagcatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggccagagactggcccgacgccagaggcatctggcacaacaacgagaagagcttcctgatctgggtgaacgaggaggaccacaccagagtgatcagcatggagaagggcggcaacatgaagagagtgttcgagagattctgcagaggcctgaaggaggtggagagactgatccaggagagaggctgggagttcatgtggaacgagagactgggctacatcctgacctgccccagcaacctgggcaccggcctgagagccggcgtgcacatcaagctgcccctgctgagcaaggacagcagattccccaagatcctggagaacctgagactgcagaagagaggcaccggcggcgtggacaccgccgccaccggcggcgtgttcgacatcagcaacctggacagactgggcaagagcgaggtggagctggtgcagctggtgatcgacggcgtgaactacctgatcgactgcgagagaagactggagagaggccaggacatcagaatccccacccccgtgatccacaccaagcactag

SEQ ID NO: 77737 - DNA, 1347 bp, Artificial Sequence
  Description of Artificial Sequence: Synthetic coding sequence
atggccggccccttcagcagactgctgagcgccagacccggcctgagactgctggccctggccggcgccggcagcctggccgccggcttcctgctgagacccgagcccgtgagagccgccagcgagagaagaagactgtacccccccagccagacctggcccaccggccagctgcccggcaactgcaccagaagcagaagactgtgcccccccagcatggtgaccggctaccccctgcccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatccaggagagacacaacggctacgaccccagaaccatgaagcacaccaccgacctggacgccagcaagatcagaagcggctacttcgacgagagatacgtgctgagcagcagagtgagaaccggcagaagcatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggccagagactggcccgacgccagaggcatctggcacaacaacgagaagagcttcctgatctgggtgaacgaggaggaccacaccagagtgatcagcatggagaagggcggcaacatgaagagagtgttcgagagattctgcagaggcctgaaggaggtggagagactgatccaggagagaggctgggagttcatgtggaacgagagactgggctacatcctgacctgccccagcaacctgggcaccggcctgagagccggcgtgcacatcaagctgcccctgctgagcaaggacagcagattccccaagatcctggagaacctgagactgcagaagagaggcaccggcggcgtggacaccgccgccaccggcggcgtgttcgacatcagcaacctggacagactgggcaagagcgaggtggagctggtgcagctggtgatcgacggcgtgaactacctgatcgactgcgagagaagactggagagaggccaggacatcagaatccccacccccgtgatccacaccaagcactag

SEQ ID NO: 77738 - DNA, 1254 bp, Artificial Sequence; identical to SEQ ID NO: 77736
  Description of Artificial Sequence: Synthetic coding sequence

SEQ ID NO: 77739 - DNA, 765 bp, Artificial Sequence
  Description of Artificial Sequence: Synthetic coding sequence
atggccggccccttcagcagactgctgagcgccagacccggcctgagactgctggccctggccggcgccggcagcctggccgccggcttcctgctgagacccgagcccgtgagagccgccagcgagagaagaagactgtacccccccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggccagagactggcccgacgccagaggcatctggcacaacaacgagaagagcttcctgatctgggtgaacgaggaggaccacaccagagtgatcagcatggagaagggcggcaacatgaagagagtgttcgagagattctgcagaggcctgaaggaggtggtggtgggcatcaagtag

SEQ ID NO: 77740 - DNA, 1254 bp, Artificial Sequence; identical to SEQ ID NO: 77736
  Description of Artificial Sequence: Synthetic coding sequence

SEQ ID NO: 77741 - DNA, 441 bp, Artificial Sequence
  Description of Artificial Sequence: Synthetic coding sequence
atgcccgtgaaggtgagaaccggcagaagcatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggccagagactggcccgacgccagaggcatctggcacaacaacgagaagagcttcctgatctgggtgaacgaggaggaccacaccagagtgatcagcatggagaagggcggcaacatgaagagagtgttcgagagattctgcagaggcctgaaggaggtgagagaggactgcgtgggcgagctgggcggcagaacctag

SEQ ID NO: 77742 - DNA, 507 bp, Artificial Sequence
  Description of Artificial Sequence: Synthetic coding sequence
atgaagcacaccaccgacctggacgccagcaagatcagaagcggctacttcgacgagagatacgtgctgagcagcagagtgagaaccggcagaagcatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggccagagactggcccgacgccagaggcatctggcacaacaacgagaagagcttcctgatctgggtgaacgaggaggaccacaccagagtgatcagcatggagaagggcggcaacatgaagagagtgttcgagagattctgcagaggcctgaaggaggtgagagaggactacgtgggcgagctgggcggcagaacctag

SEQ ID NO: 77743 - DNA, 312 bp, Artificial Sequence
  Description of Artificial Sequence: Synthetic coding sequence
atggccggccccttcagcagactgctgagcgccagacccggcctgagactgctggccctggccggcgccggcagcctggccgccggcttcctgctgagacccgagcccgtgagagccgccagcgagagaagaagactgtacccccccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagtag

SEQ ID NO: 77744 - DNA, 390 bp, Artificial Sequence
  Description of Artificial Sequence: Synthetic coding sequence
atggccggccccttcagcagactgctgagcgccagacccggcctgagactgctggccctggccggcgccggcagcctggccgccggcttcctgctgagacccgagcccgtgagagccgccagcgagagaagaagactgtacccccccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatccaggagagatag

SEQ ID NO: 77745 - DNA, 1017 bp, Artificial Sequence
  Description of Artificial Sequence: Synthetic coding sequence
atggccggccccttcagcagactgctgagcgccagacccggcctgagactgctggccctggccggcgccggcagcctggccgccggcttctgcagcgacagaaacctgtacgagctgcccgtgaacgacggcggctgcatccccagagagcagagccagacctggcccaccggccagctgcccggcaactgcaccagaagcagaagactgtgcccccccagcatggtgaccggctaccccctgcccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatccaggagagacacaacggctacgaccccagaaccatgaagcacaccaccgacctggacgccagcaagatcagaagcggctacttcgacgagagatacgtgctgagcagcagagtgagaaccggcagaagcatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggccagagactggcccgacgccagaggcatctggcacaacaacgagaagagcttcctgatctgggtgaacgaggaggaccacaccagagtgatcagcatggagaagggcggcaacatgaagagagtgttcgagagattctgcagaggcctgaaggaggtgagagaggactacgtgggcgagctgggcggcagaacctag

SEQ ID NO: 77746 - DNA, 1254 bp, Artificial Sequence; identical to SEQ ID NO: 77736
  Description of Artificial Sequence: Synthetic coding sequence

SEQ ID NO: 77747 - DNA, 774 bp, Artificial Sequence
  Description of Artificial Sequence: Synthetic coding sequence
atggtgaccggctaccccctgcccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatccaggagagacacaacggctacgaccccagaaccatgaagcacaccaccgacctggacgccagcaagatcagaagcggctacttcgacgagagatacgtgctgagcagcagagtgagaaccggcagaagcatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggccagagactggcccgacgccagaggcatctggcacaacaacgagaagagcttcctgatctgggtgaacgaggaggaccacaccagagtgatcagcatggagaagggcggcaacatgaagagagtgttcgagagattctgcagaggcctgaaggaggtggtggtgggcatcaagtag

SEQ ID NO: 77748 - DNA, 726 bp, Artificial Sequence
  Description of Artificial Sequence: Synthetic coding sequence
atggccggccccttcagcagactgctgagcgccagacccggcctgagactgctggccctggccggcgccggcagcctggccgccggcttcctgctgagacccgagcccgtgagagccgccagcgagagaagaagactgtacccccccagcgccgagtaccccgacctgagaaagcacaacaactgcatggccagccacctgacccccgccgtgtacgccagactgtgcgacaagaccacccccaccggctggaccctggaccagtgcatccagaccggcgtggacaaccccggccaccccttcatcaagaccgtgggcatggtggccggcgacgaggagacctacgaggtgttcgccgacctgttcgaccccgtgatccaggagagacacaacggctacgaccccagaaccatgaagcacaccaccgacctggacgccagcaagatcagaagcggctacttcgacgagagatacgtgctgagcagcagagtgagaaccggcagaagcatcagaggcctgagcctgccccccgcctgcaccagagccgagagaagagaggtggagagagtggtggtggacgccctgagcggcctgaagggcgacctggccggcagatactacagactgagcgagatgaccgaggccgagcagcagcagctgatcgacgaccacttcctgttcgacaagcccgtgagccccctgctgaccgccgccggcatggcctag

SEQ ID NO: 77749 - DNA, 1260 bp, Artificial Sequence
  Description of Artificial Sequence: Synthetic coding sequence
atggccagcatcttcagcaagctgctgaccggcagaaacgccagcctgctgttcgccaccatgggcaccagcgtgctgaccaccggctacctgctgaacagacagaaggtgtgcgccgaggtgagagagcagcccagactgttcccccccagcgccgactaccccgacctgagaaagcacaacaactgcatggccgagtgcctgacccccgccatctacgccaagctgagaaacaaggtgacccccaacggctacaccctggaccagtgcatccagaccggcgtggacaaccccggccaccccttcatcaagaccgtgggcatggtggccggcgacgaggagagctacgaggtgttcgccgacctgttcgaccccgtgatcaagctgagacacaacggctacgaccccagagtgatgaagcacaccaccgacctggacgccagcaagatcacccagggccagttcgacgagcactacgtgctgagcagcagagtgagaaccggcagaagcatcagaggcctgagcctgccccccgcctgcaccagagccgagagaagagaggtggagaacgtggccatcaccgccctggagggcctgaagggcgacctggccggcagatactacaagctgagcgagatgaccgagcaggaccagcagagactgatcgacgaccacttcctgttcgacaagcccgtgagccccctgctgacctgcgccggcatggccagagactggcccgacgccagaggcatctggcacaactacgacaagaccttcctgatctggatcaacgaggaggaccacaccagagtgatcagcatggagaagggcggcaacatgaagagagtgttcgagagattctgcagaggcctgaaggaggtggagagactgatccaggagagaggctgggagttcatgtggaacgagagactgggctacatcctgacctgccccagcaacctgggcaccggcctgagagccggcgtgcacgtgagaatccccaagctgagcaaggaccccagattcagcaagatcctggagaacctgagactgcagaagagaggcaccggcggcgtggacaccgccgccgtggccgacgtgtacgacatcagcaacatcgacagaatcggcagaagcgaggtggagctggtgcagatcgtgatcgacggcgtgaactacctggtggactgcgagaagaagctggagagaggccaggacatcaaggtgcccccccccctgccccagttcggcaagaagtag

SEQ ID NO: 77750 - DNA, 1260 bp, Artificial Sequence; identical to SEQ ID NO: 77749
  Description of Artificial Sequence: Synthetic coding sequence

SEQ ID NO: 77751 - DNA, 1260 bp, Artificial Sequence; identical to SEQ ID NO: 77749
  Description of Artificial Sequence: Synthetic coding sequence

SEQ ID NO: 77752 - DNA, 513 bp, Artificial Sequence
  Description of Artificial Sequence: Synthetic coding sequence
atggccagcatcttcagcaagctgctgaccggcagaaacgccagcctgctgttcgccaccatgggcaccagcgtgctgaccaccggctacctgctgaacagacagaaggtgtgcgccgaggtgagagagcagcccagactgttcccccccagcgccgactaccccgacctgagaaagcacaacaactgcatggccgagtgcctgacccccgccatctacgccaagctgagaaacaaggtgacccccaacggctacaccctggaccagtgcatccagaccggcgtggacaaccccggccaccccttcatcaagaccgtgggcatggtggccggcgacgaggagagctacgaggtgttcgccgacctgttcgaccccgtgatcaagctgagacacaacggctacgaccccagagtgatgaagcacaccaccgacctggacgccagcaagatcacccagggccagttcgacgagcactacgtgctgagcagcagagtgagaaccggcagaagctag

SEQ ID NO: 77753 - DNA, 1098 bp, Artificial Sequence
  Description of Artificial Sequence: Synthetic coding sequence
atgggcgtgcccagaccccagccctgggccctgggcctgctgctgttcctgctgcccggcagcctgggcgccgagagccacctgagcctgctgtaccacctgaccgccgtgagcagccccgcccccggcacccccgccttctgggtgagcggctggctgggcccccagcagtacctgagctacaacagcctgagaggcgaggccgagccctgcggcgcctgggtgtgggagaaccaggtgagctggtactgggagaaggagaccaccgacctgagaatcaaggagaagctgttcctggaggccttcaaggccctgggcggcaagggcccctacaccctgcagggcctgctgggctgcgagctgggccccgacaacaccagcgtgcccaccgccaagttcgccctgaacggcgaggagttcatgaacttcgacctgaagcagggcacctggggcggcgactggcccgaggccctggccatcagccagagatggcagcagcaggacaaggccgccaacaaggagctgaccttcctgctgttcagctgcccccacagactgagagagcacctggagagaggcagaggcaacctggagtggaaggagccccccagcatgagactgaaggccagacccagcagccccggcttcagcgtgctgacctgcagcgccttcagcttctacccccccgagctgcagctgagattcctgagaaacggcctggccgccggcaccggccagggcgacttcggccccaacagcgacggcagcttccacgccagcagcagcctgaccgtgaagagcggcgacgagcaccactactgctgcatcgtgcagcacgccggcctggcccagcccctgagagtggagctggagagccccgccaagagcagcgtgctggtggtgggcatcgtgatcggcgtgctgctgctgaccgccgccgccgtgggcggcgccctgctgtggagaagaatgagaagcggcctgcccgccccctggatcagcctgagaggcgacgacaccggcgtgctgctgcccacccccggcgaggcccaggacgccgacctgaaggacgtgaacgtgatccccgccaccgcctag

SEQ ID NO: 77754 - DNA, 7329 bp, Artificial Sequence
  Description of Artificial Sequence: Synthetic coding sequence
atggccgagaacctgctggacggcccccccaaccccaagagagccaagctgagcagccccggcttcagcgccaacgacagcaccgacttcggcagcctgttcgacctggagaacgacctgcccgacgagctgatccccaacggcggcgagctgggcctgctgaacagcggcaacctggtgcccgacgccgccagcaagcacaagcagctgagcgagctgctgagaggcggcagcggcagcagcatcaaccccggcatcggcaacgtgagcgccagcagccccgtgcagcagggcctgggcggccaggcccagggccagcccaacagcgccaacatggccagcctgagcgccatgggcaagagccccctgagccagggcgacagcagcgcccccagcctgcccaagcaggccgccagcaccagcggccccacccccgccgccagccaggccctgaacccccaggcccagaagcaggtgggcctggccaccagcagccccgccaccagccagaccggccccggcatctgcatgaacgccaacttcaaccagacccaccccggcctgctgaacagcaacagcggccacagcctgatcaaccaggccagccagggccaggcccaggtgatgaacggcagcctgggcgccgccggcagaggcagaggcgccggcatgccctaccccacccccgccatgcagggcgccagcagcagcgtgctggccgagaccctgacccaggtgagcccccagatgaccggccacgccggcctgaacaccgcccaggccggcggcatggccaagatgggcatcaccggcaacaccagccccttcggccagcccttcagccaggccggcggccagcccatgggcgccaccggcgtgaacccccagctggccagcaagcagagcatggtgaacagcctgcccaccttccccaccgacatcaagaacaccagcgtgaccaacgtgcccaacatgagccagatgcagaccagcgtgggcatcgtgcccacccaggccatcgccaccggccccaccgccgaccccgagaagagaaagctgatccagcagcagctggtgctgctgctgcacgcccacaagtgccagagaagagagcaggccaacggcgaggtgagagcctgcagcctgccccactgcagaaccatgaagaacgtgctgaaccacatgacccactgccaggccggcaaggcctgccaggtggcccactgcgccagcagcagacagatcatcagccactggaagaactgcaccagacacgactgccccgtgtgcctgcccctgaagaacgccagcgacaagagaaaccagcagaccatcctgggcagccccgccagcggcatccagaacaccatcggcagcgtgggcaccggccagcagaacgccaccagcctgagcaaccccaaccccatcgaccccagcagcatgcagagagcctacgccgccctgggcctgccctacatgaaccagccccagacccagctgcagccccaggtgcccggccagcagcccgcccagccccagacccaccagcagatgagaaccctgaaccccctgggcaacaaccccatgaacatccccgccggcggcatcaccaccgaccagcagccccccaacctgatcagcgagagcgccctgcccaccagcctgggcgccaccaaccccctgatgaacgacggcagcaacagcggcaacatcggcaccctgagcaccatccccaccgccgccccccccagcagcaccggcgtgagaaagggctggcacgagcacgtgacccaggacctgagaagccacctggtgcacaagctggtgcaggccatcttccccacccccgaccccgccgccctgaaggacagaagaatggagaacctggtggcctacgccaagaaggtggagggcgacatgtacgagagcgccaacagcagagacgagtactaccacctgctggccgagaagatctacaagatccagaaggagctggaggagaagagaagaagcagactgcacaagcagggcatcctgggcaaccagcccgccctgcccgcccccggcgcccagccccccgtgatcccccaggcccagcccgtgagaccccccaacggccccctgagcctgcccgtgaacagaatgcaggtgagccagggcatgaacagcttcaaccccatgagcctgggcaacgtgcagctgccccaggcccccatgggccccagagccgccagccccatgaaccacagcgtgcagatgaacagcatgggcagcgtgcccggcatggccatcagccccagcagaatgccccagccccccaacatgatgggcgcccacaccaacaacatgatggcccaggcccccgcccagagccagttcctgccccagaaccagttccccagcagcagcggcgccatgagcgtgggcatgggccagccccccgcccagaccggcgtgagccagggccaggtgcccggcgccgccctgcccaaccccctgaacatgctgggcccccaggccagccagctgccctgcccccccgtgacccagagccccctgcaccccacccccccccccgccagcaccgccgccggcatgcccagcctgcagcacaccaccccccccggcatgacccccccccagcccgccgcccccacccagcccagcacccccgtgagcagcagcggccagacccccacccccacccccggcagcgtgcccagcgccacccagacccagagcacccccaccgtgcaggccgccgcccaggcccaggtgaccccccagccccagacccccgtgcagccccccagcgtggccaccccccagagcagccagcagcagcccacccccgtgcacgcccagccccccggcacccccctgagccaggccgccgccagcatcgacaacagagtgcccacccccagcagcgtggccagcgccgagaccaacagccagcagcccggccccgacgtgcccgtgctggagatgaagaccgagacccaggccgaggacaccgagcccgaccccggcgagagcaagggcgagcccagaagcgagatgatggaggaggacctgcagggcgccagccaggtgaaggaggagaccgacatcgccgagcagaagagcgagcccatggaggtggacgagaagaagcccgaggtgaaggtggaggtgaaggaggaggaggagagcagcagcaacggcaccgccagccagagcaccagccccagccagcccagaaagaagatcttcaagcccgaggagctgagacaggccctgatgcccaccctggaggccctgtacagacaggaccccgagagcctgcccttcagacagcccgtggacccccagctgctgggcatccccgactacttcgacatcgtgaagaaccccatggacctgagcaccatcaagagaaagctggacaccggccagtaccaggagccctggcagtacgtggacgacgtgtggctgatgttcaacaacgcctggctgtacaacagaaagaccagcagagtgtacaagttctgcagcaagctggccgaggtgttcgagcaggagatcgaccccgtgatgcagagcctgggctactgctgcggcagaaagtacgagttcagcccccagaccctgtgctgctacggcaagcagctgtgcaccatccccagagacgccgcctactacagctaccagaacagataccacttctgcgagaagtgcttcaccgagatccagggcgagaacgtgaccctgggcgacgaccccagccagccccagaccaccatcagcaaggaccagttcgagaagaagaagaacgacaccctggaccccgagcccttcgtggactgcaaggagtgcggcagaaagatgcaccagatctgcgtgctgcactacgacatcatctggcccagcggcttcgtgtgcgacaactgcctgaagaagaccggcagacccagaaaggagaacaagttcagcgccaagagactgcagaccaccagactgggcaaccacctggaggacagagtgaacaagttcctgagaagacagaaccaccccgaggccggcgaggtgttcgtgagagtggtggccagcagcgacaagaccgtggaggtgaagcccggcatgaagagcagattcgtggacagcggcgagatgagcgagagcttcccctacagaaccaaggccctgttcgccttcgaggagatcgacggcgtggacgtgtgcttcttcggcatgcacgtgcaggagtacggcagcgactgccccccccccaacaccagaagagtgtacatcagctacctggacagcatccacttcttcagacccagatgcctgagaaccgccgtgtaccacgagatcctgatcggctacctggagtacgtgaagaagctgggctacgtgaccggccacatctgggcctgcccccccagcgagggcgacgactacatcttccactgccacccccccgaccagaagatccccaagcccaagagactgcaggagtggtacaagaagatgctggacaaggccttcgccgagagaatcatccacgactacaaggacatcttcaagcaggccaccgaggacagactgaccagcgccaaggagctgccctacttcgagggcgacttctggcccaacgtgctggaggagagcatcaaggagctggagcaggaggaggaggagagaaagaaggaggagagcaccgccgccagcgagaccaccgagggcagccagggcgacagcaagaacgccaagaagaagaacaacaagaagaccaacaagaacaagagcagcatcagcagagccaacaagaagaagcccagcatgcccaacgtgagcaacgacctgagccagaagctgtacgccaccatggagaagcacaaggaggtgttcttcgtgatccacctgcacgccggccccgtgatcaacaccctgccccccatcgtggaccccgaccccctgctgagctgcgacctgatggacggcagagacgccttcctgaccctggccagagacaagcactgggagttcagcagcctgagaagaagcaagtggagcaccctgtgcatgctggtggagctgcacacccagggccaggacagattcgtgtacacctgcaacgagtgcaagcaccacgtggagaccagatggcactgcaccgtgtgcgaggactacgacctgtgcatcaactgctacaacaccaagagccacgcccacaagatggtgaagtggggcctgggcctggacgacgagggcagcagccagggcgagccccagagcaagagcccccaggagagcagaagactgagcatccagagatgcatccagagcctggtgcacgcctgccagtgcagaaacgccaactgcagcctgcccagctgccagaagatgaagagagtggtgcagcacaccaagggctgcaagagaaagaccaacggcggctgccccgtgtgcaagcagctgatcgccctgtgctgctaccacgccaagcactgccaggagaacaagtgccccgtgcccttctgcctgaacatcaagcacaagctgagacagcagcagatccagcacagactgcagcaggcccagctgatgagaagaagaatggccaccatgaacaccagaaacgtgccccagcagagcctgcccagccccaccagcgccccccccggcacccccacccagcagcccagcaccccccagaccccccagccccccgcccagccccagcccagccccgtgagcatgagccccgccggcttccccagcgtggccagaacccagccccccaccaccgtgagcaccggcaagcccaccagccaggtgcccgccccccccccccccgcccagcccccccccgccgccgtggaggccgccagacagatcgagagagaggcccagcagcagcagcacctgtacagagtgaacatcaacaacagcatgccccccggcagaaccggcatgggcacccccggcagccagatggcccccgtgagcctgaacgtgcccagacccaaccaggtgagcggccccgtgatgcccagcatgccccccggccagtggcagcaggcccccctgccccagcagcagcccatgcccggcctgcccagacccgtgatcagcatgcaggcccaggccgccgtggccggccccagaatgcccagcgtgcagccccccagaagcatcagccccagcgccctgcaggacctgctgagaaccctgaagagccccagcagcccccagcagcagcagcaggtgctgaacatcctgaagagcaacccccagctgatggccgccttcatcaagcagagaaccgccaagtacgtggccaaccagcccggcatgcagccccagcccggcctgcagagccagcccggcatgcagccccagcccggcatgcaccagcagcccagcctgcagaacctgaacgccatgcaggccggcgtgcccagacccggcgtgcccccccagcagcaggccatgggcggcctgaacccccagggccaggccctgaacatcatgaaccccggccacaaccccaacatggccagcatgaacccccagtacagagagatgctgagaagacagctgctgcagcagcagcagcagcagcagcagcagcagcagcagcagcagcagcagcagcagggcagcgccggcatggccggcggcatggccggccacggccagttccagcagccccagggccccggcggctacccccccgccatgcagcagcagcagagaatgcagcagcacctgcccctgcagggcagcagcatgggccagatggccgcccagatgggccagctgggccagatgggccagcccggcctgggcgccgacagcacccccaacatccagcaggccctgcagcagagaatcctgcagcagcagcagatgaagcagcagatcggcagccccggccagcccaaccccatgagcccccagcagcacatgctgagcggccagccccaggccagccacctgcccggccagcagatcgccaccagcctgagcaaccaggtgagaagccccgcccccgtgcagagccccagaccccagagccagcccccccacagcagccccagccccagaatccagccccagcccagcccccaccacgtgagcccccagaccggcagcccccaccccggcctggccgtgaccatggccagcagcatcgaccagggccacctgggcaaccccgagcagagcgccatgctgccccagctgaacacccccagcagaagcgccctgagcagcgagctgagcctggtgggcgacaccaccggcgacaccctggagaagttcgtggagggcctgtag

SEQ ID NO: 77755 - DNA, 2934 bp, Artificial Sequence
  Description of Artificial Sequence: Synthetic coding sequence
atgcacgtgcaggagtacggcagcgactgccccccccccaacaccagaagagtgtacatcagctacctggacagcatccacttcttcagacccagatgcctgagaaccgccgtgtaccacgagatcctgatcggctacctggagtacgtgaagaagctgggctacgtgaccggccacatctgggcctgcccccccagcgagggcgacgactacatcttccactgccacccccccgaccagaagatccccaagcccaagagactgcaggagtggtacaagaagatgctggacaaggccttcgccgagagaatcatccacgactacaaggacatcttcaagcaggccaccgaggacagactgaccagcgccaaggagctgccctacttcgagggcgacttctggcccaacgtgctggaggagagcatcaaggagctggagcaggaggaggaggagagaaagaaggaggagagcaccgccgccagcgagaccaccgaggtgttcttcgtgatccacctgcacgccggccccgtgatcaacaccctgccccccatcgtggaccccgaccccctgctgagctgcgacctgatggacggcagagacgccttcctgaccctggccagagacaagcactgggagttcagcagcctgagaagaagcaagtggagcaccctgtgcatgctggtggagctgcacacccagggccaggacagattcgtgtacacctgcaacgagtgcaagcaccacgtggagaccagatggcactgcaccgtgtgcgaggactacgacctgtgcatcaactgctacaacaccaagagccacgcccacaagatggtgaagtggggcctgggcctggacgacgagggcagcagccagggcgagccccagagcaagagcccccaggagagcagaagactgagcatccagagatgcatccagagcctggtgcacgcctgccagtgcagaaacgccaactgcagcctgcccagctgccagaagatgaagagagtggtgcagcacaccaagggctgcaagagaaagaccaacggcggctgccccgtgtgcaagcagctgatcgccctgtgctgctaccacgccaagcactgccaggagaacaagtgccccgtgcccttctgcctgaacatcaagcacaagctgagacagcagcagatccagcacagactgcagcaggcccagctgatgagaagaagaatggccaccatgaacaccagaaacgtgccccagcagagcctgcccagccccaccagcgccccccccggcacccccacccagcagcccagcaccccccagaccccccagccccccgcccagccccagcccagccccgtgagcatgagccccgccggcttccccagcgtggccagaacccagccccccaccaccgtgagcaccggcaagcccaccagccaggtgcccgccccccccccccccgcccagcccccccccgccgccgtggaggccgccagacagatcgagagagaggcccagcagcagcagcacctgtacagagtgaacatcaacaacagcatgccccccggcagaaccggcatgggcacccccggcagccagatggcccccgtgagcctgaacgtgcccagacccaaccaggtgagcggccccgtgatgcccagcatgccccccggccagtggcagcaggcccccctgccccagcagcagcccatgcccggcctgcccagacccgtgatcagcatgcaggcccaggccgccgtggccggccccagaatgcccagcgtgcagccccccagaagcatcagccccagcgccctgcaggacctgctgagaaccctgaagagccccagcagcccccagcagcagcagcaggtgctgaacatcctgaagagcaacccccagctgatggccgccttcatcaagcagagaaccgccaagtacgtggccaaccagcccggcatgcagccccagcccggcctgcagagccagcccggcatgcagccccagcccggcatgcaccagcagcccagcctgcagaacctgaacgccatgcaggccggcgtgcccagacccggcgtgcccccccagcagcaggccatgggcggcctgaacccccagggccaggccctgaacatcatgaaccccggccacaaccccaacatggccagcatgaacccccagtacagagagatgctgagaagacagctgctgcagcagcagcagcagcagcagcagcagcagcagcagcagcagcagcagcagcagggcagcgccggcatggccggcggcatggccggccacggccagttccagcagccccagggccccggcggctacccccccgccatgcagcagcagcagagaatgcagcagcacctgcccctgcagggcagcagcatgggccagatggccgcccagatgggccagctgggccagatgggccagcccggcctgggcgccgacagcacccccaacatccagcaggccctgcagcagagaatcctgcagcagcagcagatgaagcagcagatcggcagccccggccagcccaaccccatgagcccccagcagcacatgctgagcggccagccccaggccagccacctgcccggccagcagatcgccaccagcctgagcaaccaggtgagaagccccgcccccgtgcagagccccagaccccagagccagcccccccacagcagccccagccccagaatccagccccagcccagcccccaccacgtgagcccccagaccggcagcccccaccccggcctggccgtgaccatggccagcagcatcgaccagggccacctgggcaaccccgagcagagcgccatgctgccccagctgaacacccccagcagaagcgccctgagcagcgagctgagcctggtgggcgacaccaccggcgacaccctggagaagttcgtggagggcctgtag

SEQ ID NO: 77756 - DNA, 7215 bp, Artificial Sequence
  Description of Artificial Sequence: Synthetic coding sequence
atggccgagaacctgctggacggcccccccaaccccaagagagccaagctgagcagccccggcttcagcgccaacgacagcaccgacttcggcagcctgttcgacctggagaacgacctgcccgacgagctgatccccaacggcggcgagctgggcctgctgaacagcggcaacctggtgcccgacgccgccagcaagcacaagcagctgagcgagctgctgagaggcggcagcggcagcagcatcaaccccggcatcggcaacgtgagcgccagcagccccgtgcagcagggcctgggcggccaggcccagggccagcccaacagcgccaacatggccagcctgagcgccatgggcaagagccccctgagccagggcgacagcagcgcccccagcctgcccaagcaggccgccagcaccagcggccccacccccgccgccagccaggccctgaacccccaggcccagaagcaggtgggcctggccaccagcagccccgccaccagccagaccggccccggcatctgcatgaacgccaacttcaaccagacccaccccggcctgctgaacagcaacagcggccacagcctgatcaaccaggccagccagggccaggcccaggtgatgaacggcagcctgggcgccgccggcagaggcagaggcgccggcatgccctaccccacccccgccatgcagggcgccagcagcagcgtgctggccgagaccctgacccaggtgagcccccagatgaccggccacgccggcctgaacaccgcccaggccggcggcatggccaagatgggcatcaccggcaacaccagccccttcggccagcccttcagccaggccggcggccagcccatgggcgccaccggcgtgaacccccagctggccagcaagcagagcatggtgaacagcctgcccaccttccccaccgacatcaagaacaccagcgtgaccaacgtgcccaacatgagccagatgcagaccagcgtgggcatcgtgcccacccaggccatcgccaccggccccaccgccgaccccgagaagagaaagctgatccagcagcagctggtgctgctgctgcacgcccacaagtgccagagaagagagcaggccaacggcgaggtgagagcctgcagcctgccccactgcagaaccatgaagaacgtgctgaaccacatgacccactgccaggccggcaaggcctgccaggccatcctgggcagccccgccagcggcatccagaacaccatcggcagcgtgggcaccggccagcagaacgccaccagcctgagcaaccccaaccccatcgaccccagcagcatgcagagagcctacgccgccctgggcctgccctacatgaaccagccccagacccagctgcagccccaggtgcccggccagcagcccgcccagccccagacccaccagcagatgagaaccctgaaccccctgggcaacaaccccatgaacatccccgccggcggcatcaccaccgaccagcagccccccaacctgatcagcgagagcgccctgcccaccagcctgggcgccaccaaccccctgatgaacgacggcagcaacagcggcaacatcggcaccctgagcaccatccccaccgccgccccccccagcagcaccggcgtgagaaagggctggcacgagcacgtgacccaggacctgagaagccacctggtgcacaagctggtgcaggccatcttccccacccccgaccccgccgccctgaaggacagaagaatggagaacctggtggcctacgccaagaaggtggagggcgacatgtacgagagcgccaacagcagagacgagtactaccacctgctggccgagaagatctacaagatccagaaggagctggaggagaagagaagaagcagactgcacaagcagggcatcctgggcaaccagcccgccctgcccgcccccggcgcccagccccccgtgatcccccaggcccagcccgtgagaccccccaacggccccctgagcctgcccgtgaacagaatgcaggtgagccagggcatgaacagcttcaaccccatgagcctgggcaacgtgcagctgccccaggcccccatgggccccagagccgccagccccatgaaccacagcgtgcagatgaacagcatgggcagcgtgcccggcatggccatcagccccagcagaatgccccagccccccaacatgatgggcgcccacaccaacaacatgatggcccaggcccccgcccagagccagttcctgccccagaaccagttccccagcagcagcggcgccatgagcgtgggcatgggccagccccccgcccagaccggcgtgagccagggccaggtgcccggcgccgccctgcccaaccccctgaacatgctgggcccccaggccagccagctgccctgcccccccgtgacccagagccccctgcaccccacccccccccccgccagcaccgccgccggcatgcccagcctgcagcacaccaccccccccggcatgacccccccccagcccgccgcccccacccagcccagcacccccgtgagcagcagcggccagacccccacccccacccccggcagcgtgcccagcgccacccagacccagagcacccccaccgtgcaggccgccgcccaggcccaggtgaccccccagccccagacccccgtgcagccccccagcgtggccaccccccagagcagccagcagcagcccacccccgtgcacgcccagccccccggcacccccctgagccaggccgccgccagcatcgacaacagagtgcccacccccagcagcgtggccagcgccgagaccaacagccagcagcccggccccgacgtgcccgtgctggagatgaagaccgagacccaggccgaggacaccgagcccgaccccggcgagagcaagggcgagcccagaagcgagatgatggaggaggacctgcagggcgccagccaggtgaaggaggagaccgacatcgccgagcagaagagcgagcccatggaggtggacgagaagaagcccgaggtgaaggtggaggtgaaggaggaggaggagagcagcagcaacggcaccgccagccagagcaccagccccagccagcccagaaagaagatcttcaagcccgaggagctgagacaggccctgatgcccaccctggaggccctgtacagacaggaccccgagagcctgcccttcagacagcccgtggacccccagctgctgggcatccccgactacttcgacatcgtgaagaaccccatggacctgagcaccatcaagagaaagctggacaccggccagtaccaggagccctggcagtacgtggacgacgtgtggctgatgttcaacaacgcctggctgtacaacagaaagaccagcagagtgtacaagttctgcagcaagctggccgaggtgttcgagcaggagatcgaccccgtgatgcagagcctgggctactgctgcggcagaaagtacgagttcagcccccagaccctgtgctgctacggcaagcagctgtgcaccatccccagagacgccgcctactacagctaccagaacagataccacttctgcgagaagtgcttcaccgagatccagggcgagaacgtgaccctgggcgacgaccccagccagccccagaccaccatcagcaaggaccagttcgagaagaagaagaacgacaccctggaccccgagcccttcgtggactgcaaggagtgcggcagaaagatgcaccagatctgcgtgctgcactacgacatcatctggcccagcggcttcgtgtgcgacaactgcctgaagaagaccggcagacccagaaaggagaacaagttcagcgccaagagactgcagaccaccagactgggcaaccacctggaggacagagtgaacaagttcctgagaagacagaaccaccccgaggccggcgaggtgttcgtgagagtggtggccagcagcgacaagaccgtggaggtgaagcccggcatgaagagcagattcgtggacagcggcgagatgagcgagagcttcccctacagaaccaaggccctgttcgccttcgaggagatcgacggcgtggacgtgtgcttcttcggcatgcacgtgcaggagtacggcagcgactgccccccccccaacaccagaagagtgtacatcagctacctggacagcatccacttcttcagacccagatgcctgagaaccgccgtgtaccacgagatcctgatcggctacctggagtacgtgaagaagctgggctacgtgaccggccacatctgggcctgcccccccagcgagggcgacgactacatcttccactgccacccccccgaccagaagatccccaagcccaagagactgcaggagtggtacaagaagatgctggacaaggccttcgccgagagaatcatccacgactacaaggacatcttcaagcaggccaccgaggacagactgaccagcgccaaggagctgccctacttcgagggcgacttctggcccaacgtgctggaggagagcatcaaggagctggagcaggaggaggaggagagaaagaaggaggagagcaccgccgccagcgagaccaccgagggcagccagggcgacagcaagaacgccaagaagaagaacaacaagaagaccaacaagaacaagagcagcatcagcagagccaacaagaagaagcccagcatgcccaacgtgagcaacgacctgagccagaagctgtacgccaccatggagaagcacaaggaggtgttcttcgtgatccacctgcacgccggccccgtgatcaacaccctgccccccatcgtggaccccgaccccctgctgagctgcgacctgatggacggcagagacgccttcctgaccctggccagagacaagcactgggagttcagcagcctgagaagaagcaagtggagcaccctgtgcatgctggtggagctgcacacccagggccaggacagattcgtgtacacctgcaacgagtgcaagcaccacgtggagaccagatggcactgcaccgtgtgcgaggactacgacctgtgcatcaactgctacaacaccaagagccacgcccacaagatggtgaagtggggcctgggcctggacgacgagggcagcagccagggcgagccccagagcaagagcccccaggagagcagaagactgagcatccagagatgcatccagagcctggtgcacgcctgccagtgcagaaacgccaactgcagcctgcccagctgccagaagatgaagagagtggtgcagcacaccaagggctgcaagagaaagaccaacggcggctgccccgtgtgcaagcagctgatcgccctgtgctgctaccacgccaagcactgccaggagaacaagtgccccgtgcccttctgcctgaacatcaagcacaagctgagacagcagcagatccagcacagactgcagcaggcccagctgatgagaagaagaatggccaccatgaacaccagaaacgtgccccagcagagcctgcccagccccaccagcgccccccccggcacccccacccagcagcccagcaccccccagaccccccagccccccgcccagccccagcccagccccgtgagcatgagccccgccggcttccccagcgtggccagaacccagccccccaccaccgtgagcaccggcaagcccaccagccaggtgcccgccccccccccccccgcccagcccccccccgccgccgtggaggccgccagacagatcgagagagaggcccagcagcagcagcacctgtacagagtgaacatcaacaacagcatgccccccggcagaaccggcatgggcacccccggcagccagatggcccccgtgagcctgaacgtgcccagacccaaccaggtgagcggccccgtgatgcccagcatgccccccggccagtggcagcaggcccccctgccccagcagcagcccatgcccggcctgcccagacccgtgatcagcatgcaggcccaggccgccgtggccggccccagaatgcccagcgtgcagccccccagaagcatcagccccagcgccctgcaggacctgctgagaaccctgaagagccccagcagcccccagcagcagcagcaggtgctgaacatcctgaagagcaacccccagctgatggccgccttcatcaagcagagaaccgccaagtacgtggccaaccagcccggcatgcagccccagcccggcctgcagagccagcccggcatgcagccccagcccggcatgcaccagcagcccagcctgcagaacctgaacgccatgcaggccggcgtgcccagacccggcgtgcccccccagcagcaggccatgggcggcctgaacccccagggccaggccctgaacatcatgaaccccggccacaaccccaacatggccagcatgaacccccagtacagagagatgctgagaagacagctgctgcagcagcagcagcagcagcagcagcagcagcagcagcagcagcagcagcagcagggcagcgccggcatggccggcggcatggccggccacggccagttccagcagccccagggccccggcggctacccccccgccatgcagcagcagcagagaatgcagcagcacctgcccctgcagggcagcagcatgggccagatggccgcccagatgggccagctgggccagatgggccagcccggcctgggcgccgacagcacccccaacatccagcaggccctgcagcagagaatcctgcagcagcagcagatgaagcagcagatcggcagccccggccagcccaaccccatgagcccccagcagcacatgctgagcggccagccccaggccagccacctgcccggccagcagatcgccaccagcctgagcaaccaggtgagaagccccgcccccgtgcagagccccagaccccagagccagcccccccacagcagccccagccccagaatccagccccagcccagcccccaccacgtgagcccccagaccggcagcccccaccccggcctggccgtgaccatggccagcagcatcgaccagggccacctgggcaaccccgagcagagcgccatgctgccccagctgaacacccccagcagaagcgccctgagcagcgagctgagcctggtgggcgacaccaccggcgacaccctggagaagttcgtggagggcctgtag

SEQ ID NO: 77757 - DNA, 7419 bp, Artificial Sequence
  Description of Artificial Sequence: Synthetic coding sequence
ctgagaggcgccgtggccgtggccgagatctggccccccccccccccccccggcctgagaccccccagccccagcgcccccgccagacccctggccgccagagccagaagcagccccagccagcccgccggcccccccacccccgtgagagccctggccggccccgccgccagagccagaggctgcttcagagagcaggtgaagatggccgagaacctgctggacggcccccccaaccccaagagagccaagctgagcagccccggcttcagcgccaacgacagcaccgacttcggcagcctgttcgacctggagaacgacctgcccgacgagctgatccccaacggcggcgagctgggcctgctgaacagcggcaacctggtgcccgacgccgccagcaagcacaagcagctgagcgagctgctgagaggcggcagcggcagcagcatcaaccccggcatcggcaacgtgagcgccagcagccccgtgcagcagggcctgggcggccaggcccagggccagcccaacagcgccaacatggccagcctgagcgccatgggcaagagccccctgagccagggcgacagcagcgcccccagcctgcccaagcaggccgccagcaccagcggccccacccccgccgccagccaggccctgaacccccaggcccagaagcaggtgggcctggccaccagcagccccgccaccagccagaccggccccggcatctgcatgaacgccaacttcaaccagacccaccccggcctgctgaacagcaacagcggccacagcctgatcaaccaggccagccagggccaggcccaggtgatgaacggcagcctgggcgccgccggcagaggcagaggcgccggcatgccctaccccacccccgccatgcagggcgccagcagcagcgtgctggccgagaccctgacccaggtgagcccccagatgaccggccacgccggcctgaacaccgcccaggccggcggcatggccaagatgggcatcaccggcaacaccagccccttcggccagcccttcagccaggccggcggccagcccatgggcgccaccggcgtgaacccccagctggccagcaagcagagcatggtgaacagcctgcccaccttccccaccgacatcaagaacaccagcgtgaccaacgtgcccaacatgagccagatgcagaccagcgtgggcatcgtgcccacccaggccatcgccaccggccccaccgccgaccccgagaagagaaagctgatccagcagcagctggtgctgctgctgcacgcccacaagtgccagagaagagagcaggccaacggcgaggtgagagcctgcagcctgccccactgcagaaccatgaagaacgtgctgaaccacatgacccactgccaggccggcaaggcctgccaggccatcctgggcagccccgccagcggcatccagaacaccatcggcagcgtgggcaccggccagcagaacgccaccagcctgagcaaccccaaccccatcgaccccagcagcatgcagagagcctacgccgccctgggcctgccctacatgaaccagccccagacccagctgcagccccaggtgcccggccagcagcccgcccagccccagacccaccagcagatgagaaccctgaaccccctgggcaacaaccccatgaacatccccgccggcggcatcaccaccgaccagcagccccccaacctgatcagcgagagcgccctgcccaccagcctgggcgccaccaaccccctgatgaacgacggcagcaacagcggcaacatcggcaccctgagcaccatccccaccgccgccccccccagcagcaccggcgtgagaaagggctggcacgagcacgtgacccaggacctgagaagccacctggtgcacaagctggtgcaggccatcttccccacccccgaccccgccgccctgaaggacagaagaatggagaacctggtggcctacgccaagaaggtggagggcgacatgtacgagagcgccaacagcagagacgagtactaccacctgctggccgagaagatctacaagatccagaaggagctggaggagaagagaagaagcagactgcacaagcagggcatcctgggcaaccagcccgccctgcccgcccccggcgcccagccccccgtgatcccccaggcccagcccgtgagaccccccaacggccccctgagcctgcccgtgaacagaatgcaggtgagccagggcatgaacagcttcaaccccatgagcctgggcaacgtgcagctgccccaggcccccatgggccccagagccgccagccccatgaaccacagcgtgcagatgaacagcatgggcagcgtgcccggcatggccatcagccccagcagaatgccccagccccccaacatgatgggcgcccacaccaacaacatgatggcccaggcccccgcccagagccagttcctgccccagaaccagttccccagcagcagcggcgccatgagcgtgggcatgggccagccccccgcccagaccggcgtgagccagggccaggtgcccggcgccgccctgcccaaccccctgaacatgctgggcccccaggccagccagctgccctgcccccccgtgacccagagccccctgcaccccacccccccccccgccagcaccgccgccggcatgcccagcctgcagcacaccaccccccccggcatgacccccccccagcccgccgcccccacccagcccagcacccccgtgagcagcagcggccagacccccacccccacccccggcagcgtgcccagcgccacccagacccagagcacccccaccgtgcaggccgccgcccaggcccaggtgaccccccagccccagacccccgtgcagccccccagcgtggccaccccccagagcagccagcagcagcccacccccgtgcacgcccagccccccggcacccccctgagccaggccgccgccagcatcgacaacagagtgcccacccccagcagcgtggccagcgccgagaccaacagccagcagcccggccccgacgtgcccgtgctggagatgaagaccgagacccaggccgaggacaccgagcccgaccccggcgagagcaagggcgagcccagaagcgagatgatggaggaggacctgcagggcgccagccaggtgaaggaggagaccgacatcgccgagcagaagagcgagcccatggaggtggacgagaagaagcccgaggtgaaggtggaggtgaaggaggaggaggagagcagcagcaacggcaccgccagccagagcaccagccccagccagcccagaaagaagatcttcaagcccgaggagctgagacaggccctgatgcccaccctggaggccctgtacagacaggaccccgagagcctgcccttcagacagcccgtggacccccagctgctgggcatccccgactacttcgacatcgtgaagaaccccatggacctgagcaccatcaagagaaagctggacaccggccagtaccaggagccctggcagtacgtggacgacgtgtggctgatgttcaacaacgcctggctgtacaacagaaagaccagcagagtgtacaagttctgcagcaagctggccgaggtgttcgagcaggagatcgaccccgtgatgcagagcctgggctactgctgcggcagaaagtacgagttcagcccccagaccctgtgctgctacggcaagcagctgtgcaccatccccagagacgccgcctactacagctaccagaacagataccacttctgcgagaagtgcttcaccgagatccagggcgagaacgtgaccctgggcgacgaccccagccagccccagaccaccatcagcaaggaccagttcgagaagaagaagaacgacaccctggaccccgagcccttcgtggactgcaaggagtgcggcagaaagatgcaccagatctgcgtgctgcactacgacatcatctggcccagcggcttcgtgtgcgacaactgcctgaagaagaccggcagacccagaaaggagaacaagttcagcgccaagagactgcagaccaccagactgggcaaccacctggaggacagagtgaacaagttcctgagaagacagaaccaccccgaggccggcgaggtgttcgtgagagtggtggccagcagcgacaagaccgtggaggtgaagcccggcatgaagagcagattcgtggacagcggcgagatgagcgagagcttcccctacagaaccaaggccctgttcgccttcgaggagatcgacggcgtggacgtgtgcttcttcggcatgcacgtgcaggagtacggcagcgactgccccccccccaacaccagaagagtgtacatcagctacctggacagcatccacttcttcagacccagatgcctgagaaccgccgtgtaccacgagatcctgatcggctacctggagtacgtgaagaagctgggctacgtgaccggccacatctgggcctgcccccccagcgagggcgacgactacatcttccactgccacccccccgaccagaagatccccaagcccaagagactgcaggagtggtacaagaagatgctggacaaggccttcgccgagagaatcatccacgactacaaggacatcttcaagcaggccaccgaggacagactgaccagcgccaaggagctgccctacttcgagggcgacttctggcccaacgtgctggaggagagcatcaaggagctggagcaggaggaggaggagagaaagaaggaggagagcaccgccgccagcgagaccaccgagggcagccagggcgacagcaagaacgccaagaagaagaacaacaagaagaccaacaagaacaagagcagcatcagcagagccaacaagaagaagcccagcatgcccaacgtgagcaacgacctgagccagaagctgtacgccaccatggagaagcacaaggaggtgttcttcgtgatccacctgcacgccggccccgtgatcaacaccctgccccccatcgtggaccccgaccccctgctgagctgcgacctgatggacggcagagacgccttcctgaccctggccagagacaagcactgggagttcagcagcctgagaagaagcaagtggagcaccctgtgcatgctggtggagctgcacacccagggccaggacagattcgtgtacacctgcaacgagtgcaagcaccacgtggagaccagatggcactgcaccgtgtgcgaggactacgacctgtgcatcaactgctacaacaccaagagccacgcccacaagatggtgaagtggggcctgggcctggacgacgagggcagcagccagggcgagccccagagcaagagcccccaggagagcagaagactgagcatccagagatgcatccagagcctggtgcacgcctgccagtgcagaaacgccaactgcagcctgcccagctgccagaagatgaagagagtggtgcagcacaccaagggctgcaagagaaagaccaacggcggctgccccgtgtgcaagcagctgatcgccctgtgctgctaccacgccaagcactgccaggagaacaagtgccccgtgcccttctgcctgaacatcaagcacaagctgagacagcagcagatccagcacagactgcagcaggcccagctgatgagaagaagaatggccaccatgaacaccagaaacgtgccccagcagagcctgcccagccccaccagcgccccccccggcacccccacccagcagcccagcaccccccagaccccccagccccccgcccagccccagcccagccccgtgagcatgagccccgccggcttccccagcgtggccagaacccagccccccaccaccgtgagcaccggcaagcccaccagccaggtgcccgccccccccccccccgcccagcccccccccgccgccgtggaggccgccagacagatcgagagagaggcccagcagcagcagcacctgtacagagtgaacatcaacaacagcatgccccccggcagaaccggcatgggcacccccggcagccagatggcccccgtgagcctgaacgtgcccagacccaaccaggtgagcggccccgtgatgcccagcatgccccccggccagtggcagcaggcccccctgccccagcagcagcccatgcccggcctgcccagacccgtgatcagcatgcaggcccaggccgccgtggccggccccagaatgcccagcgtgcagccccccagaagcatcagccccagcgccctgcaggacctgctgagaaccctgaagagccccagcagcccccagcagcagcagcaggtgctgaacatcctgaagagcaacccccagctgatggccgccttcatcaagcagagaaccgccaagtacgtggccaaccagcccggcatgcagccccagcccggcctgcagagccagcccggcatgcagccccagcccggcatgcaccagcagcccagcctgcagaacctgaacgccatgcaggccggcgtgcccagacccggcgtgcccccccagcagcaggccatgggcggcctgaacccccagggccaggccctgaacatcatgaaccccggccacaaccccaacatggccagcatgaacccccagtacagagagatgctgagaagacagctgctgcagcagcagcagcagcagcagcagcagcagcagcagcagcagcagcagcagcagggcagcgccggcatggccggcggcatggccggccacggccagttccagcagccccagggccccggcggctacccccccgccatgcagcagcagcagagaatgcagcagcacctgcccctgcagggcagcagcatgggccagatggccgcccagatgggccagctgggccagatgggccagcccggcctgggcgccgacagcacccccaacatccagcaggccctgcagcagagaatcctgcagcagcagcagatgaagcagcagatcggcagccccggccagcccaaccccatgagcccccagcagcacatgctgagcggccagccccaggccagccacctgcccggccagcagatcgccaccagcctgagcaaccaggtgagaagccccgcccccgtgcagagccccagaccccagagccagcccccccacagcagccccagccccagaatccagccccagcccagcccccaccacgtgagcccccagaccggcagcccccaccccggcctggccgtgaccatggccagcagcatcgaccagggccacctgggcaaccccgagcagagcgccatgctgccccagctgaacacccccagcagaagcgccctgagcagcgagctgagcctggtgggcgacaccaccggcgacaccctggagaagttcgtggagggcctgtag

SEQ ID NO: 77758 - DNA, 1782 bp, Artificial Sequence
  Description of Artificial Sequence: Synthetic coding sequence
atggccaccagcaacaaccccagaaagttcagcgagaagatcgccctgcacaaccagaagcaggccgaggagaccgccgccttcgaggaggtgatgaaggacctgagcctgaccagagccgccagactgcagctgcagaagagccagtacctgcagctgggccccagcagaggccagtactacggcggcagcctgcccaacgtgaaccagatcggcagcggcaccatggacctgcccttccagacccccttccagagcagcggcctggacaccagcagaaccaccagacaccacggcctggtggacagagtgtacagagagagaggcagactgggcagcccccacagaagacccctgagcgtggacaagcacggcagacaggccgacagctgcccctacggcaccatgtacctgagcccccccgccgacaccagctggagaagaaccaacagcgacagcgccctgcaccagagcaccatgacccccacccagcccgagagcttcagcagcggcagccaggacgtgcaccagaagagagtgctgctgctgaccgtgcccggcatggaggagaccaccagcgaggccgacaagaacctgagcaagcaggcctgggacaccaagaagaccggcagcagacccaagagctgcgaggtgcccggcatcaacatcttccccagcgccgaccaggagaacaccaccgccctgatccccgccacccacaacaccggcggcagcctgcccgacctgaccaacatccacttccccagccccctgcccacccccctggaccccgaggagcccaccttccccgccctgagcagcagcagcagcaccggcaacctggccgccaacctgacccacctgggcatcggcggcgccggccagggcatgagcacccccggcagcagcccccagcacagacccgccggcgtgagccccctgagcctgagcaccgaggccagaagacagcaggccagccccaccctgagccccctgagccccatcacccaggccgtggccatggacgccctgagcctggagcagcagctgccctacgccttcttcacccaggccggcagccagcagccccccccccagccccagcccccccccccccccccccccgccagccagcagccccccccccccccccccccccaggcccccgtgagactgccccccggcggccccctgctgcccagcgccagcctgaccagaggcccccagcccccccccctggccgtgaccgtgcccagcagcctgccccagagcccccccgagaaccccggccagcccagcatgggcatcgacatcgccagcgcccccgccctgcagcagtacagaaccagcgccggcagccccgccaaccagagccccaccagccccgtgagcaaccagggcttcagccccggcagcagcccccagctggagcagttcaacatgatggagaacgccatcagcagcagcagcctgtacagccccggcagcaccctgaactacagccaggccgccatgatgggcctgaccggcagccacggcagcctgcccgacagccagcagctgggctacgccagccacagcggcatccccaacatcatcctgaccgtgaccggcgagagcccccccagcctgagcaaggagctgaccagccacagaggccacctgcccgacggcccccccgtgagcggccacgccggcaccctgcccctgagcagacccgacggcgccagccccgccagaggcagaccctgcagcgtgcccagacagagacccagcctgtag

SEQ ID NO: 77759 - DNA, 1905 bp, Artificial Sequence
  Description of Artificial Sequence: Synthetic coding sequence
atggccaccagcaacaaccccagaaagttcagcgagaagatcgccctgcacaaccagaagcaggccgaggagaccgccgccttcgaggaggtgatgaaggacctgagcctgaccagagccgccagactgcagctgcagaagagccagtacctgcagctgggccccagcagaggccagtactacggcggcagcctgcccaacgtgaaccagatcggcagcggcaccatggacctgcccttccagacccccttccagagcagcggcctggacaccagcagaaccaccagacaccacggcctggtggacagagtgtacagagagagaggcagactgggcagcccccacagaagacccctgagcgtggacaagcacggcagacaggccgacagctgcccctacggcaccatgtacctgagcccccccgccgacaccagctggagaagaaccaacagcgacagcgccctgcaccagagcaccatgacccccacccagcccgagagcttcagcagcggcagccaggacgtgcaccagaagagagtgctgctgctgaccgtgcccggcatggaggagaccaccagcgaggccgacaagaacctgagcaagcaggcctgggacaccaagaagaccggcagcagacccaagagctgcgaggtgcccggcatcaacatcttccccagcgccgaccaggagaacaccaccgccctgatccccgccacccacaacaccggcggcagcctgcccgacctgaccaacatccacttccccagccccctgcccacccccctggaccccgaggagcccaccttccccgccctgagcagcagcagcagcaccggcaacctggccgccaacctgacccacctgggcatcggcggcgccggccagggcatgagcacccccggcagcagcccccagcacagacccgccggcgtgagccccctgagcctgagcaccgaggccagaagacagcaggccagccccaccctgagccccctgagccccatcacccaggccgtggccatggacgccctgagcctggagcagcagctgccctacgccttcttcacccaggccggcagccagcagccccccccccagccccagcccccccccccccccccccccgccagccagcagccccccccccccccccccccccaggcccccgtgagactgccccccggcggccccctgctgcccagcgccagcctgaccagaggcccccagcccccccccctggccgtgaccgtgcccagcagcctgccccagagcccccccgagaaccccggccagcccagcatgggcatcgacatcgccagcgcccccgccctgcagcagtacagaaccagcgccggcagccccgccaaccagagccccaccagccccgtgagcaaccagggcttcagccccggcagcagcccccagcacaccagcaccctgggcagcgtgttcggcgacgcctactacgagcagcagatggccgccagacaggccaacgccctgagccaccagctggagcagttcaacatgatggagaacgccatcagcagcagcagcctgtacagccccggcagcaccctgaactacagccaggccgccatgatgggcctgaccggcagccacggcagcctgcccgacagccagcagctgggctacgccagccacagcggcatccccaacatcatcctgaccgtgaccggcgagagcccccccagcctgagcaaggagctgaccagcagcctggccggcgtgggcgacgtgagcttcgacagcgacagccagttccccctggacgagctgaagatcgaccccctgaccctggacggcctgcacatgctgaacgaccccgacatggtgctggccgaccccgccaccgaggacaccttcagaatggacagactgtag

SEQ ID NO: 77760 - DNA, 1953 bp, Artificial Sequence
  Description of Artificial Sequence: Synthetic coding sequence
atggccaccagcaacaaccccagaaagttcagcgagaagatcgccctgcacaaccagaagcaggccgaggagaccgccgccttcgaggaggtgatgaaggacctgagcctgaccagagccgccagactgcagctgcagaagagccagtacctgcagctgggccccagcagaggccagtactacggcggcagcctgcccaacgtgaaccagatcggcagcggcaccatggacctgcccttccagcccagcggcttcctgggcgaggccctggccgccgcccccgtgagcctgacccccttccagagcagcggcctggacaccagcagaaccaccagacaccacggcctggtggacagagtgtacagagagagaggcagactgggcagcccccacagaagacccctgagcgtggacaagcacggcagacaggccgacagctgcccctacggcaccatgtacctgagcccccccgccgacaccagctggagaagaaccaacagcgacagcgccctgcaccagagcaccatgacccccacccagcccgagagcttcagcagcggcagccaggacgtgcaccagaagagagtgctgctgctgaccgtgcccggcatggaggagaccaccagcgaggccgacaagaacctgagcaagcaggcctgggacaccaagaagaccggcagcagacccaagagctgcgaggtgcccggcatcaacatcttccccagcgccgaccaggagaacaccaccgccctgatccccgccacccacaacaccggcggcagcctgcccgacctgaccaacatccacttccccagccccctgcccacccccctggaccccgaggagcccaccttccccgccctgagcagcagcagcagcaccggcaacctggccgccaacctgacccacctgggcatcggcggcgccggccagggcatgagcacccccggcagcagcccccagcacagacccgccggcgtgagccccctgagcctgagcaccgaggccagaagacagcaggccagccccaccctgagccccctgagccccatcacccaggccgtggccatggacgccctgagcctggagcagcagctgccctacgccttcttcacccaggccggcagccagcagccccccccccagccccagcccccccccccccccccccccgccagccagcagccccccccccccccccccccccaggcccccgtgagactgccccccggcggccccctgctgcccagcgccagcctgaccagaggcccccagcccccccccctggccgtgaccgtgcccagcagcctgccccagagcccccccgagaaccccggccagcccagcatgggcatcgacatcgccagcgcccccgccctgcagcagtacagaaccagcgccggcagccccgccaaccagagccccaccagccccgtgagcaaccagggcttcagccccggcagcagcccccagcacaccagcaccctgggcagcgtgttcggcgacgcctactacgagcagcagatggccgccagacaggccaacgccctgagccaccagctggagcagttcaacatgatggagaacgccatcagcagcagcagcctgtacagccccggcagcaccctgaactacagccaggccgccatgatgggcctgaccggcagccacggcagcctgcccgacagccagcagctgggctacgccagccacagcggcatccccaacatcatcctgaccgtgaccggcgagagcccccccagcctgagcaaggagctgaccagcagcctggccggcgtgggcgacgtgagcttcgacagcgacagccagttccccctggacgagctgaagatcgaccccctgaccctggacggcctgcacatgctgaacgaccccgacatggtgctggccgaccccgccaccgaggacaccttcagaatggacagactgtag

SEQ ID NO: 77761 - DNA, 2082 bp, Artificial Sequence
  Description of Artificial Sequence: Synthetic coding sequence
atggccaccagcggcgccaacggccccggcagcgccaccgccagcgccagcaaccccagaaagttcagcgagaagatcgccctgcagaagcagagacaggccgaggagaccgccgccttcgaggaggtgatgatggacatcggcagcaccagactgcaggcccagaagctgagactggcctacaccagaagcagccactacggcggcagcctgcccaacgtgaaccagatcggcagcggcctggccgagttccagagccccctgcacagccccctggacagcagcagaagcaccagacaccacggcctggtggagagagtgcagagagaccccagaagaatggtgagccccctgagaagatacaccagacacatcgacagcagcccctacagccccgcctacctgagccccccccccgagagcagctggagaagaaccatggcctggggcaacttccccgccgagaagggccagctgttcagactgcccagcgccctgaacagaaccagcagcgacagcgccctgcacaccagcgtgatgaaccccagcccccaggacacctaccccggccccaccccccccagcatcctgcccagcagaagaggcggcatcctggacggcgagatggaccccaaggtgcccgccatcgaggagaacctgctggacgacaagcacctgctgaagccctgggacgccaagaagctgagcagcagcagcagcagacccagaagctgcgaggtgcccggcatcaacatcttccccagccccgaccagcccgccaacgtgcccgtgctgccccccgccatgaacaccggcggcagcctgcccgacctgaccaacctgcacttccccccccccctgcccacccccctggaccccgaggagaccgcctaccccagcctgagcggcggcaacagcaccagcaacctgacccacaccatgacccacctgggcatcagcagaggcatgggcctgggccccggctacgacgcccccggcctgcacagccccctgagccaccccagcctgcagagcagcctgagcaaccccaacctgcaggccagcctgagcagcccccagccccagctgcagggcagccacagccaccccagcctgcccgccagcagcctggccagacacgtgctgcccaccaccagcctgggccaccccagcctgagcgcccccgccctgagcagcagcagcagcagcagcagcaccagcagccccgtgctgggcgcccccagctaccccgccagcacccccggcgccagcccccaccacagaagagtgcccctgagccccctgagcctgctggccggccccgccgacgccagaagaagccagcagcagctgcccaagcagttcagccccaccatgagccccaccctgagcagcatcacccagggcgtgcccctggacaccagcaagctgagcaccgaccagagactgcccccctacccctacagcagccccagcctggtgctgcccacccagccccacacccccaagagcctgcagcagcccggcctgcccagccagagctgcagcgtgcagagcagcggcggccagccccccggcagacagagccactacggcaccccctacccccccggccccagcggccacggccagcagagctaccacagacccatgagcgacttcaacctgggcaacctggagcagttcagcatggagagccccagcgccagcctggtgctggacccccccggcttcagcgagggccccggcttcctgggcggcgagggccccatgggcggcccccaggacccccacaccttcaaccaccagaacctgacccactgcagcagacacggcagcggccccaacatcatcctgaccggcgacagcagccccggcttcagcaaggagatcgccgccgccctggccggcgtgcccggcttcgaggtgagcgccgccggcctggagctgggcctgggcctggaggacgagctgagaatggagcccctgggcctggagggcctgaacatgctgagcgacccctgcgccctgctgcccgaccccgccgtggaggagagcttcagaagcgacagactgcagtag

SEQ ID NO: 77762 - DNA, 1860 bp, Artificial Sequence
  Description of Artificial Sequence: Synthetic coding sequence
atggccgccagccccggcagcggcagcgccaaccccagaaagttcagcgagaagatcgccctgcacacccagagacaggccgaggagaccagagccttcgagcagctgatgaccgacctgaccctgagcagagtgcagttccagaagctgcagcagctgagactgacccagtaccacggcggcagcctgcccaacgtgagccagctgagaagcagcgccagcgagttccagcccagcttccaccaggccgacaacgtgagaggcaccagacaccacggcctggtggagagacccagcagaaacagattccaccccctgcacagaagaagcggcgacaagcccggcagacagttcgacggcagcgccttcggcgccaactacagcagccagcccctggacgagagctggcccagacagcagcccccctggaaggacgagaagcaccccggcttcagactgaccagcgccctgaacagaaccaacagcgacagcgccctgcacaccagcgccctgagcaccaagccccaggacccctacggcggcggcggccagagcgcctggcccgccccctacatgggcttctgcgacggcgagaacaacggccacggcgaggtggccagcttccccggccccctgaaggaggagaacctgctgaacgtgcccaagcccctgcccaagcagctgtgggagaccaaggagatccagagcctgagcggcagacccagaagctgcgacgtgggcggcggcaacgccttcccccacaacggccagaacctgggcctgagccccttcctgggcaccctgaacaccggcggcagcctgcccgacctgaccaacctgcactacagcacccccctgcccgccagcctggacaccaccgaccaccacttcggcagcatgagcgtgggcaacagcgtgaacaacatccccgccgccatgacccacctgggcatcagaagcagcagcggcctgcagagcagcagaagcaaccccagcatccaggccaccctgaacaagaccgtgctgagcagcagcctgaacaaccacccccagaccagcgtgcccaacgccagcgccctgcaccccagcctgagactgttcagcctgagcaaccccagcctgagcaccaccaacctgagcggccccagcagaagaagacagccccccgtgagccccctgaccctgagccccggccccgaggcccaccagggcttcagcagacagctgagcagcaccagccccctggccccctaccccaccagccagatggtgagcagcgacagaagccagctgagcttcctgcccaccgaggcccaggcccaggtgagccccccccccccctaccccgccccccaggagctgacccagcccctgctgcagcagcccagagcccccgaggcccccgcccagcagccccaggccgccagcagcctgccccagagcgacttccagctgctgcccgcccagggcagcagcctgaccaacttcttccccgacgtgggcttcgaccagcagagcatgagacccggccccgccttcccccagcaggtgcccctggtgcagcagggcagcagagagctgcaggacagcttccacctgagacccagcccctacagcaactgcggcagcctgcccaacaccatcctgcccgaggacagcagcaccagcctgttcaaggacctgaacagcgccctggccggcctgcccgaggtgagcctgaacgtggacacccccttccccctggaggaggagctgcagatcgagcccctgagcctggacggcctgaacatgctgagcgacagcagcatgggcctgctggaccccagcgtggaggagaccttcagagccgacagactgtag

SEQ ID NO: 77763 - DNA, 1857 bp, Artificial Sequence
  Description of Artificial Sequence: Synthetic coding sequence
atggccgccagccccggcagcggcagcgccaaccccagaaagttcagcgagaagatcgccctgcacacccagagacaggccgaggagaccagagccttcgagcagctgatgaccgacctgaccctgagcagagtgcagttccagaagctgcagcagctgagactgacccagtaccacggcggcagcctgcccaacgtgagccagctgagaagcagcgccagcgagttccagcccagcttccaccaggccgacaacgtgagaggcaccagacaccacggcctggtggagagacccagcagaaacagattccaccccctgcacagaagaagcggcgacaagcccggcagacagttcgacggcagcgccttcggcgccaactacagcagccagcccctggacgagagctggcccagacagcagcccccctggaaggacgagaagcaccccggcttcagactgaccagcgccctgaacagaaccaacagcgacagcgccctgcacaccagcgccctgagcaccaagccccaggacccctacggcggcggcggccagagcgcctggcccgccccctacatgggcttctgcgacggcgagaacaacggccacggcgaggtggccagcttccccggccccctgaaggaggagaacctgctgaacgtgcccaagcccctgcccaagcagctgtgggagaccaaggagatccagagcctgagcggcagacccagaagctgcgacgtgggcggcggcaacgccttcccccacaacggccagaacctgggcctgagccccttcctgggcaccctgaacaccggcggcagcctgcccgacctgaccaacctgcactacagcacccccctgcccgccagcctggacaccaccgaccaccacttcggcagcatgagcgtgggcaacagcgtgaacaacatccccgccgccatgacccacctgggcatcagaagcagcagcggcctgcagagcagcagaagcaaccccagcatccaggccaccctgaacaagaccgtgctgagcagcagcctgaacaaccacccccagaccagcgtgcccaacgccagcgccctgcaccccagcctgagactgttcagcctgagcaaccccagcctgagcaccaccaacctgagcggccccagcagaagaagacagccccccgtgagccccctgaccctgagccccggccccgaggcccaccagggcttcagcagacagctgagcagcaccagccccctggccccctaccccaccagccagatggtgagcagcgacagaagccagctgagcttcctgcccaccgaggcccaggcccaggtgagccccccccccccctaccccgccccccaggagctgacccagcccctgctgcagcagcccagagcccccgaggcccccgcccagcagccccaggccgccagcagcctgccccagagcgacttccagctgctgcccgcccagggcagcagcctgaccaacttcttccccgacgtgggcttcgaccagcagagcatgagacccggccccgccttcccccagcaggtgcccctggtgcagcagggcagcagagagctgcaggacagcttccacctgagacccagcccctacagcaactgcggcagcctgcccaacaccatcctgcccgacagcagcaccagcctgttcaaggacctgaacagcgccctggccggcctgcccgaggtgagcctgaacgtggacacccccttccccctggaggaggagctgcagatcgagcccctgagcctggacggcctgaacatgctgagcgacagcagcatgggcctgctggaccccagcgtggaggagaccttcagagccgacagactgtag

SEQ ID NO: 77764 - DNA, 1749 bp, Artificial Sequence
  Description of Artificial Sequence: Synthetic coding sequence
atgaccgacctgaccctgagcagagtgcagttccagaagctgcagcagctgagactgacccagtaccacggcggcagcctgcccaacgtgagccagctgagaagcagcgccagcgagttccagcccagcttccaccaggccgacaacgtgagaggcaccagacaccacggcctggtggagagacccagcagaaacagattccaccccctgcacagaagaagcggcgacaagcccggcagacagttcgacggcagcgccttcggcgccaactacagcagccagcccctggacgagagctggcccagacagcagcccccctggaaggacgagaagcaccccggcttcagactgaccagcgccctgaacagaaccaacagcgacagcgccctgcacaccagcgccctgagcaccaagccccaggacccctacggcggcggcggccagagcgcctggcccgccccctacatgggcttctgcgacggcgagaacaacggccacggcgaggtggccagcttccccggccccctgaaggaggagaacctgctgaacgtgcccaagcccctgcccaagcagctgtgggagaccaaggagatccagagcctgagcggcagacccagaagctgcgacgtgggcggcggcaacgccttcccccacaacggccagaacctgggcctgagccccttcctgggcaccctgaacaccggcggcagcctgcccgacctgaccaacctgcactacagcacccccctgcccgccagcctggacaccaccgaccaccacttcggcagcatgagcgtgggcaacagcgtgaacaacatccccgccgccatgacccacctgggcatcagaagcagcagcggcctgcagagcagcagaagcaaccccagcatccaggccaccctgaacaagaccgtgctgagcagcagcctgaacaaccacccccagaccagcgtgcccaacgccagcgccctgcaccccagcctgagactgttcagcctgagcaaccccagcctgagcaccaccaacctgagcggccccagcagaagaagacagccccccgtgagccccctgaccctgagccccggccccgaggcccaccagggcttcagcagacagctgagcagcaccagccccctggccccctaccccaccagccagatggtgagcagcgacagaagccagctgagcttcctgcccaccgaggcccaggcccaggtgagccccccccccccctaccccgccccccaggagctgacccagcccctgctgcagcagcccagagcccccgaggcccccgcccagcagccccaggccgccagcagcctgccccagagcgacttccagctgctgcccgcccagggcagcagcctgaccaacttcttccccgacgtgggcttcgaccagcagagcatgagacccggccccgccttcccccagcaggtgcccctggtgcagcagggcagcagagagctgcaggacagcttccacctgagacccagcccctacagcaactgcggcagcctgcccaacaccatcctgcccgacagcagcaccagcctgttcaaggacctgaacagcgccctggccggcctgcccgaggtgagcctgaacgtggacacccccttccccctggaggaggagctgcagatcgagcccctgagcctggacggcctgaacatgctgagcgacagcagcatgggcctgctggaccccagcgtggaggagaccttcagagccgacagactgtag

SEQ ID NO: 77765 - DNA, 672 bp, Artificial Sequence
  Description of Artificial Sequence: Synthetic coding sequence
atgacctggagacaccacgtgagactgctgttcaccgtgagcctggccctgcagatcatcaacctgggcaacagctaccagagagagaagcacaacggcggcagagaggaggtgaccaaggtggccacccagaagcacagacagagccccctgaactggaccagcagccacttcggcgaggtgaccggcagcgccgagggctggggccccgaggagcccctgccctacagcagagccttcggcgagggcgccagcgccagacccagatgctgcagaaacggcggcacctgcgtgctgggcagcttctgcgtgtgccccgcccacttcaccggcagatactgcgagcacgaccagagaagaagcgagtgcggcgccctggagcacggcgcctggaccctgagagcctgccacctgtgcagatgcatcttcggcgccctgcactgcctgcccctgcagacccccgacagatgcgaccccaaggacttcctggccagccacgcccacggccccagcgccggcggcgcccccagcctgctgctgctgctgccctgcgccctgctgcacagactgctgagacccgacgcccccgcccaccccagaagcctggtgcccagcgtgctgcagagagagagaagaccctgcggcagacccggcctgggccacagactgtag

SEQ ID NO: 77766 - DNA, 2511 bp, Artificial Sequence
  Description of Artificial Sequence: Synthetic coding sequence
atgaccgccaccgtggagaacctgaccttccagaaggacaccctgggcaacgccgtggacaagaacagaagacacggcagcaccgagcccctggtgctggcctggagcagccagttcagaagactgacctggggctgcgccctggacgccctgcacagaagcccctgcgtggccgccagccagcacggcgtgacccacctgatcagaagcagcagaaccccccacagcaccagatgcagaaaggaggacgcccagcccggccaccacggcaacggcgccgccagcgtgaccgcccaggccagaggccagagaagcgtgctgcaggtgcccctgcccgtgcccagaagctgcctgttcagcgagagcttcgtggtgagcgtgagcagccagagcagattcctggccagcgtgcccggcaccggcgtgcagagaagcaccgccgccgacatggccgccagcaccgccgccggcaagcagagaatccccaaggtggccaaggtgaagaacaaggcccccgccgaggtgcagatcaccgccgagcagctgctgagagaggccaaggagagagagctggagctgctgcccccccccccccagcagaagatcaccgacgaggaggagctgaacgactacaagctgagaaagagaaagaccttcgaggacaacatcagaaagaacagaaccgtgatcagcaactggatcaagtacgcccagtgggaggagagcctgaaggagatccagagagccagaagcatctacgagagagccctggacgtggactacagaaacatcaccctgtggctgaagtacgccgagatggagatgaagaacagacaggtgaaccacgccagaaacatctgggacagagccatcaccaccctgcccagagtgaaccagttctggtacaagtacacctacatggaggagatgctgggcaacgtggccggcgccagacaggtgttcgagagatggatggagtggcagcccgaggagcaggcctggcacagctacatcaacttcgagctgagatacaaggaggtggacagagccagaaccatctacgagagattcgtgctggtgcaccccgacgtgaagaactggatcaagtacgccagattcgaggagaagcacgcctacttcgcccacgccagaaaggtgtacgagagagccgtggagttcttcggcgacgagcacatggacgagcacctgtacgtggccttcgccaagttcgaggagaaccagaaggagttcgagagagtgagagtgatctacaagtacgccctggacagaatcagcaagcaggacgcccaggagctgttcaagaactacaccatcttcgagaagaagttcggcgacagaagaggcatcgaggacatcatcgtgagcaagagaagattccagtacgaggaggaggtgaaggccaacccccacaactacgacgcctggttcgactacctgagactggtggagagcgacgccgaggccgaggccgtgagagaggtgtacgagagagccatcgccaacgtgccccccatccaggagaagagacactggaagagatacatctacctgtggatcaactacgccctgtacgaggagctggaggccaaggaccccgagagaaccagacaggtgtaccaggccagcctggagctgatcccccacaagaagttcaccttcgccaagatgtggatcctgtacgcccagttcgagatcagacagaagaacctgagcctggccagaagagccctgggcaccagcatcggcaagtgccccaagaacaagctgttcaaggtgtacatcgagctggagctgcagctgagagagttcgacagatgcagaaagctgtacgagaagttcctggagttcggccccgagaactgcaccagctggatcaagttcgccgagctggagaccatcctgggcgacatcgacagagccagagccatctacgagctggccatcagccagcccagactggacatgcccgaggtgctgtggaagagctacatcgacttcgagatcgagcaggaggagaccgagagaaccagaaacctgtacagaagactgctgcagagaacccagcacgtgaaggtgtggatcagcttcgcccagttcgagctgagcagcggcaaggagggcagcctgaccaagtgcagacagatctacgaggaggccaacaagaccatgagaaactgcgaggagaaggaggagagactgatgctgctggagagctggagaagcttcgaggaggagttcggcaccgccagcgacaaggagagagtggacaagctgatgcccgagaaggtgaagaagagaagaaaggtgcagaccgacgacggcagcgacgccggctgggaggagtacttcgactacatcttccccgaggacgccgccaaccagcccaacctgaagctgctggccatggccaagctgtggaagaagcagcagcaggagaaggaggacgccgagcaccaccccgacgaggacgtggacgagagcgagagctag

SEQ ID NO: 77767 - DNA, 2547 bp, Artificial Sequence
  Description of Artificial Sequence: Synthetic coding sequence
atgaccgccaccgtggagaacctgaccttccagaaggacaccctgggcaacgccgtggacaagaacaccagcagactggagctgagaagctacagcctggccggcagacacggcagcaccgagcccctggtgctggcctggagcagccagttcagaagactgacctggggctgcgccctggacgccctgcacagaagcccctgcgtggccgccagccagcacggcgtgacccacctgatcagaagcagcagaaccccccacagcaccagatgcagaaaggaggacgcccagcccggccaccacggcaacggcgccgccagcgtgaccgcccaggccagaggccagagaagcgtgctgcaggtgcccctgcccgtgcccagaagctgcctgttcagcgagagcttcgtggtgagcgtgagcagccagagcagattcctggccagcgtgcccggcaccggcgtgcagagaagcaccgccgccgacatggccgccagcaccgccgccggcaagcagagaatccccaaggtggccaaggtgaagaacaaggcccccgccgaggtgcagatcaccgccgagcagctgctgagagaggccaaggagagagagctggagctgctgcccccccccccccagcagaagatcaccgacgaggaggagctgaacgactacaagctgagaaagagaaagaccttcgaggacaacatcagaaagaacagaaccgtgatcagcaactggatcaagtacgcccagtgggaggagagcctgaaggagatccagagagccagaagcatctacgagagagccctggacgtggactacagaaacatcaccctgtggctgaagtacgccgagatggagatgaagaacagacaggtgaaccacgccagaaacatctgggacagagccatcaccaccctgcccagagtgaaccagttctggtacaagtacacctacatggaggagatgctgggcaacgtggccggcgccagacaggtgttcgagagatggatggagtggcagcccgaggagcaggcctggcacagctacatcaacttcgagctgagatacaaggaggtggacagagccagaaccatctacgagagattcgtgctggtgcaccccgacgtgaagaactggatcaagtacgccagattcgaggagaagcacgcctacttcgcccacgccagaaaggtgtacgagagagccgtggagttcttcggcgacgagcacatggacgagcacctgtacgtggccttcgccaagttcgaggagaaccagaaggagttcgagagagtgagagtgatctacaagtacgccctggacagaatcagcaagcaggacgcccaggagctgttcaagaactacaccatcttcgagaagaagttcggcgacagaagaggcatcgaggacatcatcgtgagcaagagaagattccagtacgaggaggaggtgaaggccaacccccacaactacgacgcctggttcgactacctgagactggtggagagcgacgccgaggccgaggccgtgagagaggtgtacgagagagccatcgccaacgtgccccccatccaggagaagagacactggaagagatacatctacctgtggatcaactacgccctgtacgaggagctggaggccaaggaccccgagagaaccagacaggtgtaccaggccagcctggagctgatcccccacaagaagttcaccttcgccaagatgtggatcctgtacgcccagttcgagatcagacagaagaacctgagcctggccagaagagccctgggcaccagcatcggcaagtgccccaagaacaagctgttcaaggtgtacatcgagctggagctgcagctgagagagttcgacagatgcagaaagctgtacgagaagttcctggagttcggccccgagaactgcaccagctggatcaagttcgccgagctggagaccatcctgggcgacatcgacagagccagagccatctacgagctggccatcagccagcccagactggacatgcccgaggtgctgtggaagagctacatcgacttcgagatcgagcaggaggagaccgagagaaccagaaacctgtacagaagactgctgcagagaacccagcacgtgaaggtgtggatcagcttcgcccagttcgagctgagcagcggcaaggagggcagcctgaccaagtgcagacagatctacgaggaggccaacaagaccatgagaaactgcgaggagaaggaggagagactgatgctgctggagagctggagaagcttcgaggaggagttcggcaccgccagcgacaaggagagagtggacaagctgatgcccgagaaggtgaagaagagaagaaaggtgcagaccgacgacggcagcgacgccggctgggaggagtacttcgactacatcttccccgaggacgccgccaaccagcccaacctgaagctgctggccatggccaagctgtggaagaagcagcagcaggagaaggaggacgccgagcaccaccccgacgaggacgtggacgagagcgagagctag

SEQ ID NO: 77768 - DNA, 7026 bp, Artificial Sequence
  Description of Artificial Sequence: Synthetic coding sequence
atgaagaacatctactgcctgatccccaagctggtgaacttcgccaccctgggctgcctgtggatcagcgtggtgcagtgcaccgtgctgaacagctgcctgaagagctgcgtgaccaacctgggccagcagctggacctgggcaccccccacaacctgagcgagccctgcatccagggctgccacttctggaacagcgtggaccagaagaactgcgccctgaagtgcaacgacacctacgccaccgtgtgcgagagagagagctgcgaggtgggctgcagcagcgccgagggcgcctacgaggaggaggtgctggagaacgccgacctgcccaccgcccccttcgccagcagcatcggcagccacaacatgaccctgagatggaagagcgccaacttcagcggcgtgaagtacatcatccagtggaagtacgcccagctgctgggcagctggacctacaccaagaccgtgagcagacccagctacgtggtgaagcccctgcaccccttcaccgagtacatcttcagagtggtgtggatcttcaccgcccagctgcagctgtacagcccccccagccccagctacagaacccacccccacggcgtgcccgagaccgcccccctgatcagaaacatcgagagcagcagccccgacaccgtggaggtgagctgggaccccccccagttccccggcggccccatcctgggctacaacctgagactgatcagcaagaaccagaagctggacgccggcacccagagaaccagcttccagttctacagcaccctgcccaacaccatctacagattcagcatcgccgccgtgaacgaggtgggcgagggccccgaggccgagagcagcatcaccaccagcagcagcgccgtgcagcaggaggagcagtggctgttcctgagcagaaagaccagcctgagaaagagaagcctgaagcacctggtggacgaggcccactgcctgagactggacgccatctaccacaacatcaccggcatcagcgtggacgtgcaccagcagatcgtgtacttcagcgagggcaccctgatctgggccaagaaggccgccaacatgagcgacgtgagcgacctgagaatcttctacagaggcagcggcctgatcagcagcatcagcatcgactggctgtaccagagaatgtacttcatcatggacgagctggtgtgcgtgtgcgacctggagaactgcagcaacatcgaggagatcaccccccccagcatcagcgccccccagaagatcgtggccgacagctacaacggctacgtgttctacctgctgagagacggcatctacagagccgacctgcccgtgcccagcggcagatgcgccgaggccgtgagaatcgtggagagctgcaccctgaaggacttcgccatcaagccccaggccaagagaatcatctacttcaacgacaccgcccaggtgttcatgagcaccttcctggacggcagcgccagccacctgatcctgcccagaatccccttcgccgacgtgaagagcttcgcctgcgagaacaacgacttcctggtgaccgacggcaaggtgatcttccagcaggacgccctgagcttcaacgagttcatcgtgggctgcgacctgagccacatcgaggagttcggcttcggcaacctggtgatcttcggcagcagcagccagctgcaccccctgcccggcagaccccaggagctgagcgtgctgttcggcagccaccaggccctggtgcagtggaagccccccgccctggccatcggcgccagccccagcgcctggcagaactggacctacgaggtgaaggtgagcacccaggacccccccgaggtgacccacatcttcctgaacatcagcggcaccatgctgaacgtgcccgagctgcagagcgccatgaagtacaaggtgagcgtgagagccagcagccccaagagacccggcccctggagcgagcccagcgtgggcaccaccctggtgcccgccagcgagccccccttcatcatggccgtgaaggaggacggcctgtggagcaagcccctgaacagcttcggccccggcgagttcctgagcagcgacatcggcaacgtgagcgacatggactggtacaacaacagcctgtactacagcgacaccaagggcgacgtgttcgtgtggctgctgaacggcaccgacatcagcgagaactaccacctgcccagcatcgccggcgccggcgccctggccttcgagtggctgggccacttcctgtactgggccggcaagacctacgtgatccagagacagagcgtgctgaccggccacaccgacatcgtgacccacgtgaagctgctggtgaacgacatggtggtggacagcgtgggcggctacctgtactggaccaccctgtacagcgtggagagcaccagactgaacggcgagagcagcctggtgctgcagacccagccctggttcagcggcaagaaggtgatcgccctgaccctggacctgagcgacggcctgctgtactggctggtgcaggacagccagtgcatccacctgtacaccgccgtgctgagaggccagagcaccggcgacaccaccatcaccgagttcgccgcctggagcaccagcgagatcagccagaacgccctgatgtactacagcggcagactgttctggatcaacggcttcagaatcatcaccacccaggagatcggccagaagaccagcgtgagcgtgctggagcccgccagattcaaccagttcaccatcatccagaccagcctgaagcccctgcccggcaacttcagcttcacccccaaggtgatccccgacagcgtgcaggagagcagcttcagaatcgagggcaacgccagcagcttccagatcctgtggaacggcccccccgccgtggactggggcgtggtgttctacagcgtggagttcagcgcccacagcaagttcctggccagcgagcagcacagcctgcccgtgttcaccgtggagggcctggagccctacgccctgttcaacctgagcgtgaccccctacacctactggggcaagggccccaagaccagcctgagcctgagagcccccgagaccgtgcccagcgcccccgagaaccccagaatcttcatcctgcccagcggcaagtgctgcaacaagaacgaggtggtggtggagttcagatggaacaagcccaagcacgagaacggcgtgctgaccaagttcgagatcttctacaacatcagcaaccagagcatcaccaacaagacctgcgaggactggatcgccgtgaacgtgacccccagcgtgatgagcttccagctggagggcatgagccccagatgcttcatcgccttccaggtgagagccttcaccagcaagggccccggcccctacgccgacgtggtgaagagcaccaccagcgagatcaaccccttcccccacctgatcaccctgctgggcaacaagatcgtgttcctggacatggaccagaaccaggtggtgtggaccttcagcgccgagagagtgatcagcgccgtgtgctacaccgccgacaacgagatgggctactacgccgagggcgacagcctgttcctgctgcacctgcacaacagaagcagcagcgagctgttccaggacagcctggtgttcgacatcaccgtgatcaccatcgactggatcagcagacacctgtacttcgccctgaaggagagccagaacggcatgcaggtgttcgacgtggacctggagcacaaggtgaagtaccccagagaggtgaagatccacaacagaaacagcaccatcatcagcttcagcgtgtaccccctgctgagcagactgtactggaccgaggtgagcaacttcggctaccagatgttctactacagcatcatcagccacaccctgcacagaatcctgcagcccaccgccaccaaccagcagaacaagagaaaccagtgcagctgcaacgtgaccgagttcgagctgagcggcgccatggccatcgacaccagcaacctggagaagcccctgatctacttcgccaaggcccaggagatctgggccatggacctggagggctgccagtgctggagagtgatcaccgtgcccgccatgctgggcaagaccctggtgagcctgaccgtggacggcgacctgatctactggatcatcaccgccaaggacagcacccagatctaccaggccaagaagggcaacggcgccatcgtgagccaggtgaaggccctgagaagcagacacatcctggcctacagcagcgtgatgcagcccttccccgacaaggccttcctgagcctggccagcgacaccgtggagcccaccatcctgaacgccaccaacaccagcctgaccatcagactgcccctggccaagaccaacctgacctggtacggcatcaccagccccacccccacctacctggtgtactacgccgaggtgaacgacagaaagaacagcagcgacctgaagtacagaatcctggagttccaggacagcatcgccctgatcgaggacctgcagcccttcagcacctacatgatccagatcgccgtgaagaactactacagcgaccccctggagcacctgccccccggcaaggagatctggggcaagaccaagaacggcgtgcccgaggccgtgcagctgatcaacaccaccgtgagaagcgacaccagcctgatcatcagctggagagagagccacaagcccaacggccccaaggagagcgtgagataccagctggccatcagccacctggccctgatccccgagacccccctgagacagagcgagttccccaacggcagactgaccctgctggtgaccagactgagcggcggcaacatctacgtgctgaaggtgctggcctgccacagcgaggagatgtggtgcaccgagagccaccccgtgaccgtggagatgttcaacacccccgagaagccctacagcctggtgcccgagaacaccagcctgcagttcaactggaaggcccccctgaacgtgaacctgatcagattctgggtggagctgcagaagtggaagtacaacgagttctaccacgtgaagaccagctgcagccagggccccgcctacgtgtgcaacatcaccaacctgcagccctacaccagctacaacgtgagagtggtggtggtgtacaagaccggcgagaacagcaccagcctgcccgagagcttcaagaccaaggccggcgtgcccaacaagcccggcatccccaagctgctggagggcagcaagaacagcatccagtgggagaaggccgaggacaacggctgcagaatcacctactacatcctggagatcagaaagagcaccagcaacaacctgcagaaccagaacctgagatggaagatgaccttcaacggcagctgcagcagcgtgtgcacctggaagagcaagaacctgaagggcatcttccagttcagagtggtggccgccaacaacctgggcttcggcgagtacagcggcatcagcgagaacatcatcctggtgggcgacgacttctggatccccgagaccagcttcatcctgaccatcatcgtgggcatcttcctggtggtgaccatccccctgaccttcgtgtggcacagaagactgaagaaccagaagagcgccaaggagggcgtgaccgtgctgatcaacgaggacaaggagctggccgagctgagaggcctggccgccggcgtgggcctggccaacgcctgctacgccatccacaccctgcccacccaggaggagatcgagaacctgcccgccttccccagagagaagctgaccctgagactgctgctgggcagcggcgccttcggcgaggtgtacgagggcaccgccgtggacatcctgggcgtgggcagcggcgagatcaaggtggccgtgaagaccctgaagaagggcagcaccgaccaggagaagatcgagttcctgaaggaggcccacctgatgagcaagttcaaccaccccaacatcctgaagcagctgggcgtgtgcctgctgaacgagccccagtacatcatcctggagctgatggagggcggcgacctgctgacctacctgagaaaggccagaatggccaccttctacggccccctgctgaccctggtggacctggtggacctgtgcgtggacatcagcaagggctgcgtgtacctggagagaatgcacttcatccacagagacctggccgccagaaactgcctggtgagcgtgaaggactacaccagccccagaatcgtgaagatcggcgacttcggcctggccagagacatctacaagaacgactactacagaaagagaggcgagggcctgctgcccgtgagatggatggcccccgagagcctgatggacggcatcttcaccacccagagcgacgtgtggagcttcggcatcctgatctgggagatcctgaccctgggccaccagccctaccccgcccacagcaacctggacgtgctgaactacgtgcagaccggcggcagactggagccccccagaaactgccccgacgacctgtggaacctgatgacccagtgctgggcccaggagcccgaccagagacccaccttccacagaatccaggaccagctgcagctgttcagaaacttcttcctgaacagcatctacaagagcagagacgaggccaacaacagcggcgtgatcaacgagagcttcgagggcgaggacggcgacgtgatctgcctgaacagcgacgacatcatgcccgtggccctgatggagaccaagaacagagagggcctgaactacatggtgctggccaccgagtgcggccagggcgaggagaagagcgagggccccctgggcagccaggagagcgagagctgcggcctgagaaaggaggagaaggagccccacgccgacaaggacttctgccaggagaagcaggtggcctactgccccagcggcaagcccgagggcctgaactacgcctgcctgacccacagcggctacggcgacggcagcgactag

SEQ ID NO: 77769 - DNA, 7044 bp, Artificial Sequence
  Description of Artificial Sequence: Synthetic coding sequence
atgaagaacatctactgcctgatccccaagctggtgaacttcgccaccctgggctgcctgtggatcagcgtggtgcagtgcaccgtgctgaacagctgcctgaagagctgcgtgaccaacctgggccagcagctggacctgggcaccccccacaacctgagcgagccctgcatccagggctgccacttctggaacagcgtggaccagaagaactgcgccctgaagtgcagagagagctgcgaggtgggctgcagcagcgccgagggcgcctacgaggaggaggtgctggagaacgccgacctgcccaccgcccccttcgccagcagcatcggcagccacaacatgaccctgagatggaagagcgccaacttcagcggcgtgaagtacatcatccagtggaagtacgcccagctgctgggcagctggacctacaccaagaccgtgagcagacccagctacgtggtgaagcccctgcaccccttcaccgagtacatcttcagagtggtgtggatcttcaccgcccagctgcagctgtacagcccccccagccccagctacagaacccacccccacggcgtgcccgagaccgcccccctgatcagaaacatcgagagcagcagccccgacaccgtggaggtgagctgggaccccccccagttccccggcggccccatcctgggctacaacctgagactgatcagcaagaaccagaagctggacgccggcacccagagaaccagcttccagttctacagcaccctgcccaacaccatctacagattcagcatcgccgccgtgaacgaggtgggcgagggccccgaggccgagagcagcatcaccaccagcagcagcgccgtgcagcaggaggagcagtggctgttcctgagcagaaagaccagcctgagaaagagaagcctgaagcacctggtggacgaggcccactgcctgagactggacgccatctaccacaacatcaccggcatcagcgtggacgtgcaccagcagatcgtgtacttcagcgagggcaccctgatctgggccaagaaggccgccaacatgagcgacgtgagcgacctgagaatcttctacagaggcagcggcctgatcagcagcatcagcatcgactggctgtaccagagaatgtacttcatcatggacgagctggtgtgcgtgtgcgacctggagaactgcagcaacatcgaggagatcaccccccccagcatcagcgccccccagaagatcgtggccgacagctacaacggctacgtgttctacctgctgagagacggcatctacagagccgacctgcccgtgcccagcggcagatgcgccgaggccgtgagaatcgtggagagctgcaccctgaaggacttcgccatcaagccccaggccaagagaatcatctacttcaacgacaccgcccaggtgttcatgagcaccttcctggacggcagcgccagccacctgatcctgcccagaatccccttcgccgacgtgaagagcttcgcctgcgagaacaacgacttcctggtgaccgacggcaaggtgatcttccagcaggacgccctgagcttcaacgagttcatcgtgggctgcgacctgagccacatcgaggagttcggcttcggcaacctggtgatcttcggcagcagcagccagctgcaccccctgcccggcagaccccaggagctgagcgtgctgttcggcagccaccaggccctggtgcagtggaagccccccgccctggccatcggcgccaacgtgatcctgatcagcgacatcatcgagctgttcgagctgggccccagcgcctggcagaactggacctacgaggtgaaggtgagcacccaggacccccccgaggtgacccacatcttcctgaacatcagcggcaccatgctgaacgtgcccgagctgcagagcgccatgaagtacaaggtgagcgtgagagccagcagccccaagagacccggcccctggagcgagcccagcgtgggcaccaccctggtgcccgccagcgagccccccttcatcatggccgtgaaggaggacggcctgtggagcaagcccctgaacagcttcggccccggcgagttcctgagcagcgacatcggcaacgtgagcgacatggactggtacaacaacagcctgtactacagcgacaccaagggcgacgtgttcgtgtggctgctgaacggcaccgacatcagcgagaactaccacctgcccagcatcgccggcgccggcgccctggccttcgagtggctgggccacttcctgtactgggccggcaagacctacgtgatccagagacagagcgtgctgaccggccacaccgacatcgtgacccacgtgaagctgctggtgaacgacatggtggtggacagcgtgggcggctacctgtactggaccaccctgtacagcgtggagagcaccagactgaacggcgagagcagcctggtgctgcagacccagccctggttcagcggcaagaaggtgatcgccctgaccctggacctgagcgacggcctgctgtactggctggtgcaggacagccagtgcatccacctgtacaccgccgtgctgagaggccagagcaccggcgacaccaccatcaccgagttcgccgcctggagcaccagcgagatcagccagaacgccctgatgtactacagcggcagactgttctggatcaacggcttcagaatcatcaccacccaggagatcggccagaagaccagcgtgagcgtgctggagcccgccagattcaaccagttcaccatcatccagaccagcctgaagcccctgcccggcaacttcagcttcacccccaaggtgatccccgacagcgtgcaggagagcagcttcagaatcgagggcaacgccagcagcttccagatcctgtggaacggcccccccgccgtggactggggcgtggtgttctacagcgtggagttcagcgcccacagcaagttcctggccagcgagcagcacagcctgcccgtgttcaccgtggagggcctggagccctacgccctgttcaacctgagcgtgaccccctacacctactggggcaagggccccaagaccagcctgagcctgagagcccccgagaccgtgcccagcgcccccgagaaccccagaatcttcatcctgcccagcggcaagtgctgcaacaagaacgaggtggtggtggagttcagatggaacaagcccaagcacgagaacggcgtgctgaccaagttcgagatcttctacaacatcagcaaccagagcatcaccaacaagacctgcgaggactggatcgccgtgaacgtgacccccagcgtgatgagcttccagctggagggcatgagccccagatgcttcatcgccttccaggtgagagccttcaccagcaagggccccggcccctacgccgacgtggtgaagagcaccaccagcgagatcaaccccttcccccacctgatcaccctgctgggcaacaagatcgtgttcctggacatggaccagaaccaggtggtgtggaccttcagcgccgagagagtgatcagcgccgtgtgctacaccgccgacaacgagatgggctactacgccgagggcgacagcctgttcctgctgcacctgcacaacagaagcagcagcgagctgttccaggacagcctggtgttcgacatcaccgtgatcaccatcgactggatcagcagacacctgtacttcgccctgaaggagagccagaacggcatgcaggtgttcgacgtggacctggagcacaaggtgaagtaccccagagaggtgaagatccacaacagaaacagcaccatcatcagcttcagcgtgtaccccctgctgagcagactgtactggaccgaggtgagcaacttcggctaccagatgttctactacagcatcatcagccacaccctgcacagaatcctgcagcccaccgccaccaaccagcagaacaagagaaaccagtgcagctgcaacgtgaccgagttcgagctgagcggcgccatggccatcgacaccagcaacctggagaagcccctgatctacttcgccaaggcccaggagatctgggccatggacctggagggctgccagtgctggagagtgatcaccgtgcccgccatgctggccggcaagaccctggtgagcctgaccgtggacggcgacctgatctactggatcatcaccgccaaggacagcacccagatctaccaggccaagaagggcaacggcgccatcgtgagccaggtgaaggccctgagaagcagacacatcctggcctacagcagcgtgatgcagcccttccccgacaaggccttcctgagcctggccagcgacaccgtggagcccaccatcctgaacgccaccaacaccagcctgaccatcagactgcccctggccaagaccaacctgacctggtacggcatcaccagccccacccccacctacctggtgtactacgccgaggtgaacgacagaaagaacagcagcgacctgaagtacagaatcctggagttccaggacagcatcgccctgatcgaggacctgcagcccttcagcacctacatgatccagatcgccgtgaagaactactacagcgaccccctggagcacctgccccccggcaaggagatctggggcaagaccaagaacggcgtgcccgaggccgtgcagctgatcaacaccaccgtgagaagcgacaccagcctgatcatcagctggagagagagccacaagcccaacggccccaaggagagcgtgagataccagctggccatcagccacctggccctgatccccgagacccccctgagacagagcgagttccccaacggcagactgaccctgctggtgaccagactgagcggcggcaacatctacgtgctgaaggtgctggcctgccacagcgaggagatgtggtgcaccgagagccaccccgtgaccgtggagatgttcaacacccccgagaagccctacagcctggtgcccgagaacaccagcctgcagttcaactggaaggcccccctgaacgtgaacctgatcagattctgggtggagctgcagaagtggaagtacaacgagttctaccacgtgaagaccagctgcagccagggccccgcctacgtgtgcaacatcaccaacctgcagccctacaccagctacaacgtgagagtggtggtggtgtacaagaccggcgagaacagcaccagcctgcccgagagcttcaagaccaaggccggcgtgcccaacaagcccggcatccccaagctgctggagggcagcaagaacagcatccagtgggagaaggccgaggacaacggctgcagaatcacctactacatcctggagatcagaaagagcaccagcaacaacctgcagaaccagaacctgagatggaagatgaccttcaacggcagctgcagcagcgtgtgcacctggaagagcaagaacctgaagggcatcttccagttcagagtggtggccgccaacaacctgggcttcggcgagtacagcggcatcagcgagaacatcatcctggtgggcgacgacttctggatccccgagaccagcttcatcctgaccatcatcgtgggcatcttcctggtggtgaccatccccctgaccttcgtgtggcacagaagactgaagaaccagaagagcgccaaggagggcgtgaccgtgctgatcaacgaggacaaggagctggccgagctgagaggcctggccgccggcgtgggcctggccaacgcctgctacgccatccacaccctgcccacccaggaggagatcgagaacctgcccgccttccccagagagaagctgaccctgagactgctgctgggcagcggcgccttcggcgaggtgtacgagggcaccgccgtggacatcctgggcgtgggcagcggcgagatcaaggtggccgtgaagaccctgaagaagggcagcaccgaccaggagaagatcgagttcctgaaggaggcccacctgatgagcaagttcaaccaccccaacatcctgaagcagctgggcgtgtgcctgctgaacgagccccagtacatcatcctggagctgatggagggcggcgacctgctgacctacctgagaaaggccagaatggccaccttctacggccccctgctgaccctggtggacctggtggacctgtgcgtggacatcagcaagggctgcgtgtacctggagagaatgcacttcatccacagagacctggccgccagaaactgcctggtgagcgtgaaggactacaccagccccagaatcgtgaagatcggcgacttcggcctggccagagacatctacaagaacgactactacagaaagagaggcgagggcctgctgcccgtgagatggatggcccccgagagcctgatggacggcatcttcaccacccagagcgacgtgtggagcttcggcatcctgatctgggagatcctgaccctgggccaccagccctaccccgcccacagcaacctggacgtgctgaactacgtgcagaccggcggcagactggagccccccagaaactgccccgacgacctgtggaacctgatgacccagtgctgggcccaggagcccgaccagagacccaccttccacagaatccaggaccagctgcagctgttcagaaacttcttcctgaacagcatctacaagagcagagacgaggccaacaacagcggcgtgatcaacgagagcttcgagggcgaggacggcgacgtgatctgcctgaacagcgacgacatcatgcccgtggccctgatggagaccaagaacagagagggcctgaactacatggtgctggccaccgagtgcggccagggcgaggagaagagcgagggccccctgggcagccaggagagcgagagctgcggcctgagaaaggaggagaaggagccccacgccgacaaggacttctgccaggagaagcaggtggcctactgccccagcggcaagcccgagggcctgaactacgcctgcctgacccacagcggctacggcgacggcagcgactag

SEQ ID NO: 77770 - DNA, 294 bp, Artificial Sequence
  Description of Artificial Sequence: Synthetic coding sequence
tggaagtacaacgagttctaccacgtgaagaccagctgcagccagggccccgcctacgtgtgcaacatcaccaacctgcagccctacaccagctacaacgtgagagtggtggtggtgtacaagaccggcgagaacagcaccagcctgcccgagagcttcaagaccaaggccggcgtgcccaacaagcccggcatccccaagctgctggagggcagcaagaacagcatccagtgggagaaggccgaggacaacggctgcagaatcacctactacatcctggagatcagagactag

SEQ ID NO: 77771 - DNA, 2025 bp, Artificial Sequence
  Description of Artificial Sequence: Synthetic coding sequence
atgaccagcaacggcgtggccctgctgaacttctacaacatgcccagcacccccagcttcgtgggctgcctgcaggacatcaagatcgactggaaccacatcaccctggagaacatcagcagcggcagcagcctgaacgtgaaggccggctgcgtgagaaaggactggtgcgagagccagccctgccagagcagaggcagatgcatcaacctgtggctgagctaccagtgcgactgccacagaccctacgagggccccaactgcctgagagagtacgtggccggcagattcggccaggacgacagcaccggctacgtgatcttcaccctggacgagagctacggcgacaccatcagcctgagcatgttcgtgagaaccctgcagcccagcggcctgctgctggccctggagaacagcacctaccagtacatcagagtgtggctggagagaggcagactggccatgctgacccccaacagccccaagctggtggtgaagttcgtgctgaacgacggcaacgtgcacctgatcagcctgaagatcaagccctacaagatcgagctgtaccagagcagccagaacctgggcttcatcagcgccagcacctggaagatcgagaagggcgacgtgatctacatcggcggcctgcccgacaagcaggagaccgagctgaacggcggcttcttcaagggctgcatccaggacgtgagactgaacaaccagaacctggagttcttccccaaccccaccaacaacgccagcctgaaccccgtgctggtgaacgtgacccagggctgcgccggcgacaacagctgcaagagcaacccctgccacaacggcggcgtgtgccacagcagatgggacgacttcagctgcagctgccccgccctgaccagcggcaaggcctgcgaggaggtgcagtggtgcggcttcagcccctgcccccacggcgcccagtgccagcccgtgctgcagggcttcgagtgcatcgccaacgccgtgttcaacggccagagcggccagatcctgttcagaagcaacggcaacatcaccagagagctgaccaacatcaccttcggcttcagaaccagagacgccaacgtgatcatcctgcacgccgagaaggagcccgagttcctgaacatcagcatccaggacagcagactgttcttccagctgcagagcggcaacagcttctacatgctgagcctgaccagcctgcagagcgtgaacgacggcacctggcacgaggtgaccctgagcatgaccgaccccctgagccagaccagcagatggcagatggaggtggacaacgagacccccttcgtgaccagcaccatcgccaccggcagcctgaacttcctgaaggacaacaccgacatctacgtgggcgacagagccatcgacaacatcaagggcctgcagggctgcctgagcaccatcgagatcggcggcatctacctgagctacttcgagaacgtgcacggcttcatcaacaagccccaggaggagcagttcctgaagatcagcaccaacagcgtggtgaccggctgcctgcagctgaacgtgtgcaacagcaacccctgcctgcacggcggcaactgcgaggacatctacagcagctaccactgcagctgccccctgggctggagcggcaagcactgcgagctgaacatcgacgagtgcttcagcaacccctgcatccacggcaactgcagcgacagagtggccgcctaccactgcacctgcgagcccggctacaccggcgtgaactgcgaggtggacatcgacaactgccagagccaccagtgcgccaacggcgccacctgcatcagccacaccaacggctacagctgcctgtgcttcggcaacttcaccggcaagttctgcagacagagcagactgcccagcaccgtgtgcggcaacgagaagaccaacctgacctgctacaacggcggcaactgcaccgagttccagaccgagctgaagtgcatgtgcagacccggcttcaccggcgagtggtag

SEQ ID NO: 77772 - DNA, 4221 bp, Artificial Sequence
  Description of Artificial Sequence: Synthetic coding sequence
atggccctgaagaacatcaactacctgctgatcttctacctgagcttcagcctgctgatctacatcaagaacagcttctgcaacaagaacaacaccagatgcctgagcaacagctgccagaacaacagcacctgcaaggacttcagcaaggacaacgactgcagctgcagcgacaccgccaacaacctggacaaggactgcgacaacatgaaggacccctgcttcagcaacccctgccagggcagcgccacctgcgtgaacacccccggcgagagaagcttcctgtgcaagtgcccccccggctacagcggcaccatctgcgagaccaccatcggcagctgcggcaagaacagctgccagcacggcggcatctgccaccaggaccccatctaccccgtgtgcatctgccccgccggctacgccggcagattctgcgagatcgaccacgacgagtgcgccagcagcccctgccagaacggcgccgtgtgccaggacggcatcgacggctacagctgcttctgcgtgcccggctaccagggcagacactgcgacctggaggtggacgagtgcgccagcgacccctgcaagaacgaggccacctgcctgaacgagatcggcagatacacctgcatctgcccccacaactacagcggcgtgaactgcgagctggagatcgacgagtgctggagccagccctgcctgaacggcgccacctgccaggacgccctgggcgcctacttctgcgactgcgcccccggcttcctgggcgaccactgcgagctgaacaccgacgagtgcgccagccagccctgcctgcacggcggcctgtgcgtggacggcgagaacagatacagctgcaactgcaccggcagcggcttcaccggcacccactgcgagaccctgatgcccctgtgctggagcaagccctgccacaacaacgccacctgcgaggacagcgtggacaactacacctgccactgctggcccggctacaccggcgcccagtgcgagatcgacctgaacgagtgcaacagcaacccctgccagagcaacggcgagtgcgtggagctgagcagcgagaagcagtacggcagaatcaccggcctgcccagcagcttcagctaccacgaggccagcggctacgtgtgcatctgccagcccggcttcaccggcatccactgcgaggaggacgtgaacgagtgcagcagcaacccctgccagaacggcggcacctgcgagaacctgcccggcaactacacctgccactgccccttcgacaacctgagcagaaccttctacggcggcagagactgcagcgacatcctgctgggctgcacccaccagcagtgcctgaacaacggcacctgcatcccccacttccaggacggccagcacggcttcagctgcctgtgccccagcggctacaccggcagcctgtgcgagatcgccaccaccctgagcttcgagggcgacggcttcctgtgggtgaagagcggcagcgtgaccaccaagggcagcgtgtgcaacatcgccctgagattccagaccgtgcagcccatggccctgctgctgttcagaagcaacagagacgtgttcgtgaagctggagctgctgagcggctacatccacctgagcatccaggtgaacaaccagagcaaggtgctgctgttcatcagccacaacaccagcgacggcgagtggcacttcgtggaggtgatcttcgccgaggccgtgaccctgaccctgatcgacgacagctgcaaggagaagtgcatcgccaaggcccccacccccctggagagcgaccagagcatctgcgccttccagaacagcttcctgggcggcctgcccgtgggcatgaccagcaacggcgtggccctgctgaacttctacaacatgcccagcacccccagcttcgtgggctgcctgcaggacatcaagatcgactggaaccacatcaccctggagaacatcagcagcggcagcagcctgaacgtgaaggccggctgcgtgagaaaggactggtgcgagagccagccctgccagagcagaggcagatgcatcaacctgtggctgagctaccagtgcgactgccacagaccctacgagggccccaactgcctgagagagtacgtggccggcagattcggccaggacgacagcaccggctacgtgatcttcaccctggacgagagctacggcgacaccatcagcctgagcatgttcgtgagaaccctgcagcccagcggcctgctgctggccctggagaacagcacctaccagtacatcagagtgtggctggagagaggcagactggccatgctgacccccaacagccccaagctggtggtgaagttcgtgctgaacgacggcaacgtgcacctgatcagcctgaagatcaagccctacaagatcgagctgtaccagagcagccagaacctgggcttcatcagcgccagcacctggaagatcgagaagggcgacgtgatctacatcggcggcctgcccgacaagcaggagaccgagctgaacggcggcttcttcaagggctgcatccaggacgtgagactgaacaaccagaacctggagttcttccccaaccccaccaacaacgccagcctgaaccccgtgctggtgaacgtgacccagggctgcgccggcgacaacagctgcaagagcaacccctgccacaacggcggcgtgtgccacagcagatgggacgacttcagctgcagctgccccgccctgaccagcggcaaggcctgcgaggaggtgcagtggtgcggcttcagcccctgcccccacggcgcccagtgccagcccgtgctgcagggcttcgagtgcatcgccaacgccgtgttcaacggccagagcggccagatcctgttcagaagcaacggcaacatcaccagagagctgaccaacatcaccttcggcttcagaaccagagacgccaacgtgatcatcctgcacgccgagaaggagcccgagttcctgaacatcagcatccaggacagcagactgttcttccagctgcagagcggcaacagcttctacatgctgagcctgaccagcctgcagagcgtgaacgacggcacctggcacgaggtgaccctgagcatgaccgaccccctgagccagaccagcagatggcagatggaggtggacaacgagacccccttcgtgaccagcaccatcgccaccggcagcctgaacttcctgaaggacaacaccgacatctacgtgggcgacagagccatcgacaacatcaagggcctgcagggctgcctgagcaccatcgagatcggcggcatctacctgagctacttcgagaacgtgcacggcttcatcaacaagccccaggaggagcagttcctgaagatcagcaccaacagcgtggtgaccggctgcctgcagctgaacgtgtgcaacagcaacccctgcctgcacggcggcaactgcgaggacatctacagcagctaccactgcagctgccccctgggctggagcggcaagcactgcgagctgaacatcgacgagtgcttcagcaacccctgcatccacggcaactgcagcgacagagtggccgcctaccactgcacctgcgagcccggctacaccggcgtgaactgcgaggtggacatcgacaactgccagagccaccagtgcgccaacggcgccacctgcatcagccacaccaacggctacagctgcctgtgcttcggcaacttcaccggcaagttctgcagacagagcagactgcccagcaccgtgtgcggcaacgagaagaccaacctgacctgctacaacggcggcaactgcaccgagttccagaccgagctgaagtgcatgtgcagacccggcttcaccggcgagtggtgcgagaaggacatcgacgagtgcgccagcgacccctgcgtgaacggcggcctgtgccaggacctgctgaacaagttccagtgcctgtgcgacgtggccttcgccggcgagagatgcgaggtggacctggccgacgacctgatcagcgacatcttcaccaccatcggcagcgtgaccgtggccctgctgctgatcctgctgctggccatcgtggccagcgtggtgaccagcaacaagagagccacccagggcacctacagccccagcagacaggagaaggagggcagcagagtggagatgtggaacctgatgcccccccccgccatggagagactgatctag

SEQ ID NO: 77773 - DNA, 2826 bp, Artificial Sequence
  Description of Artificial Sequence: Synthetic coding sequence
atgatcagaaacagcctgtgccagcccagcagatgcctggacggctacctgttcttcaacagaaagatgttcggcgccagaacccacggcttccacatcctgatggccatgctgatcggcatccactgcgaggaggacgtgaacgagtgcagcagcaacccctgccagaacggcggcacctgcgagaacctgcccggcaactacacctgccactgccccttcgacaacctgagcagaaccttctacggcggcagagactgcagcgacatcctgctgggctgcacccaccagcagtgcctgaacaacggcacctgcatcccccacttccaggacggccagcacggcttcagctgcctgtgccccagcggctacaccggcagcctgtgcgagatcgccaccaccctgagcttcgagggcgacggcttcctgtgggtgaagagcggcagcgtgaccaccaagggcagcgtgtgcaacatcgccctgagattccagaccgtgcagcccatggccctgctgctgttcagaagcaacagagacgtgttcgtgaagctggagctgctgagcggctacatccacctgagcatccaggtgaacaaccagagcaaggtgctgctgttcatcagccacaacaccagcgacggcgagtggcacttcgtggaggtgatcttcgccgaggccgtgaccctgaccctgatcgacgacagctgcaaggagaagtgcatcgccaaggcccccacccccctggagagcgaccagagcatctgcgccttccagaacagcttcctgggcggcctgcccgtgggcatgaccagcaacggcgtggccctgctgaacttctacaacatgcccagcacccccagcttcgtgggctgcctgcaggacatcaagatcgactggaaccacatcaccctggagaacatcagcagcggcagcagcctgaacgtgaaggccggctgcgtgagaaaggactggtgcgagagccagccctgccagagcagaggcagatgcatcaacctgtggctgagctaccagtgcgactgccacagaccctacgagggccccaactgcctgagagagtacgtggccggcagattcggccaggacgacagcaccggctacgtgatcttcaccctggacgagagctacggcgacaccatcagcctgagcatgttcgtgagaaccctgcagcccagcggcctgctgctggccctggagaacagcacctaccagtacatcagagtgtggctggagagaggcagactggccatgctgacccccaacagccccaagctggtggtgaagttcgtgctgaacgacggcaacgtgcacctgatcagcctgaagatcaagccctacaagatcgagctgtaccagagcagccagaacctgggcttcatcagcgccagcacctggaagatcgagaagggcgacgtgatctacatcggcggcctgcccgacaagcaggagaccgagctgaacggcggcttcttcaagggctgcatccaggacgtgagactgaacaaccagaacctggagttcttccccaaccccaccaacaacgccagcctgaaccccgtgctggtgaacgtgacccagggctgcgccggcgacaacagctgcaagagcaacccctgccacaacggcggcgtgtgccacagcagatgggacgacttcagctgcagctgccccgccctgaccagcggcaaggcctgcgaggaggtgcagtggtgcggcttcagcccctgcccccacggcgcccagtgccagcccgtgctgcagggcttcgagtgcatcgccaacgccgtgttcaacggccagagcggccagatcctgttcagaagcaacggcaacatcaccagagagctgaccaacatcaccttcggcttcagaaccagagacgccaacgtgatcatcctgcacgccgagaaggagcccgagttcctgaacatcagcatccaggacagcagactgttcttccagctgcagagcggcaacagcttctacatgctgagcctgaccagcctgcagagcgtgaacgacggcacctggcacgaggtgaccctgagcatgaccgaccccctgagccagaccagcagatggcagatggaggtggacaacgagacccccttcgtgaccagcaccatcgccaccggcagcctgaacttcctgaaggacaacaccgacatctacgtgggcgacagagccatcgacaacatcaagggcctgcagggctgcctgagcaccatcgagatcggcggcatctacctgagctacttcgagaacgtgcacggcttcatcaacaagccccaggaggagcagttcctgaagatcagcaccaacagcgtggtgaccggctgcctgcagctgaacgtgtgcaacagcaacccctgcctgcacggcggcaactgcgaggacatctacagcagctaccactgcagctgccccctgggctggagcggcaagcactgcgagctgaacatcgacgagtgcttcagcaacccctgcatccacggcaactgcagcgacagagtggccgcctaccactgcacctgcgagcccggctacaccggcgtgaactgcgaggtggacatcgacaactgccagagccaccagtgcgccaacggcgccacctgcatcagccacaccaacggctacagctgcctgtgcttcggcaacttcaccggcaagttctgcagacagagcagactgcccagcaccgtgtgcggcaacgagaagaccaacctgacctgctacaacggcggcaactgcaccgagttccagaccgagctgaagtgcatgtgcagacccggcttcaccggcgagtag

SEQ ID NO: 77774 - DNA, 129 bp, Artificial Sequence
  Description of Artificial Sequence: Synthetic coding sequence
gagaaggacatcgacgagtgcgccagcgacccctgcgtgaacggcggcctgtgccaggacctgctgaacaagttccagtgcctgtgcgacgtggccttcgccggcgagagatgcgaggtggactactag

SEQ ID NO: 77775 - DNA, 4149 bp, Artificial Sequence
  Description of Artificial Sequence: Synthetic coding sequence
atgaaggacccctgcttcagcaacccctgccagggcagcgccacctgcgtgaacacccccggcgagagaagcttcctgtgcaagtgcccccccggctacagcggcaccatctgcgagaccaccatcggcagctgcggcaagaacagctgccagcacggcggcatctgccaccaggaccccatctaccccgtgtgcatctgccccgccggctacgccggcagattctgcgagatcgaccacgacgagtgcgccagcagcccctgccagaacggcgccgtgtgccaggacggcatcgacggctacagctgcttctgcgtgcccggctaccagggcagacactgcgacctggaggtggacgagtgcgccagcgacccctgcaagaacgaggccacctgcctgaacgagatcggcagatacacctgcatctgcccccacaactacagcggcgtgaactgcgagctggagatcgacgagtgctggagccagccctgcctgaacggcgccacctgccaggacgccctgggcgcctacttctgcgactgcgcccccggcttcctgggcgaccactgcgagctgaacaccgacgagtgcgccagccagccctgcctgcacggcggcctgtgcgtggacggcgagaacagatacagctgcaactgcaccggcagcggcttcaccggcacccactgcgagaccctgatgcccctgtgctggagcaagccctgccacaacaacgccacctgcgaggacagcgtggacaactacacctgccactgctggcccggctacaccggcgcccagtgcgagatcgacctgaacgagtgcaacagcaacccctgccagagcaacggcgagtgcgtggagctgagcagcgagaagcagtacggcagaatcaccggcctgcccagcagcttcagctaccacgaggccagcggctacgtgtgcatctgccagcccggcttcaccggcatccactgcgaggaggacgtgaacgagtgcagcagcaacccctgccagaacggcggcacctgcgagaacctgcccggcaactacacctgccactgccccttcgacaacctgagcagaaccttctacggcggcagagactgcagcgacatcctgctgggctgcacccaccagcagtgcctgaacaacggcacctgcatcccccacttccaggacggccagcacggcttcagctgcctgtgccccagcggctacaccggcagcctgtgcgagatcgccaccaccctgagcttcgagggcgacggcttcctgtgggtgaagagcggcagcgtgaccaccaagggcagcgtgtgcaacatcgccctgagattccagaccgtgcagcccatggccctgctgctgttcagaagcaacagagacgtgttcgtgaagctggagctgctgagcggctacatccacctgagcatccaggtgaacaaccagagcaaggtgctgctgttcatcagccacaacaccagcgacggcgagtggcacttcgtggaggtgatcttcgccgaggccgtgaccctgaccctgatcgacgacagctgcaaggagaagtgcatcgccaaggcccccacccccctggagagcgaccagagcatctgcgccttccagaacagcttcctgggcggcctgcccgtgggcatgaccagcaacggcgtggccctgctgaacttctacaacatgcccagcacccccagcttcgtgggctgcctgcaggacatcaagatcgactggaaccacatcaccctggagaacatcagcagcggcagcagcctgaacgtgaaggccggctgcgtgagaaaggactggtgcgagagccagccctgccagagcagaggcagatgcatcaacctgtggctgagctaccagtgcgactgccacagaccctacgagggccccaactgcctgagagagtacgtggccggcagattcggccaggacgacagcaccggctacgtgatcttcaccctggacgagagctacggcgacaccatcagcctgagcatgttcgtgagaaccctgcagcccagcggcctgctgctggccctggagaacagcacctaccagtacatcagagtgtggctggagagaggcagactggccatgctgacccccaacagccccaagctggtggtgaagttcgtgctgaacgacggcaacgtgcacctgatcagcctgaagatcaagccctacaagatcgagctgtaccagagcagccagaacctgggcttcatcagcgccagcacctggaagatcgagaagggcgacgtgatctacatcggcggcctgcccgacaagcaggagaccgagctgaacggcggcttcttcaagggctgcatccaggacgtgagactgaacaaccagaacctggagttcttccccaaccccaccaacaacgccagcctgaaccccgtgctggtgaacgtgacccagggctgcgccggcgacaacagctgcaagagacagaccaacgtgggcagagccctgaccgagctgggcagcagaggccccaagtaccaggtgagcctgttcagattctgcgtgggcagctgggccaccggcaacaccttcttcctgagcagcatcaagcccggcagcaacccctgccacaacggcggcgtgtgccacagcagatgggacgacttcagctgcagctgccccgccctgaccagcggcaaggcctgcgaggaggtgcagtggtgcggcttcagcccctgcccccacggcgcccagtgccagcccgtgctgcagggcttcgagtgcatcgccaacgccgtgttcaacggccagagcggccagatcctgttcagaagcaacggcaacatcaccagagagctgaccaacatcaccttcggcttcagaaccagagacgccaacgtgatcatcctgcacgccgagaaggagcccgagttcctgaacatcagcatccaggacagcagactgttcttccagctgcagagcggcaacagcttctacatgctgagcctgaccagcctgcagagcgtgaacgacggcacctggcacgaggtgaccctgagcatgaccgaccccctgagccagaccagcagatggcagatggaggtggacaacgagacccccttcgtgaccagcaccatcgccaccggcagcctgaacttcctgaaggacaacaccgacatctacgtgggcgacagagccatcgacaacatcaagggcctgcagggctgcctgagcaccatcgagatcggcggcatctacctgagctacttcgagaacgtgcacggcttcatcaacaagccccaggaggagcagttcctgaagatcagcaccaacagcgtggtgaccggctgcctgcagctgaacgtgtgcaacagcaacccctgcctgcacggcggcaactgcgaggacatctacagcagctaccactgcagctgccccctgggctggagcggcaagcactgcgagctgaacatcgacgagtgcttcagcaacccctgcatccacggcaactgcagcgacagagtggccgcctaccactgcacctgcgagcccggctacaccggcgtgaactgcgaggtggacatcgacaactgccagagccaccagtgcgccaacggcgccacctgcatcagccacaccaacggctacagctgcctgtgcttcggcaacttcaccggcaagttctgcagacagagcagactgcccagcaccgtgtgcggcaacgagaagaccaacctgacctgctacaacggcggcaactgcaccgagttccagaccgagctgaagtgcatgtgcagacccggcttcaccggcgagtggtgcgagaaggacatcgacgagtgcgccagcgacccctgcgtgaacggcggcctgtgccaggacctgctgaacaagttccagtgcctgtgcgacgtggccttcgccggcgagagatgcgaggtggacctggccgacgacctgatcagcgacatcttcaccaccatcggcagcgtgaccgtggccctgctgctgatcctgctgctggccatcgtggccagcgtggtgaccagcaacaagagagccacccagggcacctacagccccagcagacaggagaaggagggcagcagagtggagatgtggaacctgatgcccccccccgccatggagagactgatctag

SEQ ID NO: 77776 - DNA, 2613 bp, Artificial Sequence
  Description of Artificial Sequence: Synthetic coding sequence
atggccctgaagaacatcaactacctgctgatcttctacctgagcttcagcctgctgatctacatcaagaacagcttctgcaacaagaacaacaccagatgcctgagcaacagctgccagaacaacagcacctgcaaggacttcagcaaggacaacgactgcagctgcagcgacaccgccaacaacctggacaaggactgcgacaacatgaaggacccctgcttcagcaacccctgccagggcagcgccacctgcgtgaacacccccggcgagagaagcttcctgtgcaagtgcccccccggctacagcggcaccatctgcgagaccaccatcggcagctgcggcaagaacagctgccagcacggcggcatctgccaccaggaccccatctaccccgtgtgcatctgccccgccggctacgccggcagattctgcgagatcgaccacgacgagtgcgccagcagcccctgccagaacggcgccgtgtgccaggacggcatcgacggctacagctgcttctgcgtgcccggctaccagggcagacactgcgacctggaggtggacgagtgcgccagcgacccctgcaagaacgaggccacctgcctgaacgagatcggcagatacacctgcatctgcccccacaactacagcggcgtgaactgcgagctggagatcgacgagtgctggagccagccctgcctgaacggcgccacctgccaggacgccctgggcgcctacttctgcgactgcgcccccggcttcctgggcgaccactgcgagctgaacaccgacgagtgcgccagccagccctgcctgcacggcggcctgtgcgtggacggcgagaacagatacagctgcaactgcaccggcagcggcttcaccggcacccactgcgagaccctgatgcccctgtgctggagcaagccctgccacaacaacgccacctgcgaggacagcgtggacaactacacctgccactgctggcccggctacaccggcgcccagtgcgagatcgacctgaacgagtgcaacagcaacccctgccagagcaacggcgagtgcgtggagctgagcagcgagaagcagtacggcagaatcaccggcctgcccagcagcttcagctaccacgaggccagcggctacgtgtgcatctgccagcccggcttcaccggcatccactgcgaggaggacgtgaacgagtgcagcagcaacccctgccagaacggcggcacctgcgagaacctgcccggcaactacacctgccactgccccttcgacaacctgagcagaaccttctacggcggcagagactgcagcgacatcctgctgggctgcacccaccagcagtgcctgaacaacggcacctgcatcccccacttccaggacggccagcacggcttcagctgcctgtgccccagcggctacaccggcagcctgtgcgagatcgccaccaccctgagcttcgagggcgacggcttcctgtgggtgaagagcggcagcgtgaccaccaagggcagcgtgtgcaacatcgccctgagattccagaccgtgcagcccatggccctgctgctgttcagaagcaacagagacgtgttcgtgaagctggagctgctgagcggctacatccacctgagcatccaggtgaacaaccagagcaaggtgctgctgttcatcagccacaacaccagcgacggcgagtggcacttcgtggaggtgatcttcgccgaggccgtgaccctgaccctgatcgacgacagctgcaaggagaagtgcatcgccaaggcccccacccccctggagagcgaccagagcatctgcgccttccagaacagcttcctgggcggcctgcccgtgggcatgaccagcaacggcgtggccctgctgaacttctacaacatgcccagcacccccagcttcgtgggctgcctgcaggacatcaagatcgactggaaccacatcaccctggagaacatcagcagcggcagcagcctgaacgtgaaggccggctgcgtgagaaaggactggtgcgagagccagccctgccagagcagaggcagatgcatcaacctgtggctgagctaccagtgcgactgccacagaccctacgagggccccaactgcctgagaggcaagttctgcagacagagcagactgcccagcaccgtgtgcggcaacgagaagaccaacctgacctgctacaacggcggcaactgcaccgagttccagaccgagctgaagtgcatgtgcagacccggcttcaccggcgagtggtgcgagaaggacatcgacgagtgcgccagcgacccctgcgtgaacggcggcctgtgccaggacctgctgaacaagttccagtgcctgtgcgacgtggccttcgccggcgagagatgcgaggtggacctggccgacgacctgatcagcgacatcttcaccaccatcggcagcgtgaccgtggccctgctgctgatcctgctgctggccatcgtggccagcgtggtgaccagcaacaagagagccacccagggcacctacagccccagcagacaggagaaggagggcagcagagtggagatgtggaacctgatgcccccccccgccatggagagactgatctag

SEQ ID NO: 77777 - DNA, 882 bp, Artificial Sequence
  Description of Artificial Sequence: Synthetic coding sequence
atgcccctgtgctggagcaagccctgccacaacaacgccacctgcgaggacagcgtggacaactacacctgccactgctggcccggctacaccggcgcccagtgcgagatcgacctgaacgagtgcaacagcaacccctgccagagcaacggcgagtgcgtggagctgagcagcgagaagcagtacggcagaatcaccggcctgcccagcagcttcagctaccacgaggccagcggctacgtgtgcatctgccagcccggcttcaccggcatccactgcgaggaggacgtgaacgagtgcagcagcaacccctgccagaacggcggcacctgcgagaacctgcccggcaactacacctgccactgccccttcgacaacctgagcagaaccttctacggcggcagagactgcagcgacatcctgctgggctgcacccaccagcagtgcctgaacaacggcacctgcatcccccacttccaggacggccagcacggcttcagctgcctgtgccccagcggctacaccggcagcctgtgcgagatcgccaccaccctgagcttcgagggcgacggcttcctgtgggtgaagagcggcagcgtgaccaccaagggcagcgtgtgcaacatcgccctgagattccagaccgtgcagcccatggccctgctgctgttcagaagcaacagagacgtgttcgtgaagctggagctgctgagcggctacatccacctgagcatccaggtgaacaaccagagcaaggtgctgctgttcatcagccacaacaccagcgacggcgagtggcacttcgtggaggccgtgagcaagaccctgaagctgatcggcatcaccctgccctggagaaccagcagactggcccaccactag

SEQ ID NO: 77778 - DNA, 2664 bp, Artificial Sequence
  Description of Artificial Sequence: Synthetic coding sequence
atggccctgctgctgttcagaagcaacagagacgtgttcgtgaagctggagctgctgagcggctacatccacctgagcatccaggtgaacaaccagagcaaggtgctgctgttcatcagccacaacaccagcgacggcgagtggcacttcgtggaggtgatcttcgccgaggccgtgaccctgaccctgatcgacgacagctgcaaggagaagtgcatcgccaaggcccccacccccctggagagcgaccagagcatctgcgccttccagaacagcttcctgggcggcctgcccgtgggcatgaccagcaacggcgtggccctgctgaacttctacaacatgcccagcacccccagcttcgtgggctgcctgcaggacatcaagatcgactggaaccacatcaccctggagaacatcagcagcggcagcagcctgaacgtgaaggccggctgcgtgagaaaggactggtgcgagagccagccctgccagagcagaggcagatgcatcaacctgtggctgagctaccagtgcgactgccacagaccctacgagggccccaactgcctgagagagtacgtggccggcagattcggccaggacgacagcaccggctacgtgatcttcaccctggacgagagctacggcgacaccatcagcctgagcatgttcgtgagaaccctgcagcccagcggcctgctgctggccctggagaacagcacctaccagtacatcagagtgtggctggagagaggcagactggccatgctgacccccaacagccccaagctggtggtgaagttcgtgctgaacgacggcaacgtgcacctgatcagcctgaagatcaagccctacaagatcgagctgtaccagagcagccagaacctgggcttcatcagcgccagcacctggaagatcgagaagggcgacgtgatctacatcggcggcctgcccgacaagcaggagaccgagctgaacggcggcttcttcaagggctgcatccaggacgtgagactgaacaaccagaacctggagttcttccccaaccccaccaacaacgccagcctgaaccccgtgctggtgaacgtgacccagggctgcgccggcgacaacagctgcaagagcaacccctgccacaacggcggcgtgtgccacagcagatgggacgacttcagctgcagctgccccgccctgaccagcggcaaggcctgcgaggaggtgcagtggtgcggcttcagcccctgcccccacggcgcccagtgccagcccgtgctgcagggcttcgagtgcatcgccaacgccgtgttcaacggccagagcggccagatcctgttcagaagcaacggcaacatcaccagagagctgaccaacatcaccttcggcttcagaaccagagacgccaacgtgatcatcctgcacgccgagaaggagcccgagttcctgaacatcagcatccaggacagcagactgttcttccagctgcagagcggcaacagcttctacatgctgagcctgaccagcctgcagagcgtgaacgacggcacctggcacgaggtgaccctgagcatgaccgaccccctgagccagaccagcagatggcagatggaggtggacaacgagacccccttcgtgaccagcaccatcgccaccggcagcctgaacttcctgaaggacaacaccgacatctacgtgggcgacagagccatcgacaacatcaagggcctgcagggctgcctgagcaccatcgagatcggcggcatctacctgagctacttcgagaacgtgcacggcttcatcaacaagccccaggaggagcagttcctgaagatcagcaccaacagcgtggtgaccggctgcctgcagctgaacgtgtgcaacagcaacccctgcctgcacggcggcaactgcgaggacatctacagcagctaccactgcagctgccccctgggctggagcggcaagcactgcgagctgaacatcgacgagtgcttcagcaacccctgcatccacggcaactgcagcgacagagtggccgcctaccactgcacctgcgagcccggctacaccggcgtgaactgcgaggtggacatcgacaactgccagagccaccagtgcgccaacggcgccacctgcatcagccacaccaacggctacagctgcctgtgcttcggcaacttcaccggcaagttctgcagacagagcagactgcccagcaccgtgtgcggcaacgagaagaccaacctgacctgctacaacggcggcaactgcaccgagttccagaccgagctgaagtgcatgtgcagacccggcttcaccggcgagtggtgcgagaaggacatcgacgagtgcgccagcgacccctgcgtgaacggcggcctgtgccaggacctgctgaacaagttccagtgcctgtgcgacgtggccttcgccggcgagagatgcgaggtggacctggccgacgacctgatcagcgacatcttcaccaccatcggcagcgtgaccgtggccctgctgctgatcctgctgctggccatcgtggccagcgtggtgaccagcaacaagagagccacccagggcacctacagccccagcagacaggagaaggagggcagcagagtggagatgtggaacctgatgcccccccccgccatggagagactgatctag

SEQ ID NO: 77779 - DNA, 3885 bp, Artificial Sequence
  Description of Artificial Sequence: Synthetic coding sequence
atggccctgaagaacatcaactacctgctgatcttctacctgagcttcagcctgctgatctacatcaagaacagcttctgcaacaagaacaacaccagatgcctgagcaacagctgccagaacaacagcacctgcaaggacttcagcaaggacaacgactgcagctgcagcgacaccgccaacaacctggacaaggactgcgacaacatgaaggacccctgcttcagcaacccctgccagggcagcgccacctgcgtgaacacccccggcgagagaagcttcctgtgcaagtgcccccccggctacagcggcaccatctgcgagaccaccatcggcagctgcggcaagaacagctgccagcacggcggcatctgccaccaggaccccatctaccccgtgtgcatctgccccgccggctacgccggcagattctgcgagatcgaccacgacgagtgcgccagcagcccctgccagaacggcgccgtgtgccaggacggcatcgacggctacagctgcttctgcgtgcccggctaccagggcagacactgcgacctggaggtggacgagtgcgccagcgacccctgcaagaacgaggccacctgcctgaacgagatcggcagatacacctgcatctgcccccacaactacagcggctacaccggcgcccagtgcgagatcgacctgaacgagtgcaacagcaacccctgccagagcaacggcgagtgcgtggagctgagcagcgagaagcagtacggcagaatcaccggcctgcccagcagcttcagctaccacgaggccagcggctacgtgtgcatctgccagcccggcttcaccggcatccactgcgaggaggacgtgaacgagtgcagcagcaacccctgccagaacggcggcacctgcgagaacctgcccggcaactacacctgccactgccccttcgacaacctgagcagaaccttctacggcggcagagactgcagcgacatcctgctgggctgcacccaccagcagtgcctgaacaacggcacctgcatcccccacttccaggacggccagcacggcttcagctgcctgtgccccagcggctacaccggcagcctgtgcgagatcgccaccaccctgagcttcgagggcgacggcttcctgtgggtgaagagcggcagcgtgaccaccaagggcagcgtgtgcaacatcgccctgagattccagaccgtgcagcccatggccctgctgctgttcagaagcaacagagacgtgttcgtgaagctggagctgctgagcggctacatccacctgagcatccaggtgaacaaccagagcaaggtgctgctgttcatcagccacaacaccagcgacggcgagtggcacttcgtggaggtgatcttcgccgaggccgtgaccctgaccctgatcgacgacagctgcaaggagaagtgcatcgccaaggcccccacccccctggagagcgaccagagcatctgcgccttccagaacagcttcctgggcggcctgcccgtgggcatgaccagcaacggcgtggccctgctgaacttctacaacatgcccagcacccccagcttcgtgggctgcctgcaggacatcaagatcgactggaaccacatcaccctggagaacatcagcagcggcagcagcctgaacgtgaaggccggctgcgtgagaaaggactggtgcgagagccagccctgccagagcagaggcagatgcatcaacctgtggctgagctaccagtgcgactgccacagaccctacgagggccccaactgcctgagagagtacgtggccggcagattcggccaggacgacagcaccggctacgtgatcttcaccctggacgagagctacggcgacaccatcagcctgagcatgttcgtgagaaccctgcagcccagcggcctgctgctggccctggagaacagcacctaccagtacatcagagtgtggctggagagaggcagactggccatgctgacccccaacagccccaagctggtggtgaagttcgtgctgaacgacggcaacgtgcacctgatcagcctgaagatcaagccctacaagatcgagctgtaccagagcagccagaacctgggcttcatcagcgccagcacctggaagatcgagaagggcgacgtgatctacatcggcggcctgcccgacaagcaggagaccgagctgaacggcggcttcttcaagggctgcatccaggacgtgagactgaacaaccagaacctggagttcttccccaaccccaccaacaacgccagcctgaaccccgtgctggtgaacgtgacccagggctgcgccggcgacaacagctgcaagagcaacccctgccacaacggcggcgtgtgccacagcagatgggacgacttcagctgcagctgccccgccctgaccagcggcaaggcctgcgaggaggtgcagtggtgcggcttcagcccctgcccccacggcgcccagtgccagcccgtgctgcagggcttcgagtgcatcgccaacgccgtgttcaacggccagagcggccagatcctgttcagaagcaacggcaacatcaccagagagctgaccaacatcaccttcggcttcagaaccagagacgccaacgtgatcatcctgcacgccgagaaggagcccgagttcctgaacatcagcatccaggacagcagactgttcttccagctgcagagcggcaacagcttctacatgctgagcctgaccagcctgcagagcgtgaacgacggcacctggcacgaggtgaccctgagcatgaccgaccccctgagccagaccagcagatggcagatggaggtggacaacgagacccccttcgtgaccagcaccatcgccaccggcagcctgaacttcctgaaggacaacaccgacatctacgtgggcgacagagccatcgacaacatcaagggcctgcagggctgcctgagcaccatcgagatcggcggcatctacctgagctacttcgagaacgtgcacggcttcatcaacaagccccaggaggagcagttcctgaagatcagcaccaacagcgtggtgaccggctgcctgcagctgaacgtgtgcaacagcaacccctgcctgcacggcggcaactgcgaggacatctacagcagctaccactgcagctgccccctgggctggagcggcaagcactgcgagctgaacatcgacgagtgcttcagcaacccctgcatccacggcaactgcagcgacagagtggccgcctaccactgcacctgcgagcccggctacaccggcgtgaactgcgaggtggacatcgacaactgccagagccaccagtgcgccaacggcgccacctgcatcagccacaccaacggctacagctgcctgtgcttcggcaacttcaccggcaagttctgcagacagagcagactgcccagcaccgtgtgcggcaacgagaagaccaacctgacctgctacaacggcggcaactgcaccgagttccagaccgagctgaagtgcatgtgcagacccggcttcaccggcgagtggtgcgagaaggacatcgacgagtgcgccagcgacccctgcgtgaacggcggcctgtgccaggacctgctgaacaagttccagtgcctgtgcgacgtggccttcgccggcgagagatgcgaggtggacctggccgacgacctgatcagcgacatcttcaccaccatcggcagcgtgaccgtggccctgctgctgatcctgctgctggccatcgtggccagcgtggtgaccagcaacaagagagccacccagggcacctacagccccagcagacaggagaaggagggcagcagagtggagatgtggaacctgatgcccccccccgccatggagagactgatctag

SEQ ID NO: 77780 - DNA, 3531 bp, Artificial Sequence
  Description of Artificial Sequence: Synthetic coding sequence
atggccctggccagacccggcacccccgacccccaggccctggccagcgtgctgctgctgctgctgtgggcccccgccctgagcctgctggccggcaccgtgcccagcgagccccccagcgcctgcgccagcgacccctgcgcccccggcaccgagtgccaggccaccgagagcggcggctacacctgcggccccatggagcccagaggctgcgccacccagccctgccaccacggcgccctgtgcgtgccccagggccccgaccccaccggcttcagatgctactgcgtgcccggcttccagggccccagatgcgagctggacatcgacgagtgcgccagcagaccctgccaccacggcgccacctgcagaaacctggccgacagatacgagtgccactgccccctgggctacgccggcgtgacctgcgagatggaggtggacgagtgcgccagcgccccctgcctgcacggcggcagctgcctggacggcgtgggcagcttcagatgcgtgtgcgcccccggctacggcggcaccagatgccagctggacctggacgagtgccagagccagccctgcgcccacggcggcacctgccacgacctggtgaacggcttcagatgcgactgcgccggcaccggctacgagggcacccactgcgagagagaggtgctggagtgcgccagcgccccctgcgagcacaacgccagctgcctggagggcctgggcagcttcagatgcctgtgctggcccggctacagcggcgagctgtgcgaggtggacgaggacgagtgcgccagcagcccctgccagcacggcggcagatgcctgcagagaagcgaccccgccctgtacggcggcgtgcaggccgccttccccggcgccttcagcttcagacacgccgccggcttcctgtgccactgcccccccggcttcgagggcgccgactgcggcgtggaggtggacgagtgcgccagcagaccctgcctgaacggcggccactgccaggacctgcccaacggcttccagtgccactgccccgacggctacgccggccccacctgcgaggaggacgtggacgagtgcctgagcgacccctgcctgcacggcggcacctgcagcgacaccgtggccggctacatctgcagatgccccgagacctggggcggcagagactgcagcgtgcagctgaccggctgccagggccacacctgccccctggccgccacctgcatccccatcttcgagagcggcgtgcacagctacgtgtgccactgcccccccggcacccacggccccttctgcggccagaacaccaccttcagcgtgatggccggcagccccatccaggccagcgtgcccgccggcggccccctgggcctggccctgagattcagaaccaccctgcccgccggcaccctggccaccagaaacgacaccaaggagagcctggagctggccctggtggccgccaccctgcaggccaccctgtggagctacagcaccaccgtgctggtgctgagactgcccgacctggccctgaacgacggccactggcaccaggtggaggtggtgctgcacctggccaccctggagctgagactgtggcacgagggctgccccgccagactgtgcgtggccagcggccccgtggccctggccagcaccgccagcgccacccccctgcccgccggcatcagcagcgcccagctgggcgacgccaccttcgccggctgcctgcaggacgtgagagtggacggccacctgctgctgcccgaggacctgggcgagaacgtgctgctgggctgcgagagaagagagcagtgcagacccctgccctgcgtgcacggcggcagctgcgtggacctgtggacccacttcagatgcgactgcgccagaccccacagaggccccacctgcgccgacgagatccccgccgccaccttcggcctgggcggcgcccccagcagcgccagcttcctgctgcaggagctgcccggccccaacctgaccgtgagcttcctgctgagaaccagagagagcgccggcctgctgctgcagttcgccaacgacagcgccgccggcctgaccgtgttcctgagcgagggcagaatcagagccgaggtgcccggcagccccgccgtggtgctgcccggcagatgggacgacggcctgagacacctggtgatgctgagcttcggccccgaccagctgcaggacctgggccagcacgtgcacgtgggcggcagactgctggccgccgacagccagccctggggcggccccttcagaggctgcctgcaggacctgagactggacggctgccacctgcccttcttccccctgcccctggacaacagcagccagcccagcgagctgggcggcagacagagctggaacctgaccgccggctgcgtgagcgaggacatgtgcagccccgacccctgcttcaacggcggcacctgcctggtgacctggaacgacttccactgcacctgccccgccaacttcaccggccccacctgcgcccagcagctgtggtgccccggccagccctgcctgccccccgccacctgcgaggaggtgcccgacggcttcgtgtgcgtggccgaggccaccttcagagagggcccccccgccgccttcagcggccacaacgccagcagcggcagactgctgggcggcctgagcctggccttcagaaccagagacagcgaggcctggctgctgagagccgccgccggcgccctggagggcgtgtggctggccgtgagaaacggcagcctggccggcggcgtgagaggcggccacggcctgcccggcgccgtgctgcccatccccggccccagagtggccgacggcgcctggcacagagtgagactggccatggagagacccgccgccaccaccagcagatggctgctgtggctggacggcgccgccacccccgtggccctgagaggcctggccagcgacctgggcttcctgcagggccccggcgccgtgagaatcctgctggccgagaacttcaccggctgcctgggcagagtggccctgggcggcctgcccctgcccctggccagacccagacccggcgccgcccccggcgccagagagcacttcgccagctggcccggcacccccgcccccatcctgggctgcagaggcgcccccgtgtgcgcccccagcccctgcctgcacgacggcgcctgcagagacctgttcgacgccttcgcctgcgcctgcggccccggctgggagggccccagatgcgaggcccacgtggacccctgccacagcgccccctgcgccagaggcagatgccacacccaccccgacggcagattcgagtgcagatgcccccccggcttcggcggccccagatgcagatgggacggctgggccggcggctgggccgccaacgccccctggggctacggcggcgccgagaagagcgccagaagcgtggacgagagcctgcccttccccggcccccacgtgctgatctgcgacatgagaagaaccgtgtag

SEQ ID NO: 77781 - DNA, 2862 bp, Artificial Sequence
  Description of Artificial Sequence: Synthetic coding sequence
atggccatggagcccggcgccctgtggaccttcctgggccacctgtggctgctggccggccccacctgcgaggaggacgtggacgagtgcctgagcgacccctgcctgcacggcggcacctgcagcgacaccgtggccggctacatctgcagatgccccgagacctggggcggcagagactgcagcgtgcagctgaccggctgccagggccacacctgccccctggccgccacctgcatccccatcttcgagagcggcgtgcacagctacgtgtgccactgcccccccggcacccacggccccttctgcggccagaacaccaccttcagcgtgatggccggcagccccatccaggccagcgtgcccgccggcggccccctgggcctggccctgagattcagaaccaccctgcccgccggcaccctggccaccagaaacgacaccaaggagagcctggagctggccctggtggccgccaccctgcaggccaccctgtggagctacagcaccaccgtgctggtgctgagactgcccgacctggccctgaacgacggccactggcaccaggtggaggtggtgctgcacctggccaccctggagctgagactgtggcacgagggctgccccgccagactgtgcgtggccagcggccccgtggccctggccagcaccgccagcgccacccccctgcccgccggcatcagcagcgcccagctgggcgacgccaccttcgccggctgcctgcaggacgtgagagtggacggccacctgctgctgcccgaggacctgggcgagaacgtgctgctgggctgcgagagaagagagcagtgcagacccctgccctgcgtgcacggcggcagctgcgtggacctgtggacccacttcagatgcgactgcgccagaccccacagaggccccacctgcgccgacgagatccccgccgccaccttcggcctgggcggcgcccccagcagcgccagcttcctgctgcaggagctgcccggccccaacctgaccgtgagcttcctgctgagaaccagagagagcgccggcctgctgctgcagttcgccaacgacagcgccgccggcctgaccgtgttcctgagcgagggcagaatcagagccgaggtgcccggcagccccgccgtggtgctgcccggcagatgggacgacggcctgagacacctggtgatgctgagcttcggccccgaccagctgcaggacctgggccagcacgtgcacgtgggcggcagactgctggccgccgacagccagccctggggcggccccttcagaggctgcctgcaggacctgagactggacggctgccacctgcccttcttccccctgcccctggacaacagcagccagcccagcgagctgggcggcagacagagctggaacctgaccgccggctgcgtgagcgaggacatgtgcagccccgacccctgcttcaacggcggcacctgcctggtgacctggaacgacttccactgcacctgccccgccaacttcaccggccccacctgcgcccagcagctgtggtgccccggccagccctgcctgccccccgccacctgcgaggaggtgcccgacggcttcgtgtgcgtggccgaggccaccttcagagagggcccccccgccgccttcagcggccacaacgccagcagcggcagactgctgggcggcctgagcctggccttcagaaccagagacagcgaggcctggctgctgagagccgccgccggcgccctggagggcgtgtggctggccgtgagaaacggcagcctggccggcggcgtgagaggcggccacggcctgcccggcgccgtgctgcccatccccggccccagagtggccgacggcgcctggcacagagtgagactggccatggagagacccgccgccaccaccagcagatggctgctgtggctggacggcgccgccacccccgtggccctgagaggcctggccagcgacctgggcttcctgcagggccccggcgccgtgagaatcctgctggccgagaacttcaccggctgcctgggcagagtggccctgggcggcctgcccctgcccctggccagacccagacccggcgccgcccccggcgccagagagcacttcgccagctggcccggcacccccgcccccatcctgggctgcagaggcgcccccgtgtgcgcccccagcccctgcctgcacgacggcgcctgcagagacctgttcgacgccttcgcctgcgcctgcggccccggctgggagggccccagatgcgaggcccacgtggacccctgccacagcgccccctgcgccagaggcagatgccacacccaccccgacggcagattcgagtgcagatgcccccccggcttcggcggccccagatgcagactgcccgtgcccagcaaggagtgcagcctgaacgtgacctgcctggacggcagcccctgcgagggcggcagccccgccgccaactgcagctgcctggagggcctggccggccagagatgccaggtgcccaccctgccctgcgaggccaacccctgcctgaacggcggcacctgcagagccgccggcggcgtgagcgagtgcatctgcaacgccagattcagcggccagttctgcgaggtggccaagggcctgcccctgcccctgcccttccccctgctggaggtggccgtgcccgccgcctgcgcctgcctgctgctgctgctgctgggcctgctgagcggcatcctggccgccagaaagagaagacagagcgagggcacctacagccccagccagcaggaggtggccggcgccagactggagatggacagcgtgctgaaggtgccccccgaggagagactgatctag

SEQ ID NO: 77782 - DNA, 3858 bp, Artificial Sequence
  Description of Artificial Sequence: Synthetic coding sequence
atggccctggccagacccggcacccccgacccccaggccctggccagcgtgctgctgctgctgctgtgggcccccgccctgagcctgctggccggcaccgtgcccagcgagccccccagcgcctgcgccagcgacccctgcgcccccggcaccgagtgccaggccaccgagagcggcggctacacctgcggccccatggagcccagaggctgcgccacccagccctgccaccacggcgccctgtgcgtgccccagggccccgaccccaccggcttcagatgctactgcgtgcccggcttccagggccccagatgcgagctggacatcgacgagtgcgccagcagaccctgccaccacggcgccacctgcagaaacctggccgacagatacgagtgccactgccccctgggctacgccggcgtgacctgcgagatggaggtggacgagtgcgccagcgccccctgcctgcacggcggcagctgcctggacggcgtgggcagcttcagatgcgtgtgcgcccccggctacggcggcaccagatgccagctggacctggacgagtgccagagccagccctgcgcccacggcggcacctgccacgacctggtgaacggcttcagatgcgactgcgccggcaccggctacgagggcacccactgcgagagagaggtgctggagtgcgccagcgccccctgcgagcacaacgccagctgcctggagggcctgggcagcttcagatgcctgtgctggcccggctacagcggcgagctgtgcgaggtggacgaggacgagtgcgccagcagcccctgccagcacggcggcagatgcctgcagagaagcgaccccgccctgtacggcggcgtgcaggccgccttccccggcgccttcagcttcagacacgccgccggcttcctgtgccactgcccccccggcttcgagggcgccgactgcggcgtggaggtggacgagtgcgccagcagaccctgcctgaacggcggccactgccaggacctgcccaacggcttccagtgccactgccccgacggctacgccggccccacctgcgaggaggacgtggacgagtgcctgagcgacccctgcctgcacggcggcacctgcagcgacaccgtggccggctacatctgcagatgccccgagacctggggcggcagagactgcagcgtgcagctgaccggctgccagggccacacctgccccctggccgccacctgcatccccatcttcgagagcggcgtgcacagctacgtgtgccactgcccccccggcacccacggccccttctgcggccagaacaccaccttcagcgtgatggccggcagccccatccaggccagcgtgcccgccggcggccccctgggcctggccctgagattcagaaccaccctgcccgccggcaccctggccaccagaaacgacaccaaggagagcctggagctggccctggtggccgccaccctgcaggccaccctgtggagctacagcaccaccgtgctggtgctgagactgcccgacctggccctgaacgacggccactggcaccaggtggaggtggtgctgcacctggccaccctggagctgagactgtggcacgagggctgccccgccagactgtgcgtggccagcggccccgtggccctggccagcaccgccagcgccacccccctgcccgccggcatcagcagcgcccagctgggcgacgccaccttcgccggctgcctgcaggacgtgagagtggacggccacctgctgctgcccgaggacctgggcgagaacgtgctgctgggctgcgagagaagagagcagtgcagacccctgccctgcgtgcacggcggcagctgcgtggacctgtggacccacttcagatgcgactgcgccagaccccacagaggccccacctgcgccgacgagatccccgccgccaccttcggcctgggcggcgcccccagcagcgccagcttcctgctgcaggagctgcccggccccaacctgaccgtgagcttcctgctgagaaccagagagagcgccggcctgctgctgcagttcgccaacgacagcgccgccggcctgaccgtgttcctgagcgagggcagaatcagagccgaggtgcccggcagccccgccgtggtgctgcccggcagatgggacgacggcctgagacacctggtgatgctgagcttcggccccgaccagctgcaggacctgggccagcacgtgcacgtgggcggcagactgctggccgccgacagccagccctggggcggccccttcagaggctgcctgcaggacctgagactggacggctgccacctgcccttcttccccctgcccctggacaacagcagccagcccagcgagctgggcggcagacagagctggaacctgaccgccggctgcgtgagcgaggacatgtgcagccccgacccctgcttcaacggcggcacctgcctggtgacctggaacgacttccactgcacctgccccgccaacttcaccggccccacctgcgcccagcagctgtggtgccccggccagccctgcctgccccccgccacctgcgaggaggtgcccgacggcttcgtgtgcgtggccgaggccaccttcagagagggcccccccgccgccttcagcggccacaacgccagcagcggcagactgctgggcggcctgagcctggccttcagaaccagagacagcgaggcctggctgctgagagccgccgccggcgccctggagggcgtgtggctggccgtgagaaacggcagcctggccggcggcgtgagaggcggccacggcctgcccggcgccgtgctgcccatccccggccccagagtggccgacggcgcctggcacagagtgagactggccatggagagacccgccgccaccaccagcagatggctgctgtggctggacggcgccgccacccccgtggccctgagaggcctggccagcgacctgggcttcctgcagggccccggcgccgtgagaatcctgctggccgagaacttcaccggctgcctgggcagagtggccctgggcggcctgcccctgcccctggccagacccagacccggcgccgcccccggcgccagagagcacttcgccagctggcccggcacccccgcccccatcctgggctgcagaggcgcccccgtgtgcgcccccagcccctgcctgcacgacggcgcctgcagagacctgttcgacgccttcgcctgcgcctgcggccccggctgggagggccccagatgcgaggcccacgtggacccctgccacagcgccccctgcgccagaggcagatgccacacccaccccgacggcagattcgagtgcagatgcccccccggcttcggcggccccagatgcagactgcccgtgcccagcaaggagtgcagcctgaacgtgacctgcctggacggcagcccctgcgagggcggcagccccgccgccaactgcagctgcctggagggcctggccggccagagatgccaggtgcccaccctgccctgcgaggccaacccctgcctgaacggcggcacctgcagagccgccggcggcgtgagcgagtgcatctgcaacgccagattcagcggccagttctgcgaggtggccaagggcctgcccctgcccctgcccttccccctgctggaggtggccgtgcccgccgcctgcgcctgcctgctgctgctgctgctgggcctgctgagcggcatcctggccgccagaaagagaagacagagcgagggcacctacagccccagccagcaggaggtggccggcgccagactggagatggacagcgtgctgaaggtgccccccgaggagagactgatctag

SEQ ID NO: 77783 - DNA, 363 bp, Artificial Sequence
  Description of Artificial Sequence: Synthetic coding sequence
atggccaaccccggcctgggcctgctgctggccctgggcctgcccttcctgctggccagatggggcagagcctggggccagatccagaccaccagcgccaacgagaacagcaccgtgctgcccagcagcaccagcagcagcagcgacggcaacctgagacccgaggccatcaccgccatcatcgtggtgttcagcctgctggccgccctgctgctggccgtgggcctggccctgctggtgagaaagctgagagagaagagacagaccgagggcacctacagacccagcagcgaggagcaggtgggcgccagagtgccccccacccccaacctgaagctgccccccgaggagagactgatctag

SEQ ID NO: 77784 - DNA, 372 bp, Artificial Sequence
  Description of Artificial Sequence: Synthetic coding sequence
atggccaaccccggcctgggcctgctgctggccctgggcctgcccttcctgctggccagatggggcagagcctggggccagatccagaccaccagcgccaacgagaacagcaccgtgctgcccagcagcaccagcagcagcagcgacggcaacctgagacccgaggccatcaccgccatcatcgtggtgttcagcctgctggccgccctgctgctggccgtgggcctggccctgctggtgagaaagctgagagagaagagacagaccgagggcacctacagacccagcagcgaggagcagttcagccacgccgccgaggccagagccccccaggacagcaaggagaccgtgcagggctgcctgcccatctag

SEQ ID NO: 77785 - DNA, 363 bp, Artificial Sequence; identical to SEQ ID NO: 77783
  Description of Artificial Sequence: Synthetic coding sequence

SEQ ID NO: 77786 - DNA, 1599 bp, Artificial Sequence
  Description of Artificial Sequence: Synthetic coding sequence
atgcccgccccccccggcagaacccacacctggttcctgctgcagagcctggaggacctggacaccagcctgagaaagctgaacagcagactgttcgtggtgagaggccagcccgccgacgtgttccccagactgttcaaggagtggggcgtgaccagactgaccttcgagtacgacagcgagcccttcggcaaggagagagacgccgccatcatgaagatggccaaggaggccggcgtggaggtggtgaccgagaacagccacaccctgtacgacctggacagaatcatcgagctgaacggccagaagccccccctgacctacaagagattccaggccatcatcagcagaatggagctgcccaagaagcccgtgggcctggtgaccagccagcagatggagagctgcagagccgagatccaggagaaccacgacgagacctacggcgtgcccagcctggaggagctgggcttccccaccgagggcctgggccccgccgtgtggcagggcggcgagaccgaggccctggccagactggacaagcacctggagagaaaggcctgggtggccaactacgagagacccagaatgaacgccaacagcctgctggccagccccaccggcctgagcccctacctgagattcggctgcctgagctgcagactgttctactacagactgtgggacctgtacaagaaggtgaagagaaacagcaccccccccctgagcctgttcggccagctgctgtggagagagttcttctacaccgccgccaccaacaaccccagattcgacagaatggagggcaaccccatctgcatccagatcccctgggacagaaaccccgaggccctggccaagtgggccgagggcaagaccggcttcccctggatcgacgccatcatgacccagctgagacaggagggctggatccaccacctggccagacacgccgtggcctgcttcctgaccagaggcgacctgtgggtgagctgggagagcggcgtgagagtgttcgacgagctgctgctggacgccgacttcagcgtgaacgccggcagctggatgtggctgagctgcagcgccttcttccagcagttcttccactgctactgccccgtgggcttcggcagaagaaccgaccccagcggcgactacatcagaagatacctgcccaagctgaaggccttccccagcagatacatctacgagccctggaacgcccccgagagcatccagaaggccgccaagtgcatcatcggcgtggactaccccagacccatcgtgaaccacgccgagaccagcagactgaacatcgagagaatgaagcagatctaccagcagctgagcagatacagaggcctgtgcctgctggccagcgtgcccagctgcgtggaggacctgagccaccccgtggccgagcccagcagcagccaggccggcagcatgagcagcgccggccccagacccctgcccagcggccccgccagccccaagagaaagctggaggccgccgaggagccccccggcgaggagctgagcaagagagccagagtggccgagctgcccacccccgagctgcccagcaaggacgcctag

SEQ ID NO: 77787 - DNA, 1845 bp, Artificial Sequence
  Description of Artificial Sequence: Synthetic coding sequence
atgggcggcgtgcacgtggcctacagaggcggcgccggcgtggccggcgccgtgtggaccgtgatggccgccaccgtggccaccgccgccgccgtggcccccgcccccgcccccggcaccgacagcgccagcagcgtgcactggttcagaaagggcctgagactgcacgacaaccccgccctgctggccgccgtgagaggcgccagatgcgtgagatgcgtgtacatcctggacccctggttcgccgccagcagcagcgtgggcatcaacagatggagattcctgctgcagagcctggaggacctggacaccagcctgagaaagctgaacagcagactgttcgtggtgagaggccagcccgccgacgtgttccccagactgttcaaggagtggggcgtgaccagactgaccttcgagtacgacagcgagcccttcggcaaggagagagacgccgccatcatgaagatggccaaggaggccggcgtggaggtggtgaccgagaacagccacaccctgtacgacctggacagaatcatcgagctgaacggccagaagccccccctgacctacaagagattccaggccatcatcagcagaatggagctgcccaagaagcccgtgggcctggtgaccagccagcagatggagagctgcagagccgagatccaggagaaccacgacgagacctacggcgtgcccagcctggaggagctgggcttccccaccgagggcctgggccccgccgtgtggcagggcggcgagaccgaggccctggccagactggacaagcacctggagagaaaggcctgggtggccaactacgagagacccagaatgaacgccaacagcctgctggccagccccaccggcctgagcccctacctgagattcggctgcctgagctgcagactgttctactacagactgtgggacctgtacaagaaggtgaagagaaacagcaccccccccctgagcctgttcggccagctgctgtggagagagttcttctacaccgccgccaccaacaaccccagattcgacagaatggagggcaaccccatctgcatccagatcccctgggacagaaaccccgaggccctggccaagtgggccgagggcaagaccggcttcccctggatcgacgccatcatgacccagctgagacaggagggctggatccaccacctggccagacacgccgtggcctgcttcctgaccagaggcgacctgtgggtgagctgggagagcggcgtgagagtgttcgacgagctgctgctggacgccgacttcagcgtgaacgccggcagctggatgtggctgagctgcagcgccttcttccagcagttcttccactgctactgccccgtgggcttcggcagaagaaccgaccccagcggcgactacatcagaagatacctgcccaagctgaaggccttccccagcagatacatctacgagccctggaacgcccccgagagcatccagaaggccgccaagtgcatcatcggcgtggactaccccagacccatcgtgaaccacgccgagaccagcagactgaacatcgagagaatgaagcagatctaccagcagctgagcagatacagaggcctgtgcctgctggccagcgtgcccagctgcgtggaggacctgagccaccccgtggccgagcccagcagcagccaggccggcagcatgagcagcgccggccccagacccctgcccagcggccccgccagccccaagagaaagctggaggccgccgaggagccccccggcgaggagctgagcaagagagccagagtggccgagctgcccacccccgagctgcccagcaaggacgcctag

SEQ ID NO: 77788 - DNA, 522 bp, Artificial Sequence
  Description of Artificial Sequence: Synthetic coding sequence
atggacgtgaccatccagcacccctggttcaagagaaccctgggccccttctaccccagcagactgttcgaccagttcttcggcgagggcctgttcgagtacgacctgctgcccttcctgagcagcaccatcagcccctactacagacagagcctgttcagaaccgtgctggacagcggcatcagcgaggtgagaagcgacagagacaagttcgtgatcttcctggacgtgaagcacttcagccccgaggacctgaccgtgaaggtgcaggacgacttcgtggagatccacggcaagcacaacgagagacaggacgaccacggctacatcagcagagagttccacagaagatacagactgcccagcaacgtggaccagagcgccctgagctgcagcctgagcgccgacggcatgctgaccttctgcggccccaagatccagaccggcctggacgccacccacgccgagagagccatccccgtgagcagagaggagaagcccaccagcgcccccagcagctag

SEQ ID NO: 77789 - DNA, 570 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgtgagagtgtacagcccctaccaggactactacgaggtggtgccccccaacgcccacgaggccacctacgtgagaagctactacggccccccctacgccggccccggcgtgacccacgtgatcgtgagagaggacccctgctacagcgccggcgcccccctggccatgggcatgctggccggcgccgccaccggcgccgccctgggcagcctgatgtggagcccctgctggttctag

SEQ ID NO: 77790 - DNA, 528 bp, Artificial Sequence
  Description of Artificial Sequence: Synthetic coding sequence
atggacatcgccatccaccacccctggatcagaagacccttcttccccttccacagccccagcagactgttcgaccagttcttcggcgagcacctgctggagagcgacctgttccccaccagcaccagcctgagccccttctacctgagaccccccagcttcctgagagcccccagctggttcgacaccggcctgagcgagatgagactggagaaggacagattcagcgtgaacctggacgtgaagcacttcagccccgaggagctgaaggtgaaggtgctgggcgacgtgatcgaggtgcacggcaagcacgaggagagacaggacgagcacggcttcatcagcagagagttccacagaaagtacagaatccccgccgacgtggaccccctgaccatcaccagcagcctgagcagcgacggcgtgctgaccgtgaacggccccagaaagcaggtgagcggccccgagagaaccatccccatcaccagagaggagaagcccgccgtgaccgccgcccccaagaagtag

SEQ ID NO: 77791 - DNA, 525 bp, Artificial Sequence
  Description of Artificial Sequence: Synthetic coding sequence
atggacatcgccatccaccacccctggatcagaagacccttcttccccttccacagccccagcagactgttcgaccagttcttcggcgagcacctgctggagagcgacctgttccccaccagcaccagcctgagccccttctacctgagaccccccagcttcctgagagcccccagctggttcgacaccggcctgagcgagatgagactggagaaggacagattcagcgtgaacctggacgtgaagcacttcagccccgaggagctgaaggtgaaggtgctgggcgacgtgatcgaggtgcacggcaagcacgaggagagacaggacgagcacggcttcatcagcagagagttccacagaaagtacagaatccccgccgacgtggaccccctgaccatcaccagcagcctgagcagcgacggcgtgctgaccgtgaacggccccagaaagcaggtgagcggccccgagagaaccatccccatcaccagagaggagaagcccgccgtgaccgccgcccccaagtag

SEQ ID NO: 77792 - DNA, 528 bp, Artificial Sequence; identical to SEQ ID NO: 77790
  Description of Artificial Sequence: Synthetic coding sequence

SEQ ID NO: 77793 - DNA, 234 bp, Artificial Sequence
  Description of Artificial Sequence: Synthetic coding sequence
atggacatcgccatccaccacccctggatcagaagacccttcttccccttccacagccccagcagactgttcgaccagttcttcggcgagcacctgctggagagcgacctgttccccaccagcaccagcctgagccccttctacctgagaccccccagcttcctgagagcccccagctggttcgacaccggcctgagcgagatgagactggagaaggacagattcagcgtgtag

SEQ ID NO: 77794 - DNA, 393 bp, Artificial Sequence
  Description of Artificial Sequence: Synthetic coding sequence
atggacatcgccatccaccacccctggatcagaagacccttcttccccttccacagccccagcagactgttcgaccagttcttcggcgagcacctgctggagagcgacctgttccccaccagcaccagcctgagccccttctacctgagaccccccagcttcctgagagcccccagctggttcgacaccggcctgagcgagatgagactggagaaggacagattcagcgtgaacctggacgtgaagcacttcagccccgaggagctgaaggtgaaggtgctgggcgacgtgatcgaggtgcacggcaagcacgaggagagacaggacgagcacggcttcatcagcagagagttccacagaaagtacagaatccccgccgacgtggacccctag

SEQ ID NO: 77795 - DNA, 528 bp, Artificial Sequence; identical to SEQ ID NO: 77790
  Description of Artificial Sequence: Synthetic coding sequence

SEQ ID NO: 77796 - DNA, 528 bp, Artificial Sequence; identical to SEQ ID NO: 77790
  Description of Artificial Sequence: Synthetic coding sequence

SEQ ID NO: 77797 - DNA, 210 bp, Artificial Sequence
  Description of Artificial Sequence: Synthetic coding sequence
atggacatcgccatccaccacccctggatcagaagacccttcttccccttccacagccccagcagactgttcgaccagttcttcggcgagcacctgctggagagcgacctgttccccaccagcaccagcctgagccccttctacctgagaccccccagcttcctgagagcccccagctggttcgacaccggcctgagcgagatgagatag

SEQ ID NO: 77798 - DNA, 2148 bp, Artificial Sequence
  Description of Artificial Sequence: Synthetic coding sequence
atgcacctgctgcccgccctggccggcgtgctggccaccctggtgctggcccagccctgcgagggcaccgaccccgccagccccggcgccgtggagaccagcgtgctgagagactgcatcgccgaggccaagctgctggtggacgccgcctacaactggacccagaagagcatcaagcagagactgagaagcggcagcgccagccccatggacctgctgagctacttcaagcagcccgtggccgccaccagaaccgtggtgagagccgccgactacatgcacgtggccctgggcctgctggaggagaagctgcagccccagagaagcggccccttcaacgtgaccgacgtgctgaccgagccccagctgagactgctgagccaggccagcggctgcgccctgagagaccaggccgagagatgcagcgacaagtacagaaccatcaccggcagatgcaacaacaagagaagacccctgctgggcgccagcaaccaggccctggccagatggctgcccgccgagtacgaggacggcctgagcctgcccttcggctggacccccagcagaagaagaaacggcttcctgctgcccctggtgagagccgtgagcaaccagatcgtgagattccccaacgagagactgaccagcgacagaggcagagccctgatgttcatgcagtggggccagttcatcgaccacgacctggacttcagccccgagagccccgccagagtggccttcaccgccggcgtggactgcgagagaacctgcgcccagctgcccccctgcttccccatcaagatcccccccaacgaccccagaatcaagaaccagagagactgcatccccttcttcagaagcgcccccagctgcccccagaacaagaacagagtgagaaaccagatcaacgccctgaccagcttcgtggacgccagcatggtgtacggcagcgaggtgagcctgagcctgagactgagaaacagaaccaactacctgggcctgctggccatcaaccagagattccaggacaacggcagagccctgctgcccttcgacaacctgcacgacgacccctgcctgctgaccaacagaagcgccagaatcccctgcttcctggccggcgacaccagaagcaccgagacccccaagctggccgccatgcacaccctgttcatgagagagcacaacagactggccaccgagctgagaagactgaaccccagatggaacggcgacaagctgtacaacgaggccagaaagatcatgggcgccatggtgcagatcatcacctacagagacttcctgcccctggtgctgggcaaggccagagccagaagaaccctgggccactacagaggctactgcagcaacgtggaccccagagtggccaacgtgttcaccctggccttcagattcggccacaccatgctgcagcccttcatgttcagactggacagccagtacagagccagcgcccccaacagccacgtgcccctgagcagcgccttcttcgccagctggagaatcgtgtacgagggcggcatcgaccccatcctgagaggcctgatggccacccccgccaagctgaacagacaggacgccatgctggtggacgagctgagagacagactgttcagacaggtgagaagaatcggcctggacctggccgccctgaacatgcagagaagcagagaccacggcctgcccggctacaacgcctggagaagattctgcggcctgagccagcccagaaacctggcccagctgagcagagtgctgaagaaccaggacctggccagaaagttcctgaacctgtacggcacccccgacaacatcgacatctggatcggcgccatcgccgagcccctgctgcccggcgccagagtgggccccctgctggcctgcctgttcgagaaccagttcagaagagccagagacggcgacagattctggtggcagaagagaggcgtgttcaccaagagacagagaaaggccctgagcagaatcagcctgagcagaatcatctgcgacaacaccggcatcaccaccgtgagcagagacatcttcagagccaacatctaccccagaggcttcgtgaactgcagcagaatccccagactgaacctgagcgcctggagaggcacctag

SEQ ID NO: 77799 - DNA, 594 bp, Artificial Sequence
  Description of Artificial Sequence: Synthetic coding sequence
atgagcagcgcccccgcccccggccccgcccccgccagcctgaccctgtgggacgaggaggacttccagggcagaagatgcagactgctgagcgactgcgccaacgtgtgcgagagaggcggcctgcccagagtgagaagcgtgaaggtggagaacggcgtgtgggtggccttcgagtaccccgacttccagggccagcagttcatcctggagaagggcgactaccccagatggagcgcctggagcggcagcagcagccacaacagcaaccagctgctgagcttcagacccgtgctgtgcgccaaccacaacgacagcagagtgaccctgttcgagggcgacaacttccagggctgcaagttcgacctggtggacgactaccccagcctgcccagcatgggctgggccagcaaggacgtgggcagcctgaaggtgagcagcggcgcctgggtggcctaccagtaccccggctacagaggctaccagtacgtgctggagagagacagacacagcggcgagttctgcacctacggcgagctgggcacccaggcccacaccggccagctgcagagcatcagaagagtgcagcactag

SEQ ID NO: 77800 - DNA, 594 bp, Artificial Sequence; identical to SEQ ID NO: 77799
  Description of Artificial Sequence: Synthetic coding sequence

SEQ ID NO: 77801 - DNA, 390 bp, Artificial Sequence
  Description of Artificial Sequence: Synthetic coding sequence
atgagcagcgcccccgcccccggccccgcccccgccagcctgaccctgtgggacgaggaggacttccagggcagaagatgcagactgctgagcgactgcgccaacgtgtgcgagagaggcggcctgcccagagtgagaagcgtgaaggtggagaacggcgtgtgggtggccttcgagtaccccgacttccagggccagcagttcatcctggagaagggcgactaccccagatggagcgcctggagcggcagcagcagccacaacagcaaccagctgctgagcttcagacccgtgctgtgcgccaaccacaacgacagcagagtgaccctgttcgagggcgacaacttccagggctgcaagttcgacctggtggacgactaccccagctag

SEQ ID NO: 77802 - DNA, 591 bp, Artificial Sequence
  Description of Artificial Sequence: Synthetic coding sequence
atgaccctgcagtgcaccaagagcgccggcccctggaagatggtggtgtgggacgaggacggcttccagggcagaagacacgagttcaccgccgagtgccccagcgtgctggagctgggcttcgagaccgtgagaagcctgaaggtgctgagcggcgcctgggtgggcttcgagcacgccggcttccagggccagcagtacatcctggagagaggcgagtaccccagctgggacgcctggggcggcaacaccgcctaccccgccgagagactgaccagcttcagacccgccgcctgcgccaaccacagagacagcagactgaccatcttcgagcaggagaacttcctgggcaagaagggcgagctgagcgacgactaccccagcctgcaggccatgggctgggagggcaacgaggtgggcagcttccacgtgcacagcggcgcctgggtgtgcagccagttccccggctacagaggcttccagtacgtgctggagtgcgaccaccacagcggcgactacaagcacttcagagagtggggcagccacgcccccaccttccaggtgcagagcatcagaagaatccagcagtag

SEQ ID NO: 77803 - DNA, 1614 bp, Artificial Sequence
  Description of Artificial Sequence: Synthetic coding sequence
atggagagagtgaacgacgccagctgcggccccagcggctgctacacctaccaggtgagcagacacagcaccgagatgctgcacaacctgaaccagcagagaaagaacggcggcagattctgcgacgtgctgctgagagtgggcgacgagagcttccccgcccacagagccgtgctggccgcctgcagcgagtacttcgagagcgtgttcagcgcccagctgggcgacggcggcgccgccgacggcggccccgccgacgtgggcggcgccaccgccgcccccggcggcggcgccggcggcagcagagagctggagatgcacaccatcagcagcaaggtgttcggcgacatcctggacttcgcctacaccagcagaatcgtggtgagactggagagcttccccgagctgatgaccgccgccaagttcctgctgatgagaagcgtgatcgagatctgccaggaggtgatcaagcagagcaacgtgcagatcctggtgccccccgccagagccgacatcatgctgttcagaccccccggcaccagcgacctgggcttccccctggacatgaccaacggcgccgccctggccgccaacagcaacggcatcgccggcagcatgcagcccgaggaggaggccgccagagccgccggcgccgccatcgccggccaggccagcctgcccgtgctgcccggcgtggacagactgcccatggtggccggccccctgagcccccagctgctgaccagccccttccccagcgtggccagcagcgccccccccctgaccggcaagagaggcagaggcagacccagaaaggccaacctgctggacagcatgttcggcagccccggcggcctgagagaggccggcatcctgccctgcggcctgtgcggcaaggtgttcaccgacgccaacagactgagacagcacgaggcccagcacggcgtgaccagcctgcagctgggctacatcgacctgcccccccccagactgggcgagaacggcctgcccatcagcgaggaccccgacggccccagaaagagaagcagaaccagaaagcaggtggcctgcgagatctgcggcaagatcttcagagacgtgtaccacctgaacagacacaagctgagccacagcggcgagaagccctacagctgccccgtgtgcggcctgagattcaagagaaaggacagaatgagctaccacgtgagaagccacgacggcagcgtgggcaagccctacatctgccagagctgcggcaagggcttcagcagacccgaccacctgaacggccacatcaagcaggtgcacaccagcgagagaccccacaagtgccaggtgtgggtgggcagcagcagcggcctgccccccctggagcccctgcccagcgacctgcccagctgggacttcgcccagcccgccctgtggagaagcagccacagcgtgcccgacaccgccttcagcctgagcctgaagaagagcttccccgccctggagaacctgggccccgcccacagcagcaacaccctgttctgccccgccccccccggctacctgagacagggctggaccacccccgagggcagcagagccttcacccagtggcccgtgggctag

SEQ ID NO: 77804 - DNA, 618 bp, Artificial Sequence
  Description of Artificial Sequence: Synthetic coding sequence
atggccagcgaccaccagacccaggccggcaagccccagagcctgaaccccaagatcatcatcttcgagcaggagaacttccagggccacagccacgagctgaacggcccctgccccaacctgaaggagaccggcgtggagaaggccggcagcgtgctggtgcaggccggcccctgggtgggctacgagcaggccaactgcaagggcgagcagttcgtgttcgagaagggcgagtaccccagatgggacagctggaccagcagcagaagaaccgacagcctgagcagcctgagacccatcaaggtggacagccaggagcacaagatcatcctgtacgagaaccccaacttcaccggcaagaagatggagatcatcgacgacgacgtgcccagcttccacgcccacggctaccaggagaaggtgagcagcgtgagagtgcagagcggcacctgggtgggctaccagtaccccggctacagaggcctgcagtacctgctggagaagggcgactacaaggacagcagcgacttcggcgccccccacccccaggtgcagagcgtgagaagaatcagagacatgcagtggcaccagagaggcgccttccaccccagcaactag

SEQ ID NO: 77805 - DNA, 1284 bp, Artificial Sequence
  Description of Artificial Sequence: Synthetic coding sequence
atgagacacctgggcgccttcctgttcctgctgggcgtgctgggcgccctgaccgagatgtgcgagatccccgagatggacagccacctggtggagaagctgggccagcacctgctgccctggatggacagactgagcctggagcacctgaaccccagcatctacgtgggcctgagactgagcagcctgcaggccggcaccaaggaggacctgtacctgcacagcctgaagctgggctaccagcagtgcctgctgggcagcgccttcagcgaggacgacggcgactgccagggcaagcccagcatgggccagctggccctgtacctgctggccctgagagccaactgcgagttcgtgagaggccacaagggcgacagactggtgagccagctgaagtggttcctggaggacgagaagagagccatcggccacgaccacaagggccacccccacaccagctactaccagtacggcctgggcatcctggccctgtgcctgcaccagaagagagtgcacgacagcgtggtggacaagctgctgtacgccgtggagcccttccaccagggccaccacagcgtggacaccgccgccatggccggcctggccttcacctgcctgaagagaagcaacttcaaccccggcagaagacagagaatcaccatggccatcagaaccgtgagagaggagatcctgaaggcccagacccccgagggccacttcggcaacgtgtacagcacccccctggccctgcagttcctgatgaccagccccatgagaggcgccgagctgggcaccgcctgcctgaaggccagagtggccctgctggccagcctgcaggacggcgccttccagaacgccctgatgatcagccagctgctgcccgtgctgaaccacaagacctacatcgacctgatcttccccgactgcctggcccccagagtgatgctggagcccgccgccgagaccatcccccagacccaggagatcatcagcgtgaccctgcaggtgctgagcctgctgcccccctacagacagagcatcagcgtgctggccggcagcaccgtggaggacgtgctgaagaaggcccacgagctgggcggcttcacctacgagacccaggccagcctgagcggcccctacctgaccagcgtgatgggcaaggccgccggcgagagagagttctggcagctgctgagagaccccaacacccccctgctgcagggcatcgccgactacagacccaaggacggcgagaccatcgagctgagactggtgagctggtag

SEQ ID NO: 77806 - DNA, 525 bp, Artificial Sequence
  Description of Artificial Sequence: Synthetic coding sequence
atgggcaagatcaccttctacgaggacagagacttccagggcagatgctacaactgcatcagcgactgccccaacctgagagtgtacttcagcagatgcaacagcatcagagtggacagcggctgctggatgctgtacgagagacccaactaccagggccaccagtacttcctgagaagaggcaagtaccccgactaccagcactggatgggcctgagcgacagcgtgcagagctgcagaatcatcccccacaccagcagccacaagctgagactgtacgagagagacgactacagaggcctgatgagcgagctgaccgacgactgcgcctgcgtgcccgagctgttcagactgcccgagatctacagcctgcacgtgctggagggctgctgggtgctgtacgagatgcccaactacagaggcagacagtacctgctgagacccggcgactacagaagataccacgactggggcggcgccgacgccaaggtgggcagcctgagaagagtgaccgacctgtactag

SEQ ID NO: 77807 - DNA, 528 bp, Artificial Sequence
  Description of Artificial Sequence: Synthetic coding sequence
atgggcaagatcaccttctacgaggacagagccttccagggcagaagctacgagtgcaccaccgactgccccaacctgcagccctacttcagcagatgcaacagcatcagagtggagagcggctgctggatgatctacgagagacccaactaccagggccaccagtacttcctgagaagaggcgagtaccccgactaccagcagtggatgggcctgagcgacagcatcagaagctgctgcctgatccccccccacagcggcgcctacagaatgaagatctacgacagagacgagctgagaggccagatgagcgagctgaccgacgactgcatcagcgtgcaggacagattccacctgaccgagatccacagcctgaacgtgctggagggcagctggatcctgtacgagatgcccaactacagaggcagacagtacctgctgagacccggcgagtacagaagattcctggactggggcgcccccaacgccaaggtgggcagcctgagaagagtgatggacctgtactag

SEQ ID NO: 77808 - DNA, 525 bp, Artificial Sequence
  Description of Artificial Sequence: Synthetic coding sequence
atgggcaagatcaccttctacgaggacagagccttccagggcagaagctacgagaccaccaccgactgccccaacctgcagccctacttcagcagatgcaacagcatcagagtggagagcggctgctggatgctgtacgagagacccaactaccagggccagcagtacctgctgagaagaggcgagtaccccgactaccagcagtggatgggcctgagcgacagcatcagaagctgctgcctgatcccccagaccgtgagccacagactgagactgtacgagagagaggaccacaagggcctgatgatggagctgagcgaggactgccccagcatccaggacagattccacctgagcgagatcagaagcctgcacgtgctggagggctgctgggtgctgtacgagctgcccaactacagaggcagacagtacctgctgagaccccaggagtacagaagatgccaggactggggcgccatggacgccaaggccggcagcctgagaagagtggtggacctgtactag

SEQ ID NO: 77809 - DNA, 525 bp, Artificial Sequence
  Description of Artificial Sequence: Synthetic coding sequence
atgggcaagatcaccctgtacgaggacagaggcttccagggcagacactacgagtgcagcagcgaccaccccaacctgcagccctacctgagcagatgcaacagcgccagagtggacagcggctgctggatgctgtacgagcagcccaactacagcggcctgcagtacttcctgagaagaggcgactacgccgaccaccagcagtggatgggcctgagcgacagcgtgagaagctgcagactgatcccccacagcggcagccacagaatcagactgtacgagagagaggactacagaggccagatgatcgagttcaccgaggactgcagctgcctgcaggacagattcagattcaacgagatccacagcctgaacgtgctggagggcagctgggtgctgtacgagctgagcaactacagaggcagacagtacctgctgatgcccggcgactacagaagataccaggactggggcgccaccaacgccagagtgggcagcctgagaagagtgatcgacttcagctag

SEQ ID NO: 77810 - DNA, 537 bp, Artificial Sequence
  Description of Artificial Sequence: Synthetic coding sequence
atgagcaagaccggcaccaagatcaccttctacgaggacaagaacttccagggcagaagatacgactgcgactgcgactgcgccgacttccacacctacctgagcagatgcaacagcatcaaggtggagggcggcacctgggccgtgtacgagagacccaacttcgccggctacatgtacatcctgccccagggcgagtaccccgagtaccagagatggatgggcctgaacgacagactgagcagctgcagagccgtgcacctgcccagcggcggccagtacaagatccagatcttcgagaagggcgacttcagcggccagatgtacgagaccaccgaggactgccccagcatcatggagcagttccacatgagagagatccacagctgcaaggtgctggagggcgtgtggatcttctacgagctgcccaactacagaggcagacagtacctgctggacaagaaggagtacagaaagcccatcgactggggcgccgccagccccgccgtgcagagcttcagaagaatcgtggagtag

SEQ ID NO: 77811 - DNA, 537 bp, Artificial Sequence; identical to SEQ ID NO: 77810
  Description of Artificial Sequence: Synthetic coding sequence

SEQ ID NO: 77812 - DNA, 960 bp, Artificial Sequence
  Description of Artificial Sequence: Synthetic coding sequence
atggccagcagcgccgccggctgcgtggtgatcgtgggcagcggcgtgatcggcagaagctgggccatgctgttcgccagcggcggcttccaggtgaagctgtacgacatcgagcagcagcagatcagaaacgccctggagaacatcagaaaggagatgaagctgctggagcaggccggcagcctgaagggcagcctgagcgtggaggagcagctgagcctgatcagcggctgccccaacatccaggaggccgtggagggcgccatgcacatccaggagtgcgtgcccgaggacctggagctgaagaagaagatcttcgcccagctggacagcatcatcgacgacagagtgatcctgagcagcagcaccagctgcctgatgcccagcaagctgttcgccggcctggtgcacgtgaagcagtgcatcgtggcccaccccgtgaaccccccctactacatccccctggtggagctggtgccccaccccgagaccgcccccaccaccgtggacagaacccacgccctgatgaagaagatcggccagtgccccatgagagtgcagaaggaggtggccggcttcgtgctgaacagactgcagtacgccatcatcagcgaggcctggagactggtggaggagggcatcgtgagccccagcgacctggacctggtgatgagcgagggcctgggcatgagatacgccttcatcggccccctggagaccatgcacctgaacgccgagggcatgctgagctactgcgacagatacagcgagggcatcaagcacgtgctgcagaccttcggccccatccccgagttcagcagagccaccgccgagaaggtgaaccaggacatgtgcatgaaggtgcccgacgaccccgagcacctggccgccagaagacagtggagagacgagtgcctgatgagactggccaagctgaagagccaggtgcagccccagtag

SEQ ID NO: 77813 - DNA, 2346 bp, Artificial Sequence
  Description of Artificial Sequence: Synthetic coding sequence
atggccaagacccccagcgaccacctgctgagcaccctggaggagctggtgccctacgacttcgagaagttcaagttcaagctgcagaacaccagcgtgcagaaggagcacagcagaatccccagaagccagatccagagagccagacccgtgaagatggccaccctgctggtgacctactacggcgaggagtacgccgtgcagctgaccctgcaggtgctgagagccatcaaccagagactgctggccgaggagctgcacagagccgccatccaggagtacagcacccaggagaacggcaccgacgacagcgccgccagcagcagcctgggcgagaacaagcccagaagcctgaagacccccgaccaccccgagggcaacgagggcaacggccccagaccctacggcggcggcgccgccagcctgagatgcagccagcccgaggccggcagaggcctgagcagaaagcccctgagcaagagaagagagaaggccagcgagggcctggacgcccagggcaagcccagaaccagaagccccgccctgcccggcggcagaagccccggcccctgcagagccctggagggcggccaggccgaggtgagactgagaagaaacgccagcagcgccggcagactgcagggcctggccggcggcgcccccggccagaaggagtgcagacccttcgaggtgtacctgcccagcggcaagatgagacccagaagcctggaggtgaccatcagcaccggcgagaaggcccccgccaaccccgagatcctgctgaccctggaggagaagaccgccgccaacctggacagcgccaccgagcccagagccagacccacccccgacggcggcgccagcgccgacctgaaggagggccccggcaaccccgagcacagcgtgaccggcagaccccccgacaccgccgccagccccagatgccacgcccaggagggcgaccccgtggacggcacctgcgtgagagacagctgcagcttccccgaggccgtgagcggccacccccaggccagcggcagcagaagccccggctgccccagatgccaggacagccacgagagaaagagccccggcagcctgagcccccagcccctgccccagtgcaagagacacctgaagcaggtgcagctgctgttctgcgaggaccacgacgagcccatctgcctgatctgcagcctgagccaggagcaccagggccacagagtgagacccatcgaggaggtggccctggagcacaagaagaagatccagaagcagctggagcacctgaagaagctgagaaagagcggcgaggagcagagaagctacggcgaggagaaggccgtgagcttcctgaagcagaccgaggccctgaagcagagagtgcagagaaagctggagcaggtgtactacttcctggagcagcaggagcacttcttcgtggccagcctggaggacgtgggccagatggtgggccagatcagaaaggcctacgacaccagagtgagccaggacatcgccctgctggacgccctgatcggcgagctggaggccaaggagtgccagagcgagtgggagctgctgcaggacatcggcgacatcctgcacagagccaagaccgtgcccgtgcccgagaagtggaccaccccccaggagatcaagcagaagatccagctgctgcaccagaagagcgagttcgtggagaagagcaccaagtacttcagcgagaccctgagaagcgagatggagatgttcaacgtgcccgagctgatcggcgcccaggcccacgccgtgaacgtgatcctggacgccgagaccgcctaccccaacctgatcttcagcgacgacctgaagagcgtgagactgggcaacaagtgggagagactgcccgacggcccccagagattcgacagctgcatcatcgtgctgggcagccccagcttcctgagcggcagaagatactgggaggtggaggtgggcgacaagaccgcctggatcctgggcgcctgcaagaccagcatcagcagaaagggcaacatgaccctgagccccgagaacggctactgggtggtgatcatgatgaaggagaacgagtaccaggccagcagcgtgccccccaccagactgctgatcaaggagccccccaagagagtgggcatcttcgtggactacagagtgggcagcatcagcttctacaacgtgaccgccagaagccacatctacaccttcgccagctgcagcttcagcggccccctgcagcccatcttcagccccggcaccagagacggcggcaagaacaccgcccccctgaccatctgccccgtgggcggccagggccccgactag

SEQ ID NO: 77814 - DNA, 945 bp, Artificial Sequence
  Description of Artificial Sequence: Synthetic coding sequence
atgagcagagtgcccgccttcctgagcgccgccgaggtggaggagcacctgagaagcagcagcctgctgatcccccccctggagaccgccctggccaacttcagcagcggccccgagggcggcgtgatgcagcccgtgagaaccgtggtgcccgtgaccaagcacagaggctacctgggcgtgatgcccgcctacagcgccgccgaggacgccctgaccaccaagctggtgaccttctacgaggacagaggcatcaccagcgtggtgcccagccaccaggccaccgtgctgctgttcgagcccagcaacggcaccctgctggccgtgatggacggcaacgtgatcaccgccaagagaaccgccgccgtgagcgccatcgccaccaagttcctgaagccccccagcagcgaggtgctgtgcatcctgggcgccggcgtgcaggcctacagccactacgagatcttcaccgagcagttcagcttcaaggaggtgagaatctggaacagaaccaaggagaacgccgagaagttcgccgacaccgtgcagggcgaggtgagagtgtgcagcagcgtgcaggaggccgtggccggcgccgacgtgatcatcaccgtgaccctggccaccgagcccatcctgttcggcgagtgggtgaagcccggcgcccacatcaacgccgtgggcgccagcagacccgactggagagagctggacgacgagctgatgaaggaggccgtgctgtacgtggacagccaggaggccgccctgaaggagagcggcgacgtgctgctgagcggcgccgagatcttcgccgagctgggcgaggtgatcaagggcgtgaagcccgcccactgcgagaagaccaccgtgttcaagagcctgggcatggccgtggaggacaccgtggccgccaagctgatctacgacagctggagcagcggcaagtag

SEQ ID NO: 77815 - DNA, 819 bp, Artificial Sequence
  Description of Artificial Sequence: Synthetic coding sequence
atgcagcccgtgagaaccgtggtgcccgtgaccaagcacagaggctacctgggcgtgatgcccgcctacagcgccgccgaggacgccctgaccaccaagctggtgaccttctacgaggacagaggcatcaccagcgtggtgcccagccaccaggccaccgtgctgctgttcgagcccagcaacggcaccctgctggccgtgatggacggcaacgtgatcaccgccaagagaaccgccgccgtgagcgccatcgccaccaagttcctgaagccccccagcagcgaggtgctgtgcatcctgggcgccggcgtgcaggcctacagccactacgagatcttcaccgagcagttcagcttcaaggaggtgagaatctggaacagaaccaaggagaacgccgagaagttcgccgacaccgtgcagggcgaggtgagagtgtgcagcagcgtgcaggaggccgtggccggcgccgacgtgatcatcaccgtgaccctggccaccgagcccatcctgttcggcgagtgggtgaagcccggcgcccacatcaacgccgtgggcgccagcagacccgactggagagagctggacgacgagctgatgaaggaggccgtgctgtacgtggacagccaggaggccgccctgaaggagagcggcgacgtgctgctgagcggcgccgagatcttcgccgagctgggcgaggtgatcaagggcgtgaagcccgcccactgcgagaagaccaccgtgttcaagagcctgggcatggccgtggaggacaccgtggccgccaagctgatctacgacagctggagcagcggcaagtag

SEQ ID NO: 77816 - DNA, 945 bp, Artificial Sequence; identical to SEQ ID NO: 77814
  Description of Artificial Sequence: Synthetic coding sequence

SEQ ID NO: 77817 - DNA, 990 bp, Artificial Sequence
  Description of Artificial Sequence: Synthetic coding sequence
atggccaccggccagaagctgatgagagccgtgagagtgttcgagttcggcggccccgaggtgctgaagctgagaagcgacatcgccgtgcccatccccaaggaccaccaggtgctgatcaaggtgcacgcctgcggcgtgaaccccgtggagacctacatcagaagcggcacctacagcagaaagcccctgctgccctacacccccggcagcgacgtggccggcgtgatcgaggccgtgggcgacaacgccagcgccttcaagaagggcgacagagtgttcaccagcagcaccatcagcggcggctacgccgagtacgccctggccgccgaccacaccgtgtacaagctgcccgagaagctggacttcaagcagggcgccgccatcggcatcccctacttcaccgcctacagagccctgatccacagcgcctgcgtgaaggccggcgagagcgtgctggtgcacggcgccagcggcggcgtgggcctggccgcctgccagatcgccagagcctacggcctgaagatcctgggcaccgccggcaccgaggagggccagaagatcgtgctgcagaacggcgcccacgaggtgttcaaccacagagaggtgaactacatcgacaagatcaagaagtacgtgggcgagaagggcatcgacatcatcatcgagatgctggccaacgtgaacctgagcaaggacctgagcctgctgagccacggcggcagagtgatcgtggtgggcagcagaggcaccatcgagatcaaccccagagacaccatggccaaggagagcagcatcatcggcgtgaccctgttcagcagcaccaaggaggagttccagcagtacgccgccgccctgcaggccggcatggagatcggctggctgaagcccgtgatcggcagccagtaccccctggagaaggtggccgaggcccacgagaacatcatccacggcagcggcgccaccggcaagatgatcctgctgctgtag

SEQ ID NO: 77818 - DNA, 732 bp, Artificial Sequence
  Description of Artificial Sequence: Synthetic coding sequence
atggccaccggccagaagctgatgagagccgtgagagtgttcgagttcggcggccccgaggtgctgaagctgagaagcgacatcgccgtgcccatccccaaggaccaccaggtgctgatcaaggtgcacgcctgcggcgtgaaccccgtggagacctacatcagaagcggcacctacagcagaaagcccctgctgccctacacccccggcagcgacgtggccggcgtgatcgaggccgtgggcgacaacgccagcgccttcaagaagggcgacagagtgttcaccagcagcaccatcagcggcggctacgccgagtacgccctggccgccgaccacaccgtgtacaagctgcccgagaagctggacttcaagcagggcgccgccatcggcatcccctacttcaccgcctacagagccctgatccacagcgcctgcgtgaaggccggcgagagcgtgctggtgcacggcgccagcggcggcgtgggcctggccgcctgccagatcgccagagcctacggcctgaagatcctgggcaccgccggcaccgaggagggccagaagatcgtgctgcagaacggcgcccacgaggtgttcaaccacagagaggtgaactacatcgacaagatcaagaagtacgtgggcgagaagggcatcgacatcatcatcgagatgctggccaacgtgaacctgagcaaggacctgagcctgctgagccacggcggcagagtgtag

SEQ ID NO: 77819 - DNA, 888 bp, Artificial Sequence
  Description of Artificial Sequence: Synthetic coding sequence
atggccaccggccagaagctgatgagagccgtgagagtgttcgagttcggcggccccgaggtgctgaagctgagaagcgacatcgccgtgcccatccccaaggaccaccaggtgctgatcaaggtgcacgcctgcggcgtgaaccccgtggagacctacatcagaagcggcacctacagcagaaagcccctgctgccctacacccccggcagcgacgtggccggcgtgatcgaggccgtgggcgacaacgccagcgccttcaagaagggcgacagagtgttcaccagcagcaccatcagcggcggctacgccgagtacgccctggccgccgaccacaccgtgtacaagctgcccgagaagctggacttcaagcagggcgccgccatcggcatcccctacttcaccgcctacagagccctgatccacagcgcctgcgtgaaggccggcgagagcgtgctggtgcacggcgccagcggcggcgtgggcctggccgcctgccagatcgccagagcctacggcctgaagatcctgggcaccgccggcaccgaggagggccagaagatcgtgctgcagaacggcgcccacgaggtgttcaaccacagagaggtgaactacatcgacaagatcaaggtggtgggcagcagaggcaccatcgagatcaaccccagagacaccatggccaaggagagcagcatcatcggcgtgaccctgttcagcagcaccaaggaggagttccagcagtacgccgccgccctgcaggccggcatggagatcggctggctgaagcccgtgatcggcagccagtaccccctggagaaggtggccgaggcccacgagaacatcatccacggcagcggcgccaccggcaagatgatcctgctgctgtag

SEQ ID NO: 77820 - DNA, 579 bp, Artificial Sequence
  Description of Artificial Sequence: Synthetic coding sequence
atgcacctgctgagcagcgcctgcgtgaaggccggcgagagcgtgctggtgcacggcgccagcggcggcgtgggcctggccgcctgccagatcgccagagcctacggcctgaagatcctgggcaccgccggcaccgaggagggccagaagatcgtgctgcagaacggcgcccacgaggtgttcaaccacagagaggtgaactacatcgacaagatcaagaagtacgtgggcgagaagggcatcgacatcatcatcgagatgctggccaacgtgaacctgagcaaggacctgagcctgctgagccacggcggcagagtgatcgtggtgggcagcagaggcaccatcgagatcaaccccagagacaccatggccaaggagagcagcatcatcggcgtgaccctgttcagcagcaccaaggaggagttccagcagtacgccgccgccctgcaggccggcatggagatcggctggctgaagcccgtgatcggcagccagtaccccctggagaaggtggccgaggcccacgagaacatcatccacggcagcggcgccaccggcaagatgatcctgctgctgtag

SEQ ID NO: 77821 - DNA, 990 bp, Artificial Sequence; identical to SEQ ID NO: 77817
  Description of Artificial Sequence: Synthetic coding sequence

SEQ ID NO: 77822 - DNA, 621 bp, Artificial Sequence
  Description of Artificial Sequence: Synthetic coding sequence
atggccaccggccagaagctgatgagagccgtgagagtgttcgagttcggcggccccgaggtgctgaagctgagaagcgacatcgccgtgcccatccccaaggaccaccaggtgctgatcaaggtgcacgcctgcggcgtgaaccccgtggagacctacatcagaagcggcacctacagcagaaagcccctgctgccctacacccccggcagcgacgtggccggcgtgatcgaggccgtgggcgacaacgccagcgccttcaagaagggcgacagagtgttcaccagcagcaccatcagcggcggctacgccgagtacgccctggccgccgaccacaccgtgtacaagctgcccgagaagctggacttcaagcagggcgccgccatcggcatcccctacttcaccgcctacagagccctgatccacagcgcctgcgtgaaggccggcgagagcgtgctggtgcacggcgccagcggcggcgtgggcctggccgcctgccagatcgccagagcctacggcctgaagatcctgggcaccgccggcaccgaggagggccagaagatcgtgctgcagaacggcgcccacgaggtgttcaaccacagagaggtgaactacatctag

SEQ ID NO: 77823 - DNA, 1050 bp, Artificial Sequence
  Description of Artificial Sequence: Synthetic coding sequence
atgaagggcctgtacttccagcagagcagcaccgacgaggagatcaccttcgtgttccaggagaaggaggacctgcccgtgaccgaggacaacttcgtgaagctgcaggtgaaggcctgcgccctgagccagatcaacaccaagctgctggccgagatgaagatgaagaaggacctgttccccgtgggcagagagatcgccggcatcgtgctggacgtgggcagcaaggtgagcttcttccagcccgacgacgaggtggtgggcatcctgcccctggacagcgaggaccccggcctgtgcgaggtggtgagagtgcacgagcactacctggtgcacaagcccgagaaggtgacctggaccgaggccgccggcagcatcagagacggcgtgagagcctacaccgccctgcactacctgagccacctgagccccggcaagagcgtgctgatcatggacggcgccagcgccttcggcaccatcgccatccagctggcccaccacagaggcgccaaggtgatcagcaccgcctgcagcctggaggacaagcagtgcctggagagattcagaccccccatcgccagagtgatcgacgtgagcaacggcaaggtgcacgtggccgagagctgcctggaggagaccggcggcctgggcgtggacatcgtgctggacgccggcgtgagactgtacagcaaggacgacgagcccgccgtgaagctgcagctgctgccccacaagcacgacatcatcaccctgctgggcgtgggcggccactgggtgaccaccgaggagaacctgcagctggacccccccgacagccactgcctgttcctgaagggcgccaccctggccttcctgaacgacgaggtgtggaacctgagcaacgtgcagcagggcaagtacctgtgcatcctgaaggacgtgatggagaagctgagcaccggcgtgttcagaccccagctggacgagcccatccccctgtacgaggccaaggtgagcatggaggccgtgcagaagaaccagggcagaaagaagcaggtggtgcagttctag

SEQ ID NO: 77824 - DNA, 546 bp, Artificial Sequence
  Description of Artificial Sequence: Synthetic coding sequence
atgaagggcctgtacttccagcagagcagcaccgacgaggagatcaccttcgtgttccaggagaaggaggacctgcccgtgaccgaggacaacttcgtgaagctgcaggtgaaggcctgcgccctgagccagatcaacaccaagctgctggccgagatgaagatgaagaaggacctgttccccgtgggcagagagatcgccggcatcgtgctggacgtgggcagcaaggtgagcttcttccagcccgacgacgaggtggtgggcatcctgcccctggacagcgaggaccccggcctgtgcgaggtggtgagagtgcacgagcactacctggtgcacaagcccgagaaggtgacctggaccgaggccgccggcagcatcagagacggcgtgagagcctacaccgccctgcactacctgagccacctgagccccggcaagagcgtgctgatcatggacggcgccagcgccttcggcaccatcgccatccagctggcccaccacagaggcgccaaggtgatcagcaccgcctgcagcctggaggactag

SEQ ID NO: 77825 - DNA, 60 bp, Artificial Sequence
  Description of Artificial Sequence: Synthetic coding sequence
atgaagggcctgtacttccagcagagcagcaccgacgaggagatcaccttcgtgttctag

SEQ ID NO: 77826 - DNA, 597 bp, Artificial Sequence
  Description of Artificial Sequence: Synthetic coding sequence
atgaagggcctgtacttccagcagagcagcaccgacgaggagatcaccttcgtgttccaggagaaggaggacctgcccgtgaccgaggacaacttcgtgaagctgcaggtgaaggcctgcgccctgagccagatcaacaccaagctgctggccgagatgaagatgaagaaggacctgttccccgtgggcagagagatcgccggcatcgtgctggacgtgggcagcaaggtgagcttcttccagcccgacgacgaggtggtgggcatcctgcccctggacagcgaggaccccggcctgtgcgaggtggtgagagtgcacgagcactacctggtgcacaagcccgagaaggtgacctggaccgaggccgccggcagcatcagagacggcgtgagagcctacaccgccctgcactacctgagccacctgagccccggcaagagcgtgctgatcatggacggcgccagcgccttcggcaccatcgccatccagctggcccaccacagaggcgccaaggtgatcagcaccgcctgcagcctggaggacaagcagtgcctggagagattcagaccccccatcgagaacagcaccatcgcctag

SEQ ID NO: 77827 - DNA, 2916 bp, Artificial Sequence
  Description of Artificial Sequence: Synthetic coding sequence
atggagctgagcgacgccaacctgcagaccctgaccgagtacctgaagaagaccctggaccccgaccccgccatcagaagacccgccgagaagttcctggagagcgtggagggcaaccagaactaccccctgctgctgctgaccctgctggagaagagccaggacaacgtgatcaaggtgtgcgccagcgtgaccttcaagaactacatcaagagaaactggagaatcgtggaggacgagcccaacaagatctgcgaggccgacagagtggccatcaaggccaacatcgtgcacctgatgctgagcagccccgagcagatccagaagcagctgagcgacgccatcagcatcatcggcagagaggacttcccccagaagtggcccgacctgctgaccgagatggtgaacagattccagagcggcgacttccacgtgatcaacggcgtgctgagaaccgcccacagcctgttcaagagatacagacacgagttcaagagcaacgagctgtggaccgagatcaagctggtgctggacgccttcgccctgcccctgaccaacctgttcaaggccaccatcgagctgtgcagcacccacgccaacgacgccagcgccctgagaatcctgttcagcagcctgatcctgatcagcaagctgttctacagcctgaacttccaggacctgcccgagttcttcgaggacaacatggagacctggatgaacaacttccacaccctgctgaccctggacaacaagctgctgcagaccgacgacgaggaggaggccggcctgctggagctgctgaagagccagatctgcgacaacgccgccctgtacgcccagaagtacgacgaggagttccagagatacctgcccagattcgtgaccgccatctggaacctgctggtgaccaccggccaggaggtgaagtacgacctgctggtgagcaacgccatccagttcctggccagcgtgtgcgagagaccccactacaagaacctgttcgaggaccagaacaccctgaccagcatctgcgagaaggtgatcgtgcccaacatggagttcagagccgccgacgaggaggccttcgaggacaacagcgaggagtacatcagaagagacctggagggcagcgacatcgacaccagaagaagagccgcctgcgacctggtgagaggcctgtgcaagttcttcgagggccccgtgaccggcatcttcagcggctacgtgaacagcatgctgcaggagtacgccaagaaccccagcgtgaactggaagcacaaggacgccgccatctacctggtgaccagcctggccagcaaggcccagacccagaagcacggcatcacccaggccaacgagctggtgaacctgaccgagttcttcgtgaaccacatcctgcccgacctgaagagcgccaacgtgaacgagttccccgtgctgaaggccgacggcatcaagtacatcatgatcttcagaaaccaggtgcccaaggagcacctgctggtgagcatccccctgctgatcaaccacctgcaggccgagagcatcgtggtgcacacctacgccgcccacgccctggagagactgttcaccatgagaggccccaacaacgccaccctgttcaccgccgccgagatcgcccccttcgtggagatcctgctgaccaacctgttcaaggccctgaccctgcccggcagcagcgagaacgagtacatcatgaaggccatcatgagaagcttcagcctgctgcaggaggccatcatcccctacatccccaccctgatcacccagctgacccagaagctgctggccgtgagcaagaaccccagcaagccccacttcaaccactacatgttcgaggccatctgcctgagcatcagaatcacctgcaaggccaaccccgccgccgtggtgaacttcgaggaggccctgttcctggtgttcaccgagatcctgcagaacgacgtgcaggagttcatcccctacgtgttccaggtgatgagcctgctgctggagacccacaagaacgacatccccagcagctacatggccctgttcccccacctgctgcagcccgtgctgtgggagagaaccggcaacatccccgccctggtgagactgctgcaggccttcctggagagaggcagcaacaccatcgccagcgccgccgccgacaagatccccggcctgctgggcgtgttccagaagctgatcgccagcaaggccaacgaccaccagggcttctacctgctgaacagcatcatcgagcacatgccccccgagagcgtggaccagtacagaaagcagatcttcatcctgctgttccagagactgcagaacagcaagaccaccaagttcatcaagagcttcctggtgttcatcaacctgtactgcatcaagtacggcgccctggccctgcaggagatcttcgacggcatccagcccaagatgttcggcatggtgctggagaagatcatcatccccgagatccagaaggtgagcggcaacgtggagaagaagatctgcgccgtgggcatcaccaagctgctgaccgagtgcccccccatgatggacaccgagtacaccaagctgtggacccccctgctgcagagcctgatcggcctgttcgagctgcccgaggacgacaccatccccgacgaggagcacttcatcgacatcgaggacacccccggctaccagaccgccttcagccagctggccttcgccggcaagaaggagcacgaccccgtgggccagatggtgaacaaccccaagatccacctggcccagagcctgcacaagctgagcaccgcctgccccggcagagtgcccagcatggtgagcaccagcctgaacgccgaggccctgcagtacctgcagggctacctgcaggccgccagcgtgaccctgctgtag

SEQ ID NO: 77828 - DNA, 2748 bp, Artificial Sequence
  Description of Artificial Sequence: Synthetic coding sequence
atggagctgagcgacgccaacctgcagaccctgaccgagtacctgaagaagaccctggaccccgaccccgccatcagaagacccgccgagaagttcctggagagcgtggagggcaaccagaactaccccctgctgctgctgaccctgctggagaagagccaggacaacgtgatcaaggtgtgcgccagcgtgaccttcaagaactacatcaagagaaactggagaatcgtggaggacgagcccaacaagatctgcgaggccgacagagtggccatcaaggccaacatcgtgcacctgatgctgagcagccccgagcagatccagaagcagctgagcgacgccatcagcatcatcggcagagaggacttcccccagaagtggcccgacctgctgaccgagatggtgaacagattccagagcggcgacttccacgtgatcaacggcgtgctgagaaccgcccacagcctgttcaagagatacagacacgagttcaagagcaacgagctgtggaccgagatcaagctggtgctggacgccttcgccctgcccctgaccaacctgttcaaggccaccatcgagctgtgcagcacccacgccaacgacgccagcgccctgagaatcctgttcagcagcctgatcctgatcagcaagctgttctacagcctgaacttccaggacctgcccgagttcttcgaggacaacatggagacctggatgaacaacttccacaccctgctgaccctggacaacaagctgctgcagaccgacctggtgagcaacgccatccagttcctggccagcgtgtgcgagagaccccactacaagaacctgttcgaggaccagaacaccctgaccagcatctgcgagaaggtgatcgtgcccaacatggagttcagagccgccgacgaggaggccttcgaggacaacagcgaggagtacatcagaagagacctggagggcagcgacatcgacaccagaagaagagccgcctgcgacctggtgagaggcctgtgcaagttcttcgagggccccgtgaccggcatcttcagcggctacgtgaacagcatgctgcaggagtacgccaagaaccccagcgtgaactggaagcacaaggacgccgccatctacctggtgaccagcctggccagcaaggcccagacccagaagcacggcatcacccaggccaacgagctggtgaacctgaccgagttcttcgtgaaccacatcctgcccgacctgaagagcgccaacgtgaacgagttccccgtgctgaaggccgacggcatcaagtacatcatgatcttcagaaaccaggtgcccaaggagcacctgctggtgagcatccccctgctgatcaaccacctgcaggccgagagcatcgtggtgcacacctacgccgcccacgccctggagagactgttcaccatgagaggccccaacaacgccaccctgttcaccgccgccgagatcgcccccttcgtggagatcctgctgaccaacctgttcaaggccctgaccctgcccggcagcagcgagaacgagtacatcatgaaggccatcatgagaagcttcagcctgctgcaggaggccatcatcccctacatccccaccctgatcacccagctgacccagaagctgctggccgtgagcaagaaccccagcaagccccacttcaaccactacatgttcgaggccatctgcctgagcatcagaatcacctgcaaggccaaccccgccgccgtggtgaacttcgaggaggccctgttcctggtgttcaccgagatcctgcagaacgacgtgcaggagttcatcccctacgtgttccaggtgatgagcctgctgctggagacccacaagaacgacatccccagcagctacatggccctgttcccccacctgctgcagcccgtgctgtgggagagaaccggcaacatccccgccctggtgagactgctgcaggccttcctggagagaggcagcaacaccatcgccagcgccgccgccgacaagatccccggcctgctgggcgtgttccagaagctgatcgccagcaaggccaacgaccaccagggcttctacctgctgaacagcatcatcgagcacatgccccccgagagcgtggaccagtacagaaagcagatcttcatcctgctgttccagagactgcagaacagcaagaccaccaagttcatcaagagcttcctggtgttcatcaacctgtactgcatcaagtacggcgccctggccctgcaggagatcttcgacggcatccagcccaagatgttcggcatggtgctggagaagatcatcatccccgagatccagaaggtgagcggcaacgtggagaagaagatctgcgccgtgggcatcaccaagctgctgaccgagtgcccccccatgatggacaccgagtacaccaagctgtggacccccctgctgcagagcctgatcggcctgttcgagctgcccgaggacgacaccatccccgacgaggagcacttcatcgacatcgaggacacccccggctaccagaccgccttcagccagctggccttcgccggcaagaaggagcacgaccccgtgggccagatggtgaacaaccccaagatccacctggcccagagcctgcacaagctgagcaccgcctgccccggcagagtgcccagcatggtgagcaccagcctgaacgccgaggccctgcagtacctgcagggctacctgcaggccgccagcgtgaccctgctgtag

SEQ ID NO: 77829 - DNA, 1710 bp, Artificial Sequence
  Description of Artificial Sequence: Synthetic coding sequence
atggagacctggatgaacaacttccacaccctgctgaccctggacaacaagctgctgcagaccgacgacgaggaggaggccggcctgctggagctgctgaagagccagatctgcgacaacgccgccctgtacgcccagaagtacgacgaggagttccagagatacctgcccagattcgtgaccgccatctggaacctgctggtgaccaccggccaggaggtgaagtacgacctgctggtgagcaacgccatccagttcctggccagcgtgtgcgagagaccccactacaagaacctgttcgaggaccagaacaccctgaccagcatctgcgagaagagcatcgtggtgcacacctacgccgcccacgccctggagagactgttcaccatgagaggccccaacaacgccaccctgttcaccgccgccgagatcgcccccttcgtggagatcctgctgaccaacctgttcaaggccctgaccctgcccggcagcagcgagaacgagtacatcatgaaggccatcatgagaagcttcagcctgctgcaggaggccatcatcccctacatccccaccctgatcacccagctgacccagaagctgctggccgtgagcaagaaccccagcaagccccacttcaaccactacatgttcgaggccatctgcctgagcatcagaatcacctgcaaggccaaccccgccgccgtggtgaacttcgaggaggccctgttcctggtgttcaccgagatcctgcagaacgacgtgcaggagttcatcccctacgtgttccaggtgatgagcctgctgctggagacccacaagaacgacatccccagcagctacatggccctgttcccccacctgctgcagcccgtgctgtgggagagaaccggcaacatccccgccctggtgagactgctgcaggccttcctggagagaggcagcaacaccatcgccagcgccgccgccgacaagatccccggcctgctgggcgtgttccagaagctgatcgccagcaaggccaacgaccaccagggcttctacctgctgaacagcatcatcgagcacatgccccccgagagcgtggaccagtacagaaagcagatcttcatcctgctgttccagagactgcagaacagcaagaccaccaagttcatcaagagcttcctggtgttcatcaacctgtactgcatcaagtacggcgccctggccctgcaggagatcttcgacggcatccagcccaagatgttcggcatggtgctggagaagatcatcatccccgagatccagaaggtgagcggcaacgtggagaagaagatctgcgccgtgggcatcaccaagctgctgaccgagtgcccccccatgatggacaccgagtacaccaagctgtggacccccctgctgcagagcctgatcggcctgttcgagctgcccgaggacgacaccatccccgacgaggagcacttcatcgacatcgaggacacccccggctaccagaccgccttcagccagctggccttcgccggcaagaaggagcacgaccccgtgggccagatggtgaacaaccccaagatccacctggcccagagcctgcacaagctgagcaccgcctgccccggcagagtgcccagcatggtgagcaccagcctgaacgccgaggccctgcagtacctgcagggctacctgcaggccgccagcgtgaccctgctgtag

SEQ ID NO: 77830 - DNA, 2265 bp, Artificial Sequence
  Description of Artificial Sequence: Synthetic coding sequence
atgctgagcaacctgaacttccaggacctgcccgagttcttcgaggacaacatggagacctggatgaacaacttccacaccctgctgaccctggacaacaagctgctgcagaccgacgacgaggaggaggccggcctgctggagctgctgaagagccagatctgcgacaacgccgccctgtacgcccagaagtacgacgaggagttccagagatacctgcccagattcgtgaccgccatctggaacctgctggtgaccaccggccaggaggtgaagtacgacctgctggtgagcaacgccatccagttcctggccagcgtgtgcgagagaccccactacaagaacctgttcgaggaccagaacaccctgaccagcatctgcgagaaggtgatcgtgcccaacatggagttcagagccgccgacgaggaggccttcgaggacaacagcgaggagtacatcagaagagacctggagggcagcgacatcgacaccagaagaagagccgcctgcgacctggtgagaggcctgtgcaagttcttcgagggccccgtgaccggcatcttcagcggctacgtgaacagcatgctgcaggagtacgccaagaaccccagcgtgaactggaagcacaaggacgccgccatctacctggtgaccagcctggccagcaaggcccagacccagaagcacggcatcacccaggccaacgagctggtgaacctgaccgagttcttcgtgaaccacatcctgcccgacctgaagagcgccaacgtgaacgagttccccgtgctgaaggccgacggcatcaagtacatcatgatcttcagaaaccaggtgcccaaggagcacctgctggtgagcatccccctgctgatcaaccacctgcaggccgagagcatcgtggtgcacacctacgccgcccacgccctggagagactgttcaccatgagaggccccaacaacgccaccctgttcaccgccgccgagatcgcccccttcgtggagatcctgctgaccaacctgttcaaggccctgaccctgcccggcagcagcgagaacgagtacatcatgaaggccatcatgagaagcttcagcctgctgcaggaggccatcatcccctacatccccaccctgatcacccagctgacccagaagctgctggccgtgagcaagaaccccagcaagccccacttcaaccactacatgttcgaggccatctgcctgagcatcagaatcacctgcaaggccaaccccgccgccgtggtgaacttcgaggaggccctgttcctggtgttcaccgagatcctgcagaacgacgtgcaggagttcatcccctacgtgttccaggtgatgagcctgctgctggagacccacaagaacgacatccccagcagctacatggccctgttcccccacctgctgcagcccgtgctgtgggagagaaccggcaacatccccgccctggtgagactgctgcaggccttcctggagagaggcagcaacaccatcgccagcgccgccgccgacaagatccccggcctgctgggcgtgttccagaagctgatcgccagcaaggccaacgaccaccagggcttctacctgctgaacagcatcatcgagcacatgccccccgagagcgtggaccagtacagaaagcagatcttcatcctgctgttccagagactgcagaacagcaagaccaccaagttcatcaagagcttcctggtgttcatcaacctgtactgcatcaagtacggcgccctggccctgcaggagatcttcgacggcatccagcccaagatgttcggcatggtgctggagaagatcatcatccccgagatccagaaggtgagcggcaacgtggagaagaagatctgcgccgtgggcatcaccaagctgctgaccgagtgcccccccatgatggacaccgagtacaccaagctgtggacccccctgctgcagagcctgatcggcctgttcgagctgcccgaggacgacaccatccccgacgaggagcacttcatcgacatcgaggacacccccggctaccagaccgccttcagccagctggccttcgccggcaagaaggagcacgaccccgtgggccagatggtgaacaaccccaagatccacctggcccagagcctgcacaagctgagcaccgcctgccccggcagagtgcccagcatggtgagcaccagcctgaacgccgaggccctgcagtacctgcagggctacctgcaggccgccagcgtgaccctgctgtag

SEQ ID NO: 77831 - DNA, 888 bp, Artificial Sequence; identical to SEQ ID NO: 73171
  Description of Artificial Sequence: Synthetic coding sequence

SEQ ID NO: 77832 - DNA, 1353 bp, Artificial Sequence
  Description of Artificial Sequence: Synthetic coding sequence
atgagcgccatccaggccgcctggcccagcggcaccgagtgcatcgccaagtacaacttccacggcaccgccgagcaggacctgcccttctgcaagggcgacgtgctgaccatcgtggccgtgaccaaggaccccaactggtacaaggccaagaacaaggtgggcagagagggcatcatccccgccaactacgtgcagaagagagagggcgtgaaggccggcaccaagctgagcctgatgccctggttccacggcaagatcaccagagagcaggccgagagactgctgtacccccccgagaccggcctgttcctggtgagagagagcaccaactaccccggcgactacaccctgtgcgtgagctgcgacggcaaggtggagcactacagaatcatgtaccacgccagcaagctgagcatcgacgaggaggtgtacttcgagaacctgatgcagctggtggagcactacaccagcgacgccgacggcctgtgcaccagactgatcaagcccaaggtgatggagggcaccgtggccgcccaggacgagttctacagaagcggctgggccctgaacatgaaggagctgaagctgctgcagaccatcggcaagggcgagttcggcgacgtgatgctgggcgactacagaggcaacaaggtggccgtgaagtgcatcaagaacgacgccaccgcccaggccttcctggccgaggccagcgtgatgacccagctgagacacagcaacctggtgcagctgctgggcgtgatcgtggaggagaagggcggcctgtacatcgtgaccgagtacatggccaagggcagcctggtggactacctgagaagcagaggcagaagcgtgctgggcggcgactgcctgctgaagttcagcctggacgtgtgcgaggccatggagtacctggagggcaacaacttcgtgcacagagacctggccgccagaaacgtgctggtgagcgaggacaacgtggccaaggtgagcgacttcggcctgaccaaggaggccagcagcacccaggacaccggcaagctgcccgtgaagtggaccgcccccgaggccctgagagagaagaagttcagcaccaagagcgacgtgtggagcttcggcatcctgctgtgggagatctacagcttcggcagagtgccctaccccagaatccccctgaaggacgtggtgcccagagtggagaagggctacaagatggacgcccccgacggctgcccccccgccgtgtacgaggtgatgaagaactgctggcacctggacgccgccatgagacccagcttcctgcagctgagagagcagctggagcacatcaagacccacgagctgcacctgtag

SEQ ID NO: 77833 - DNA, 1353 bp, Artificial Sequence; identical to SEQ ID NO: 77832
  Description of Artificial Sequence: Synthetic coding sequence

SEQ ID NO: 77834 - DNA, 1200 bp, Artificial Sequence
  Description of Artificial Sequence: Synthetic coding sequence
atgagcgccatccaggccgcctggcccagcggcaccgagtgcatcgccaagtacaacttccacggcaccgccgagcaggacctgcccttctgcaagggcgacgtgctgaccatcgtggccgtgaccaaggaccccaactggtacaaggccaagaacaaggtgggcagagagggcatcatccccgccaactacgtgcagaagagagagggcgtgaaggccggcaccaagctgagcctgatgccctggttccacggcaagctgagcatcgacgaggaggtgtacttcgagaacctgatgcagctggtggagcactacaccagcgacgccgacggcctgtgcaccagactgatcaagcccaaggtgatggagggcaccgtggccgcccaggacgagttctacagaagcggctgggccctgaacatgaaggagctgaagctgctgcagaccatcggcaagggcgagttcggcgacgtgatgctgggcgactacagaggcaacaaggtggccgtgaagtgcatcaagaacgacgccaccgcccaggccttcctggccgaggccagcgtgatgacccagctgagacacagcaacctggtgcagctgctgggcgtgatcgtggaggagaagggcggcctgtacatcgtgaccgagtacatggccaagggcagcctggtggactacctgagaagcagaggcagaagcgtgctgggcggcgactgcctgctgaagttcagcctggacgtgtgcgaggccatggagtacctggagggcaacaacttcgtgcacagagacctggccgccagaaacgtgctggtgagcgaggacaacgtggccaaggtgagcgacttcggcctgaccaaggaggccagcagcacccaggacaccggcaagctgcccgtgaagtggaccgcccccgaggccctgagagagaagaagttcagcaccaagagcgacgtgtggagcttcggcatcctgctgtgggagatctacagcttcggcagagtgccctaccccagaatccccctgaaggacgtggtgcccagagtggagaagggctacaagatggacgcccccgacggctgcccccccgccgtgtacgaggtgatgaagaactgctggcacctggacgccgccatgagacccagcttcctgcagctgagagagcagctggagcacatcaagacccacgagctgcacctgtag

SEQ ID NO: 77835 - DNA, 783 bp, Artificial Sequence
  Description of Artificial Sequence: Synthetic coding sequence
atggtggccgccccctgggccacccaggagcaggaggagggcagaggcatccagcccggcgacagaggcgaccagaagagcgccgccagccagaagcccagaagcagaggcatcctgcacagcctgttctgctgcgtgtgcagagacgacggcgaggccctgcccgcccacagcggcgcccccctgctggtggaggagaacggcgccatccccaagacccccgtgcagtacctgctgcccgaggccaaggcccaggacagcgacaagatctgcgtggtgatcgacctggacgagaccctggtgcacagcagcttcaagcccgtgaacaacgccgacttcatcatccccgtggagatcgacggcgtggtgcaccaggtgtacgtgctgaagagaccccacgtggacgagttcctgcagagaatgggcgagctgttcgagtgcgtgctgttcaccgccagcctggccaagtacgccgaccccgtggccgacctgctggacaagtggggcgccttcagagccagactgttcagagagagctgcgtgttccacagaggcaactacgtgaaggacctgagcagactgggcagagacctgagaagagtgctgatcctggacaacagccccgccagctacgtgttccaccccgacaacgccgtgcccgtggccagctggttcgacaacatgagcgacaccgagctgcacgacctgctgcccttcttcgagcagctgagcagagtggacgacgtgtacagcgtgctgagacagcccagacccggcagctag

SEQ ID NO: 77836 - DNA, 2604 bp, Artificial Sequence
  Description of Artificial Sequence: Synthetic coding sequence
atggaggtgcccgccgccggcagagtgcccgccgagggcgcccccaccgccgccgtggccgaggtgagatgccccggccccgcccccctgagactgctggagtggagagtggccgccggcgccgccgtgagaatcggcagcgtgctggccgtgttcgaggccgccgccagcgcccagagcagcggcgccagccagagcagagtggccagcggcggctgcgtgagacccgccagacccgagagaagactgagaagcgagagagccggcgtggtgagagagctgtgcgcccagcccggccaggtggtggcccccggcgccgtgctggtgagactggagggctgcagccaccccgtggtgatgaagggcctgtgcgccgagtgcggccaggacctgacccagctgcagagcaagaacggcaagcagcaggtgcccctgagcaccgccaccgtgagcatggtgcacagcgtgcccgagctgatggtgagcagcgagcaggccgagcagctgggcagagaggaccagcagagactgcacagaaacagaaagctggtgctgatggtggacctggaccagaccctgatccacaccaccgagcagcactgccagcagatgagcaacaagggcatcttccacttccagctgggcagaggcgagcccatgctgcacaccagactgagaccccactgcaaggacttcctggagaagatcgccaagctgtacgagctgcacgtgttcaccttcggcagcagactgtacgcccacaccatcgccggcttcctggaccccgagaagaagctgttcagccacagaatcctgagcagagacgagtgcatcgaccccttcagcaagaccggcaacctgagaaacctgttcccctgcggcgacagcatggtgtgcatcatcgacgacagagaggacgtgtggaagttcgcccccaacctgatcaccgtgaagaagtacgtgtacttccagggcaccggcgacatgaacgccccccccggcagcagagagagccagaccagaaagaaggtgaaccacagcagaggcaccgaggtgagcgagcccagcccccccgtgagagaccccgagggcgtgacccaggcccccggcgtggagcccagcaacggcctggagaagcccgccagagagctgaacggcagcgaggccgccacccccagagacagccccagacccggcaagcccgacgagagagacatctggccccccgcccaggcccccaccagcagccaggagctggccggcgcccccgagccccagggcagctgcgcccagggcggcagagtggcccccggccagagacccgcccagggcgccaccggcaccgacctggacttcgacctgagcagcgacagcgagagcagcagcgagagcgagggcaccaagagcagcagcagcgccagcgacggcgagagcgagggcaagagaggcagacagaagcccaaggccgcccccgagggcgccggcgccctggcccagggcagcagcctggagcccggcagacccgccgcccccagcctgcccggcgaggccgagcccggcgcccacgcccccgacaaggagcccgagctgggcggccaggaggagggcgagagagacggcctgtgcggcctgggcaacggctgcgccgacagaaaggaggccgagaccgagagccagaacagcgagctgagcggcgtgaccgccggcgagagcctggaccagagcatggaggaggaggaggaggaggacaccgacgaggacgaccacctgatctacctggaggagatcctggtgagagtgcacaccgactactacgccaagtacgacagatacctgaacaaggagatcgaggaggcccccgacatcagaaagatcgtgcccgagctgaagagcaaggtgctggccgacgtggccatcatcttcagcggcctgcaccccaccaacttccccatcgagaagaccagagagcactaccacgccaccgccctgggcgccaagatcctgaccagactggtgctgagccccgacgcccccgacagagccacccacctgatcgccgccagagccggcaccgagaaggtgctgcaggcccaggagtgcggccacctgcacgtggtgaaccccgactggctgtggagctgcctggagagatgggacaaggtggaggagcagctgttccccctgagagacgaccacaccaaggcccagagagagaacagccccgccgccttccccgacagagagggcgtgccccccaccgccctgttccaccccatgcccgtgctgcccaaggcccagcccggccccgaggtgagaatctacgacagcaacaccggcaagctgatcagaaccggcgccagaggcccccccgcccccagcagcagcctgcccatcagacaggagcccagcagcttcagatggaccaccagcctggagaaggccgccaccaccgccaccgccagaagaggcggcctgagaagcagaagaagaagccccagccccggcagccagggccccgccggcagcggcagaagcggccacctgagacccgccagaggcgccagacagggcgccggcggccccgaggccaccagaggcagctag

SEQ ID NO: 77837 - DNA, 2886 bp, Artificial Sequence
  Description of Artificial Sequence: Synthetic coding sequence
atggaggtgcccgccgccggcagagtgcccgccgagggcgcccccaccgccgccgtggccgaggtgagatgccccggccccgcccccctgagactgctggagtggagagtggccgccggcgccgccgtgagaatcggcagcgtgctggccgtgttcgaggccgccgccagcgcccagagcagcggcgccagccagagcagagtggccagcggcggctgcgtgagacccgccagacccgagagaagactgagaagcgagagagccggcgtggtgagagagctgtgcgcccagcccggccaggtggtggcccccggcgccgtgctggtgagactggagggctgcagccaccccgtggtgatgaagggcctgtgcgccgagtgcggccaggacctgacccagctgcagagcaagaacggcaagcagcaggtgcccctgagcaccgccaccgtgagcatggtgcacagcgtgcccgagctgatggtgagcagcgagcaggccgagcagctgggcagagaggaccagcagagactgcacagaaacagaaagctggtgctgatggtggacctggaccagaccctgatccacaccaccgagcagcactgccagcagatgagcaacaagggcatcttccacttccagctgggcagaggcgagcccatgctgcacaccagactgagaccccactgcaaggacttcctggagaagatcgccaagctgtacgagctgcacgtgttcaccttcggcagcagactgtacgcccacaccatcgccggcttcctggaccccgagaagaagctgttcagccacagaatcctgagcagagacgagtgcatcgaccccttcagcaagaccggcaacctgagaaacctgttcccctgcggcgacagcatggtgtgcatcatcgacgacagagaggacgtgtggaagttcgcccccaacctgatcaccgtgaagaagtacgtgtacttccagggcaccggcgacatgaacgccccccccggcagcagagagagccagaccagaaagaaggtgaaccacagcagaggcaccgaggtgagcgagcccagcccccccgtgagagaccccgagggcgtgacccaggcccccggcgtggagcccagcaacggcctggagaagcccgccagagagctgaacggcagcgaggccgccacccccagagacagccccagacccggcaagcccgacgagagagacatctggccccccgcccaggcccccaccagcagccaggagctggccggcgcccccgagccccagggcagctgcgcccagggcggcagagtggcccccggccagagacccgcccagggcgccaccggcaccgacctggacttcgacctgagcagcgacagcgagagcagcagcgagagcgagggcaccaagagcagcagcagcgccagcgacggcgagagcgagggcaagagaggcagacagaagcccaaggccgcccccgagggcgccggcgccctggcccagggcagcagcctggagcccggcagacccgccgcccccagcctgcccggcgaggccgagcccggcgcccacgcccccgacaaggagcccgagctgggcggccaggaggagggcgagagagacggcctgtgcggcctgggcaacggctgcgccgacagaaaggaggccgagaccgagagccagaacagcgagctgagcggcgtgaccgccggcgagagcctggaccagagcatggaggaggaggaggaggaggacaccgacgaggacgaccacctgatctacctggaggagatcctggtgagagtgcacaccgactactacgccaagtacgacagatacctgaacaaggagatcgaggaggcccccgacatcagaaagatcgtgcccgagctgaagagcaaggtgctggccgacgtggccatcatcttcagcggcctgcaccccaccaacttccccatcgagaagaccagagagcactaccacgccaccgccctgggcgccaagatcctgaccagactggtgctgagccccgacgcccccgacagagccacccacctgatcgccgccagagccggcaccgagaaggtgctgcaggcccaggagtgcggccacctgcacgtggtgaaccccgactggctgtggagctgcctggagagatgggacaaggtggaggagcagctgttccccctgagagacgaccacaccaaggcccagagagagaacagccccgccgccttccccgacagagagggcgtgccccccaccgccctgttccaccccatgcccgtgctgcccaaggcccagcccggccccgaggtgagaatctacgacagcaacaccggcaagctgatcagaaccggcgccagaggcccccccgcccccagcagcagcctgcccatcagacaggagcccagcagcttcagagccgtgccccccccccagccccagatgttcggcgaggagctgcccgacgcccaggacggcgagcagcccggccccagcagaagaaagagacagcccagcatgagcgagaccatgcccctgtacaccctgtgcaaggaggacctggagagcatggacaaggaggtggacgacatcctgggcgagggcagcgacgacagcgacagcgagaagagaagacccgaggagcaggaggaggagccccagcccagaaagcccggcaccagaagagagagaaccctgggcgcccccgccagcagcgagagaagcgccgccggcggcagaggccccagaggccacaagagaaagctgaacgaggaggacgccgccagcgagagcagcagagagagcagcaacgaggacgagggcagcagcagcgaggccgacgagatggccaaggccctggaggccgagctgaacgacctgatgtag

SEQ ID NO: 77838 - DNA, 786 bp, Artificial Sequence
  Description of Artificial Sequence: Synthetic coding sequence
atggacagcagcgccgtgatcacccagatcagcaaggaggaggccagaggccccctgagaggcaagggcgaccagaagagcgccgccagccagaagcccagaagcagaggcatcctgcacagcctgttctgctgcgtgtgcagagacgacggcgaggccctgcccgcccacagcggcgcccccctgctggtggaggagaacggcgccatccccaagcagacccccgtgcagtacctgctgcccgaggccaaggcccaggacagcgacaagatctgcgtggtgatcgacctggacgagaccctggtgcacagcagcttcaagcccgtgaacaacgccgacttcatcatccccgtggagatcgacggcgtggtgcaccaggtgtacgtgctgaagagaccccacgtggacgagttcctgcagagaatgggcgagctgttcgagtgcgtgctgttcaccgccagcctggccaagtacgccgaccccgtggccgacctgctggacaagtggggcgccttcagagccagactgttcagagagagctgcgtgttccacagaggcaactacgtgaaggacctgagcagactgggcagagacctgagaagagtgctgatcctggacaacagccccgccagctacgtgttccaccccgacaacgccgtgcccgtggccagctggttcgacaacatgagcgacaccgagctgcacgacctgctgcccttcttcgagcagctgagcagagtggacgacgtgtacagcgtgctgagacagcccagacccggcagctag

SEQ ID NO: 77839 - DNA, 2928 bp, Artificial Sequence
  Description of Artificial Sequence: Synthetic coding sequence
atggaggactacgagcaggagctgtgcggcgtggaggacgacttccacaaccagttcgccgccgagctggaggtgctggccgagctggagggcgccagcacccccagccccagcggcgtgcccctgttcaccgccggcagaccccccagaaccttcgaggaggccctggccagaggcgacgccgccagcagccccgcccccgccgccagcgtgggcagcagccagggcggcgccagaaagagacaggtggacgccgacctgcagcccgccggcagcctgccccacgcccccagaatcaagagacccagactgcaggtggtgaagagactgaacttcagaagcgaggagatggaggagccccccccccccgacagcagccccaccgacatcacccccccccccagccccgaggacctggccgagctgtggggccacggcgtgagcgaggccgccgccgacgtgggcctgaccagagccagccccgccgccagaaaccccgtgctgagaagaccccccatcctggaggactacgtgcacgtgaccagcaccgagggcgtgagagcctacctggtgctgagagccgaccccatggcccccggcgtgcagggcagcctgctgcacgtgccctggagaggcggcggccagctggacctgctgggcgtgagcctggccagcctgaagaagcaggtggacggcgagagaagagagagactgctgcaggaggcccagaagctgagcgacaccctgcacagcctgagaagcggcgaggaggaggccgcccagcccctgggcgcccccgaggaggagcccaccgacggccaggacgccagcagccactgcctgtgggtggacgagttcgcccccagacactacaccgagctgctgagcgacgacttcaccaacagatgcctgctgaagtggctgaagctgtgggacctggtggtgttcggccacgagagacccagcagaaagcccagacccagcgtggagcccgccagagtgagcaaggaggccaccgcccccggcaagtggaagagccacgagcaggtgctggaggagatgctggaggccggcctggaccccagccagagacccaagcagaaggtggccctgctgtgcggcccccccggcctgggcaagaccaccctggcccacgtgatcgccagacacgccggctacagcgtggtggagatgaacgccagcgacgacagaagccccgaggtgttcagaaccagaatcgaggccgccacccagatggagagcgtgctgggcgccggcggcaagcccaactgcctggtgatcgacgagatcgacggcgcccccgtggccgccatcaacgtgctgctgagcatcctgaacagaaagggcccccaggaggtgggcccccagggccccgccgtgcccagcggcggcggcagaagaagaagagccgagggcggcctgctgatgagacccatcatctgcatctgcaacgaccagttcgcccccagcctgagacagctgaagcagcaggccttcctgctgcacttcccccccaccctgcccagcagactggtgcagagactgcaggaggtgagcctgagacagggcatgagagccgaccccggcgtgctggccgccctgtgcgagaagaccgacaacgacatcagagcctgcatcaacaccctgcagttcctgtacagcagaggccagagagagctgagcgtgagagacgtgcaggccaccagagtgggcctgaaggaccagagaagaggcctgttcagcgtgtggcaggaggtgttccagctgcccagagcccagagaagaagagtgggccaggaccccgccctgcccgccgacaccctgctgctgggcgacggcgacgccggcagcctgaccagcgccagccagagattctacagagtgctgcacgccgccgccagcgccggcgagcacgagaaggtggtgcagggcctgttcgacaacttcctgagactgagactgagagacagcagcctgggcgccgtgtgcgtggccctggactggctggccttcgacgacctgctggccggcgccgcccaccacagccagagcttccagctgctgagatacccccccttcctgcccgtggccttccacgtgctgttcgccagcagccacacccccagaatcaccttccccagcagccagcaggaggcccagaacagaatgagccagatgagaaacctgatccagaccctggtgagcggcatcgcccccgccaccagaagcagagccaccccccaggccctgctgctggacgccctgtgcctgctgctggacatcctggcccccaagctgagacccgtgagcacccagctgtacagcaccagagagaagcagcagctggccagcctggtgggcaccatgctggcctacagcctgacctacagacaggagagaacccccgacggccagtacatctacagactggagcccaacgtggaggagctgtgcagattccccgagctgcccgccagaaagcccctgacctaccagaccaagcagctgatcgccagagagatcgaggtggagaagatgagaagagccgaggccagcgccagagtggagaacagcccccaggtggacggcagcccccccggcctggagggcctgctgggcggcatcggcgagaagggcgtgcacagacccgcccccagaaaccacgagcagagactggagcacatcatgagaagagccgccagagaggagcagcccgagaaggacttcttcggcagagtggtggtgagaagcaccgccgtgcccagcgccggcgacaccgcccccgagcaggacagcgtggagagaagaatgggcaccgccgtgggcagaagcgaggtgtggttcagattcaacgagggcgtgagcaacgccgtgagaagaagcctgtacatcagagacctgctgtag

SEQ ID NO: 77840 - DNA, 3555 bp, Artificial Sequence
  Description of Artificial Sequence: Synthetic coding sequence
atgcacgtgaacgccagcgccagaagatggggcagaggcggcgccgccgccctgcccggccccgccgccagccccagaagacccgcccccagaaccggccccgtgggcagacccaccctggcccccagccccagcagagcccacgcccacgccaagaccaacctgctgcccggcagagccgtgcaggcccccgacgccgtgcccggcgccggcagcagcagagcccccgccagatggagacccagagaccccggcagcagcgcccccgacgcctggcagagattcagacccgcccccctgagagcccagcccagacccccccccagacccgcccccggcccccccccccccagaaagggcggctgcggcggccagtggagagccccccaggacagaaccagaggcctgagaagcagaaacagccccagaccccccctggcccagcccagactgagacacgccaaccagtggagagccccccccggcacccccgccgccgactggagaagacccgccagaagcggcagagccgtgagagacggcggcggcggcgccggcggcagcgagagagagctgggcctggccgacggcatggaggactacgagcaggagctgtgcggcgtggaggacgacttccacaaccagttcgccgccgagctggaggtgctggccgagctggagggcgccagcacccccagccccagcggcgtgcccctgttcaccgccggcagaccccccagaaccttcgaggaggccctggccagaggcgacgccgccagcagccccgcccccgccgccagcgtgggcagcagccagggcggcgccagaaagagacaggtggacgccgacctgcagcccgccggcagcctgccccacgcccccagaatcaagagacccagactgcaggtggtgaagagactgaacttcagaagcgaggagatggaggagccccccccccccgacagcagccccaccgacatcacccccccccccagccccgaggacctggccgagctgtggggccacggcttcagcgaggccgccgccgacgtgggcctgaccagagccagccccgccgccagaaaccccgtgctgagaagaccccccatcctggaggactacgtgcacgtgaccagcaccgagggcgtgagagcctacctggtgctgagagccgaccccatggcccccggcgtgcagggcagcctgctgcacgtgccctggagaggcggcggccagctggacctgctgggcgtgagcctggccagcctgaagaagcaggtggacggcgagagaagagagagactgctgcaggaggcccagaagctgagcgacaccctgcacagaagcggcgaggaggaggccgcccagcccctgggcgcccccgaggaggagcccaccgacggccaggacgccagcagccactgcctgtgggtggacgagttcgcccccagacactacaccgagctgctgagcgacgacttcaccaacagatgcctgctgaagtggctgaagctgtgggacctggtggtgttcggccacgagagacccagcagaaagcccagacccagcgtggagcccgccagagtgagcaaggaggccaccgcccccggcaagtggaagagccacgagcaggtgctggaggagatgctggaggccggcctggaccccagccagagacccaagcagaaggtggccctgctgtgcggcccccccggcctgggcaagaccaccctggcccacgtgatcgccagacacgccggctacagcgtggtggagatgaacgccagcgacgacagaagccccgaggtgttcagaaccagaatcgaggccgccacccagatggagagcgtgctgggcgccggcggcaagcccaactgcctggtgatcgacgagatcgacggcgcccccgtggccgccatcaacgtgctgctgagcatcctgaacagaaagggcccccaggaggtgggcccccagggccccgccgtgcccagcggcggcggcagaagaagaagagccgagggcggcctgctgatgagacccatcatctgcatctgcaacgaccagttcgcccccagcctgagacagctgaagcagcaggccttcctgctgcacttcccccccaccctgcccagcagactggtgcagagactgcaggagggcatgagagccgaccccggcgtgctggccgccctgtgcgagaagaccgacaacgacatcagagcctgcatcaacaccctgcagttcctgtacagcagaggccagagagagctgagcgtgagagacgtgcaggccaccagagtgggcctgaaggaccagagaagaggcctgttcagcgtgtggcaggaggtgttccagctgcccagagcccagagaagcagccagcacgtgagcgtgctgacctgccacggcacccccggcgacgccggcctggtggtgctgcaggacatgggcgacgccggcctgggcctgtgggacgtgctgctgctggcctggaccagaagaggcaccttccccggcagattctacagagtgctgcacgccgccgccagcgccggcgagcacgagaaggtggtgcagggcctgttcgacaacttcctgagactgagactgagagacagcagcctgggcgccgtgtgcgtggccctggactggctggccttcgacgacctgctggccggcgccgcccaccacagccagagcttccagctgctgagatacccccccttcctgcccgtggccttccacgtgctgttcgccagcagccacacccccagaatcaccttccccagcagccagcaggaggcccagaacagaatgagccagatgagaaacctgatccagaccctggtgagcggcatcgcccccgccaccagaagcagagccaccccccaggccctgctgctggacgccctgtgcctgctgctggacatcctggcccccaagctgagacccgtgagcacccagctgtacagcaccagagagaagcagcagctggccagcctggtgggcaccatgctggcctacagcctgacctacagacaggagagaacccccgacggccagtacatctacagactggagcccaacgtggaggagctgtgcagattccccgagctgcccgccagaaagcccctgacctaccagaccaagcagctgatcgccagagagatcgaggtggagaagatgagaagagccgaggccagcgccagagtggagaacagcccccaggtggacggcagcccccccggcctggagggcctgctgggcggcatcggcgagaagggcgtgcacagacccgcccccagaaaccacgagcagagactggagcacatcatgagaagagccgccagagaggagcagcccgagaaggacttcttcggcagagtggtggtgagaagcaccgccgtgcccagcgccggcgacaccgcccccgagcaggacagcgtggagagaagaatgggcaccgccgtgggcagaagcgaggtgtggttcagattcaacgagggcgtgagcaacgccgtgagaagaagcctgtacatcagagacctgctgtag

SEQ ID NO: 77841 - DNA, 3012 bp, Artificial Sequence
  Description of Artificial Sequence: Synthetic coding sequence
atggaggactacgagcaggagctgtgcggcgtggaggacgacttccacaaccagttcgccgccgagctggaggtgctggccgagctggagggcgccagcacccccagccccagcggcgtgcccctgttcaccgccggcagaccccccagaaccttcgaggaggccctggccagaggcgacgccgccagcagccccgcccccgccgccagcgtgggcagcagccagggcggcgccagaaagagacaggtggacgccgacctgcagcccgccggcagcctgccccacggcagactggccgccctgccccagggcctgagaagcggcagagaggccgaggaggccagcggcagcctgcacgtgagcccccccgcccccagaatcaagagacccagactgcaggtggtgaagagactgaacttcagaagcgaggagatggaggagccccccccccccgacagcagccccaccgacatcacccccccccccagccccgaggacctggccgagctgtggggccacggcgtgagcgaggccgccgccgacgtgggcctgaccagagccagccccgccgccagaaaccccgtgctgagaagaccccccatcctggaggactacgtgcacgtgaccagcaccgagggcgtgagagcctacctggtgctgagagccgaccccatggcccccggcgtgcagggcagcctgctgcacgtgccctggagaggcggcggccagctggacctgctgggcgtgagcctggccagcctgaagaagcaggtggacggcgagagaagagagagactgctgcaggaggcccagaagctgagcgacaccctgcacagcctgagaagcggcgaggaggaggccgcccagcccctgggcgcccccgaggaggagcccaccgacggccaggacgccagcagccactgcctgtgggtggacgagttcgcccccagacactacaccgagctgctgagcgacgacttcaccaacagatgcctgctgaagtggctgaagctgtgggacctggtggtgttcggccacgagagacccagcagaaagcccagacccagcgtggagcccgccagagtgagcaaggaggccaccgcccccggcaagtggaagagccacgagcaggtgctggaggagatgctggaggccggcctggaccccagccagagacccaagcagaaggtggccctgctgtgcggcccccccggcctgggcaagaccaccctggcccacgtgatcgccagacacgccggctacagcgtggtggagatgaacgccagcgacgacagaagccccgaggtgttcagaaccagaatcgaggccgccacccagatggagagcgtgctgggcgccggcggcaagcccaactgcctggtgatcgacgagatcgacggcgcccccgtggccgccatcaacgtgctgctgagcatcctgaacagaaagggcccccaggaggtgggcccccagggccccgccgtgcccagcggcggcggcagaagaagaagagccgagggcggcctgctgatgagacccatcatctgcatctgcaacgaccagttcgcccccagcctgagacagctgaagcagcaggccttcctgctgcacttcccccccaccctgcccagcagactggtgcagagactgcaggaggtgagcctgagacagggcatgagagccgaccccggcgtgctggccgccctgtgcgagaagaccgacaacgacatcagagcctgcatcaacaccctgcagttcctgtacagcagaggccagagagagctgagcgtgagagacgtgcaggccaccagagtgggcctgaaggaccagagaagaggcctgttcagcgtgtggcaggaggtgttccagctgcccagagcccagagaagaagagtgggccaggaccccgccctgcccgccgacaccctgctgctgggcgacggcgacgccggcagcctgaccagcgccagccagagattctacagagtgctgcacgccgccgccagcgccggcgagcacgagaaggtggtgcagggcctgttcgacaacttcctgagactgagactgagagacagcagcctgggcgccgtgtgcgtggccctggactggctggccttcgacgacctgctggccggcgccgcccaccacagccagagcttccagctgctgagatacccccccttcctgcccgtggccttccacgtgctgttcgccagcagccacacccccagaatcaccttccccagcagccagcaggaggcccagaacagaatgagccagatgagaaacctgatccagaccctggtgagcggcatcgcccccgccaccagaagcagagccaccccccaggccctgctgctggacgccctgtgcctgctgctggacatcctggcccccaagctgagacccgtgagcacccagctgtacagcaccagagagaagcagcagctggccagcctggtgggcaccatgctggcctacagcctgacctacagacaggagagaacccccgacggccagtacatctacagactggagcccaacgtggaggagctgtgcagattccccgagctgcccgccagaaagcccctgacctaccagaccaagcagctgatcgccagagagatcgaggtggagaagatgagaagagccgaggccagcgccagagtggagaacagcccccaggtggacggcagcccccccggcctggagggcctgctgggcggcatcggcgagaagggcgtgcacagacccgcccccagaaaccacgagcagagactggagcacatcatgagaagagccgccagagaggagcagcccgagaaggacttcttcggcagagtggtggtgagaagcaccgccgtgcccagcgccggcgacaccgcccccgagcaggacagcgtggagagaagaatgggcaccgccgtgggcagaagcgaggtgtggttcagattcaacgagggcgtgagcaacgccgtgagaagaagcctgtacatcagagacctgctgtag

SEQ ID NO: 77842 - DNA, 1575 bp, Artificial Sequence
  Description of Artificial Sequence: Synthetic coding sequence
atgaaggagcccagaatcttccccagagagagacccaccccctggaccagagcccccctgccccccagaggcagactggacggcagcctgggcccccagggcggccccgtgctgaacaccggccaccccctgggcgtgaacagcgaccccttcctgatggccgccggcagcctgggcggcaacctgacccccttccccagaaaccccagccccttccccgccagcagcggcagcctggccagcaaccccgcccccttccccgccggcgccagagaccccagcatggccagcttccccagaggcatgaaccccaccggcaccggcgccgtgagcttccccagacccggcggcctgctgggccccggccccggccccggccccaccctgaaccccagaaccggcgccctgcccggccccggccccctgagcaaccccagactgggcggcctgcccggccccggccccatgagcaaccccagagccggcggcctgctgggcgccggccccgaccccagaggcggcggccccatgggccccggcagcggccccaacctgagagccggcgtgctgctgaccagcggcaacggcccccccaaccccagacccgtgggcctgggccccggccccaaccccaacctgagaagcggcttcctgggcaccaaccccgcccccagaagcggcgtgttccccggccccggcctgggccccaaccccagacccagcggcctgggccccggccccaacctggacgccagagccggcggcctgctgggcaccggcagcggcctgaacctgagaatggccggcccccagggcctggacctggcccccatcctgagagccgccggcctgctgggcgccaacagcgccagcttcagccaggccagcggcaacatgggcaccagccccagcagcatggccagagtgcccggccccatgggccccaacagcggccccagcagcagaggcatcggcctgcccggccccaaccccagccccatgagcagagcccccggccccatcggccccaacagcgcccacttcagcagacccgtgggccccatgggcgtgaacgccaaccccttccccagaggcgccggcagcagcgccttcagccagagcagcggcaccctggccagcaaccccgccaccttccagagaagcgccggcctgcagggcagcaaccccaccatcttccccagagccagcggccccctgggccccaaccccgccaacttccccagagccaccggcctgcagggccccagccccaccaccttccccagaagcaccggccccctgggccccggccaggtgaccttccccagacccgccgccggccacctgggccccagccccgccggccccgtgggcatcaaccccgcccccttcaccagacccaccggcaccctgggcctgaaccccgccagcttccccagaatgaacggccccgccggcaagagcttcgtgcccttccccagagtgggcagcctgcccggcaccaaccccgccgccttccccagacccggcggccccatggccgccatgtaccccaacggcatgctgcccccctag

SEQ ID NO: 77843 - DNA, 366 bp, Artificial Sequence
  Description of Artificial Sequence: Synthetic coding sequence
atggtgcagatcgtgatcagcagcgccagagccggcggcctggccgagtgggtgctgatggagctgcagggcgagatcgaggccagatacagcaccggcctggccggcaacctgctgggcgacctgcactacaccaccgagggcatccccgtgctgatcgtgggccaccacatcctgtacggcaagatcatccacctggagaagcccttcgccgtgctggtgaagcacacccccggcgaccaggactgcgacgagctgggcagagagaccggcaccagatacctggtgaccgccctgatcaaggacaagatcctgttcaagaccagacccaagcccatcatcaccagcgtgcccaagaaggtgtag

SEQ ID NO: 77844 - DNA, 366 bp, Artificial Sequence; identical to SEQ ID NO: 77843
  Description of Artificial Sequence: Synthetic coding sequence

SEQ ID NO: 77845 - DNA, 1776 bp, Artificial Sequence
  Description of Artificial Sequence: Synthetic coding sequence
atgaagtacatcctggtgaccggcggcgtgatcagcggcatcggcaagggcatcatcgccagcagcgtgggcaccatcctgaagagctgcggcctgcacgtgaccagcatcaagatcgacccctacatcaacatcgacgccggcaccttcagcccctacgagcacggcgaggtgttcgtgctggacgacggcggcgaggtggacctggacctgggcaactacgagagattcctggacatcagactgaccaaggacaacaacctgaccaccggcaagatctaccagtacgtgatcaacaaggagagaaagggcgactacctgggcaagaccgtgcaggtggtgccccacatcaccgacgccatccaggagtgggtgatgagacaggccctgatccccgtggacgaggacggcctggagccccaggtgtgcgtgatcgagctgggcggcaccgtgggcgacatcgagagcatgcccttcatcgaggccttcagacagttccagttcaaggtgaagagagagaacttctgcaacatccacgtgagcctggtgccccagcccagcagcaccggcgagcagaagaccaagcccacccagaacagcgtgagagagctgagaggcctgggcctgagccccgacctggtggtgtgcagatgcagcaaccccctggacaccagcgtgaaggagaagatcagcatgttctgccacgtggagcccgagcaggtgatctgcgtgcacgacgtgagcagcatctacagagtgcccctgctgctggaggagcagggcgtggtggactacttcctgagaagactggacctgcccatcgagagacagcccagaaagatgctgatgaagtggaaggagatggccgacagatacgacagactgctggagacctgcagcatcgccctggtgggcaagtacaccaagttcagcgacagctacgccagcgtgatcaaggccctggagcacagcgccctggccatcaaccacaagctggagatcaagtacatcgacagcgccgacctggagcccatcaccagccaggaggagcccgtgagataccacgaggcctggcagaagctgtgcagcgcccacggcgtgctggtgcccggcggcttcggcgtgagaggcaccgagggcaagatccaggccatcgcctgggccagaaaccagaagaagcccttcctgggcgtgtgcctgggcatgcagctggccgtggtggagttcagcagaaacgtgctgggctggcaggacgccaacagcaccgagttcgaccccaccaccagccaccccgtggtggtggacatgcccgagcacaaccccggccagatgggcggcaccatgagactgggcaagagaagaaccctgttccagaccaagaacagcgtgatgagaaagctgtacggcgacgccgactacctggaggagagacacagacacagattcgaggtgaaccccgtgtggaagaagtgcctggaggagcagggcctgaagttcgtgggccaggacgtggagggcgagagaatggagatcgtggagctggaggaccaccccttcttcgtgggcgtgcagtaccaccccgagttcctgagcagacccatcaagcccagccccccctacttcggcctgctgctggccagcgtgggcagactgagccactacctgcagaagggctgcagactgagccccagagacacctacagcgacagaagcggcagcagcagccccgacagcgagatcaccgagctgaagttccccagcatcaaccacgactag

SEQ ID NO: 77846 - DNA, 1776 bp, Artificial Sequence; identical to SEQ ID NO: 77845
  Description of Artificial Sequence: Synthetic coding sequence

SEQ ID NO: 77847 - DNA, 1083 bp, Artificial Sequence
  Description of Artificial Sequence: Synthetic coding sequence
atgttctgccacgtggagcccgagcaggtgatctgcgtgcacgacgtgagcagcatctacagagtgcccctgctgctggaggagcagggcgtggtggactacttcctgagaagactggacctgcccatcgagagacagcccagaaagatgctgatgaagtggaaggagatggccgacagatacgacagactgctggagacctgcagcatcgccctggtgggcaagtacaccaagttcagcgacagctacgccagcgtgatcaaggccctggagcacagcgccctggccatcaaccacaagctggagatcaagtacatcgacagcgccgacctggagcccatcaccagccaggaggagcccgtgagataccacgaggcctggcagaagctgtgcagcgcccacggcgtgctggtgcccggcggcttcggcgtgagaggcaccgagggcaagatccaggccatcgcctgggccagaaaccagaagaagcccttcctgggcgtgtgcctgggcatgcagctggccgtggtggagttcagcagaaacgtgctgggctggcaggacgccaacagcaccgagttcgaccccaccaccagccaccccgtggtggtggacatgcccgagcacaaccccggccagatgggcggcaccatgagactgggcaagagaagaaccctgttccagaccaagaacagcgtgatgagaaagctgtacggcgacgccgactacctggaggagagacacagacacagattcgaggtgaaccccgtgtggaagaagtgcctggaggagcagggcctgaagttcgtgggccaggacgtggagggcgagagaatggagatcgtggagctggaggaccaccccttcttcgtgggcgtgcagtaccaccccgagttcctgagcagacccatcaagcccagccccccctacttcggcctgctgctggccagcgtgggcagactgagccactacctgcagaagggctgcagactgagccccagagacacctacagcgacagaagcggcagcagcagccccgacagcgagatcaccgagctgaagttccccagcatcaaccacgactag

SEQ ID NO: 77848 - DNA, 945 bp, Artificial Sequence
  Description of Artificial Sequence: Synthetic coding sequence
atgcccaagagcaagagcaagatgaagtacatcctggtgaccggcggcgtgatcagcggcatcggcaagggcatcatcgccagcagcgtgggcaccatcctgaagagctgcggcctgcacgtgaccagcatcaagatcgacccctacatcaacatcgacgccggcaccttcagcccctacgagcacggcgaggtgttcgtgctggacgacggcggcgaggtggacctggacctgggcaactacgagagattcctggacatcagactgaccaaggacaacaacctgaccaccggcaagatctaccagtacgtgatcaacaaggagagaaagggcgactacctgggcaagaccgtgcaggtggtgccccacatcaccgacgccatccaggagtgggtgatgagacaggccctgatccccgtggacgaggacggcctggagccccaggtgtgcgtgatcgagctgggcggcaccgtgggcgacatcgagagcatgcccttcatcgaggccttcagacagttccagttcaaggtgaagagagagaacttctgcaacatccacgtgagcctggtgccccagcccagcagcaccggcgagcagaagaccaagcccacccagaacagcgtgagagagctgagaggcctgggcctgagccccgacctggtggtgtgcagatgcagcaaccccctggacaccagcgtgaaggagaagatcagcatgttctgccacgtggagcccgagcaggtgatctgcgtgcacgacgtgagcagcatctacagagtgcccctgctgctggaggagcagggcgtggtggactacttcctgagaagactggacctgcccatcgagagacagcccagaaagatgctgatgaagtggaaggagatggccgacagattcgcctgcaacgaggagctgggcgtgctggccagcttcaccctgctgtag

SEQ ID NO: 77849 - DNA, 1761 bp, Artificial Sequence
  Description of Artificial Sequence: Synthetic coding sequence
atgaagtacatcctggtgaccggcggcgtgatcagcggcatcggcaagggcatcatcgccagcagcatcggcaccatcctgaagagctgcggcctgagagtgaccgccatcaagatcgacccctacatcaacatcgacgccggcaccttcagcccctacgagcacggcgaggtgttcgtgctgaacgacggcggcgaggtggacctggacctgggcaactacgagagattcctggacatcaacctgtacaaggacaacaacatcaccaccggcaagatctaccagcacgtgatcaacaaggagagaagaggcgactacctgggcaagaccgtgcaggtggtgccccacatcaccgacgccgtgcaggagtgggtgatgaaccaggccaaggtgcccgtggacggcaacaaggaggagccccagatctgcgtgatcgagctgggcggcaccatcggcgacatcgagggcatgcccttcgtggaggccttcagacagttccagttcaaggccaagagagagaacttctgcaacatccacgtgagcctggtgccccagctgagcgccaccggcgagcagaagaccaagcccacccagaacagcgtgagagccctgagaggcctgggcctgagccccgacctgatcgtgtgcagaagcagcacccccatcgagatggccgtgaaggagaagatcagcatgttctgccacgtgaaccccgagcaggtgatctgcatccacgacgtgagcagcacctacagagtgcccgtgctgctggaggagcagagcatcgtgaagtacttcaaggagagactgcacctgcccatcggcgacagcgccagcaacctgctgttcaagtggagaaacatggccgacagatacgagagactgcagaagatctgcagcatcgccctggtgggcaagtacaccaagctgagagactgctacgccagcgtgttcaaggccctggagcacagcgccctggccatcaaccacaagctgaacctgatgtacatcgacagcatcgacctggagaagatcaccgagaccgaggaccccgtgaagttccacgaggcctggcagaagctgtgcaaggccgacggcatcctggtgcccggcggcttcggcatcagaggcaccctgggcaagctgcaggccatcagctgggccagaaccaagaagatccccttcctgggcgtgtgcctgggcatgcagctggccgtgatcgagttcgccagaaactgcctgaacctgaaggacgccgacagcaccgagttcagacccaacgcccccgtgcccctggtgatcgacatgcccgagcacaaccccggcaacctgggcggcaccatgagactgggcatcagaagaaccgtgttcaagaccgagaacagcatcctgagaaagctgtacggcgacgtgcccttcatcgaggagagacacagacacagattcgaggtgaaccccaacctgatcaagcagttcgagcagaacgacctgagcttcgtgggccaggacgtggacggcgacagaatggagatcatcgagctggccaaccacccctacttcgtgggcgtgcagttccaccccgagttcagcagcagacccatgaagcccagccccccctacctgggcctgctgctggccgccaccggcaacctgaacgcctacctgcagcagggctgcaagctgagcagcagcgacagatacagcgacgccagcgacgacagcttcagcgagcccagaatcgccgagctggagatcagctag

SEQ ID NO: 77850 - DNA, 531 bp, Artificial Sequence
  Description of Artificial Sequence: Synthetic coding sequence
atgtacatcgacagcatcgacctggagaagatcaccgagaccgaggaccccgtgaagttccacgaggcctggcagaagctgtgcaaggccgacggcatcctggtgcccggcggcttcggcatcagaggcaccctgggcaagctgcaggccatcagctgggccagaaccaagaagatccccttcctgggcgtgtgcctgggcatgcagctggccgtgatcgagttcgccagaaactgcctgaacctgaaggacgccgacagcaccgagttcagacccaacgcccccgtgcccctggtgatcgacatgcccgagcacaaccccggcaacctgggcggcaccatgagactgggcatcagaagaaccgtgttcaagaccgagaacagcatcctgatcagcctgagcctgggcctggccagcgtggagcacaccgagtgccccagcgccttcgacctgagagacagcctgttcatcggcctgttctgcgagctgcccatgctgctggagatgaacctggactgggacctggactag

SEQ ID NO: 77851 - DNA, 1761 bp, Artificial Sequence; identical to SEQ ID NO: 77849
  Description of Artificial Sequence: Synthetic coding sequence

SEQ ID NO: 77852 - DNA, 1761 bp, Artificial Sequence; identical to SEQ ID NO: 77849
  Description of Artificial Sequence: Synthetic coding sequence

SEQ ID NO: 77853 - DNA, 399 bp, Artificial Sequence
  Description of Artificial Sequence: Synthetic coding sequence
tgaggcaagctgcaggccatcagctgggccagaaccaagaagatccccttcctgggcgtgtgcctgggcatgcagctggccgtgatcgagttcgccagaaactgcctgaacctgaaggacgccgacagcaccgagttcagacccaacgcccccgtgcccctggtgatcgacatgcccgagcacaaccccggcaacctgggcggcaccatgagactgggcatcagaagaaccgtgttcaagaccgagaacagcatcctgatcagcctgagcctgggcctggccagcgtggagcacaccgagtgccccagcgccttcgacctgagagacagcctgttcatcggcctgttctgcgagctgcccatgctgctggagatgaacctggactgggacctggactag

SEQ ID NO: 77854 - DNA, 3654 bp, Artificial Sequence
  Description of Artificial Sequence: Synthetic coding sequence
atggccgccggcagagcccaggtgcccagcagcgagcaggcctggctggaggacgcccaggtgttcatccagaagaccctgtgccccgccgtgaaggagcccaacgtgcagctgacccccctggtgatcgactgcgtgaagaccgtgtggctgagccagggcagaaaccagggcagcaccctgcccctgagctacagcttcgtgagcgtgcaggacctgaagacccaccagagactgccctgctgcagccacctgagctggagcagcagcgcctaccaggcctgggcccaggaggccggccccaacggcaaccccctgcccagagagcagctgctgctgctgggcaccctgaccgacctgagcgccgacctggagcaggagtgcagaaacggcagcctgtacgtgagagacaacaccggcgtgctgagctgcgagctgatcgacctggacctgagctggctgggccacctgttcctgttccccagatggagctacctgccccccgccagatggaacagcagcggcgagggccacctggagctgtgggacgcccccgtgcccgtgttccccctgaccatcagccccggccccgtgacccccatccccgtgctgtaccccgagagcgccagctgcctgctgagactgagaaacaagctgagaggcgtgcagagaaacctggccggcagcctggtgagactgagcgccctggtgaagagcaagcagaaggcctacttcatcctgagcctgggcagaagccaccccgccgtgacccacgtgagcatcatcgtgcaggtgcccgcccagctggtgtggcacagagccctgagacccggcaccgcctacgtgctgaccgagctgagagtgagcaagatcagaggccagagacagcacgtgtggatgaccagccagagcagcagactgctgctgctgaagcccgagtgcgtgcaggagctggagctggagctggagggccccctgctggaggccgaccccaagcccctgcccatgcccagcaacagcgaggacaagaaggaccccgagagcctggtgagatacagcagactgctgagctacagcggcgccgtgaccggcgtgctgaacgagcccgccggcctgtacgagctggacggccagctgggcctgtgcctggcctaccagcagttcagaggcctgagaagagtgatgagacccggcgtgtgcctgcagctgcaggacgtgcacctgctgcagagcgtgggcggcggcaccagaagacccgtgctggccccctgcctgagaggcgccgtgctgctgcagagcttcagcagacagaagcccggcgcccacagcagcagacaggcctacggcgccagcctgtacgagcagctggtgtgggagagacagctgggcctgcccctgtacctgtgggccaccaaggccctggaggagctggcctgcaagctgtgcccccacgtgctgagacaccaccagttcctgcagcacagcagccccggcagccccagcctgggcctgcagctgctggcccccaccctggacctgctggccccccccggcagccccgtgagaaacgcccacaacgagatcctggaggagccccaccactgccccctgcagaagtacaccagactgcagacccccagcagcttccccaccctggccaccctgaaggaggagggccagagaaaggcctgggccagcttcgaccccaaggccctgctgcccctgcccgaggccagctacctgcccagctgccagctgaacagaagactggcctggagctggctgtgcctgctgcccagcgccttctgccccgcccaggtgctgctgggcgtgctggtggccagcagccacaagggctgcctgcagctgagagaccagagcggcagcctgccctgcctgctgctggccaagcacagccagcccctgagcgaccccagactgatcggctgcctggtgagagccgagagattccagctgatcgtggagagagacgtgagaagcagcttccccagctggaaggagctgagcatgcccggcttcatccagaagcagcaggccagagtgtacgtgcagttcttcctggccgacgccctgatcctgcccgtgcccagaccctgcctgcacagcgccacccccagcaccccccagaccgaccccaccggccccgagggcccccacctgggccagagcagactgttcctgctgtgccacaaggaggccctgatgaagagaaacttctgcgtgccccccggcgccagccccgaggtgcccaagcccgccctgagcttctacgtgctgggcagctggctgggcggcacccagagaaaggagggcaccggctggggcctgcccgagccccagggcaacgacgacaacgaccagaaggtgcacctgatcttcttcggcagcagcgtgagatggttcgagttcctgcaccccggccaggtgtacagactgatcgcccccggccccgccacccccatgctgttcgagaaggacggcagcagctgcatcagcagaagacccctggagctggccggctgcgccagctgcctgaccgtgcaggacaactggaccctggagctggagagcagccaggacatccaggacgtgctggacgccaacaagagcctgcccgagagcagcctgaccgacctgctgagcgacaacttcaccgacagcctggtgagcttcagcgccgagatcctgagcagaaccctgtgcgagcccctggtggccagcctgtggatgaagctgggcaacaccggcgccatgagaagatgcgtgaagctgaccgtggccctggagaccgccgagtgcgagttccccccccacctggacgtgtacatcgaggacccccacctgccccccagcctgggcctgctgcccggcgccagagtgcacttcagccagctggagaagagagtgagcagaagccacaacgtgtactgctgcttcagaagcagcacctacgtgcaggtgctgagcttcccccccgagaccaccatcagcatccccctgccccacatctacctggccgagctgctgcagggcggccagagccccttccaggccaccgccagctgccacatcgtgagcgtgttcagcctgcagctgttctgggtgtgcgcctactgcaccagcatctgcagacagggcaagtgcaccagactgggcagcacctgccccacccagaccgccatcagccaggccatcatcagactgctggtggaggacggcaccgccgaggccgtggtgacctgcagaaaccaccacgtggccgccgccctgggcctgtgccccagagagtgggccagcctgctggacttcgtgcaggtgcccggcagagtggtgctgcagttcgccggccccggcgcccagctggagagcagcgccagagtggacgagcccatgaccatgttcctgtggaccctgtgcaccagccccagcgtgctgagacccatcgtgctgagcttcgagctggagagaaagcccagcaagatcgtgcccctggagccccccagactgcagagattccagtgcggcgagctgcccttcctgacccacgtgaaccccagactgagactgagctgcctgagcatcagagagagcgagtacagcagcagcctgggcatcctggccagcagctgctag

SEQ ID NO: 77855 - DNA, 3096 bp, Artificial Sequence
  Description of Artificial Sequence: Synthetic coding sequence
atggccgccggcagagcccaggtgcccagcagcgagcaggcctggctggaggacgcccaggtgttcatccagaagaccctgtgccccgccgtgaaggagcccaacgtgcagctgacccccctggtgatcgactgcgtgaagaccgtgtggctgagccagggcagaaaccagggcagcaccctgcccctgagctacagcttcgtgagcgtgcaggacctgaagacccaccagagactgccctgctgcagccacctgagctggagcagcagcgcctaccaggcctgggcccaggaggccggccccaacggcaaccccctgcccagagagcagctgctgctgctgggcaccctgaccgacctgagcgccgacctggagcaggagtgcagaaacggcagcctgtacgtgagagacaacaccggcgtgctgagctgcgagctgatcgacctggacctgagctggctgggccacctgttcctgttccccagatggagctacctgccccccgccagatggaacagcagcggcgagggccacctggagctgtgggacgcccccgtgcccgtgttccccctgaccatcagccccggccccgtgacccccatccccgtgctgtaccccgagagcgccagctgcctgctgagactgagaagccaccccgccgtgacccacgtgagcatcatcgtgcaggtgcccgcccagctggtgtggcacagagccctgagacccggcaccgcctacgtgctgaccgagctgagagtgagcaagatcagaggccagagacagcacgtgtggatgaccagccagagcagcagactgctgctgctgaagcccgagtgcgtgcaggagctggagctggagctggagggccccctgctggaggccgaccccaagcccctgcccatgcccagcaacagcgaggacaagaaggaccccgagagcctggtgagatacagcagactgctgagctacagcggcgccgtgaccggcgtgctgaacgagcccgccggcctgtacgagctggacggccagctgggcctgtgcctggcctaccagcagttcagaggcctgagaagagtgatgagacccggcgtgtgcctgcagctgcaggacgtgcacctgctgcagagcgtgggcggcggcaccagaagacccgtgctggccccctgcctgagaggcgccgtgctgctgcagagcttcagcagacagaagcccggcgcccacagcagcagacaggcctacggcgccagcctgtacgagcagctggtgtgggagagacagctgggcctgcccctgtacctgtgggccaccaaggccctggaggagctggcctgcaagctgtgcccccacgtgctgagacaccaccagttcctgcagcacagcagccccggcagccccagcctgggcctgcagctgctggcccccaccctggacctgctggccccccccggcagccccgtgagaaacgcccacaacgagatcctggaggagccccaccactgccccctgcagaagtacaccagactgcagacccccagcagcttccccaccctggccaccctgaaggaggagggccagagaaaggcctgggccagcttcgaccccaaggccctgctgcccctgcccgaggccagctacctgcccagctgccagctgaacagaagactggcctggagctggctgtgcctgctgcccagcgccttctgccccgcccaggtgctgctgggcgtgctggtggccagcagccacaagggctgcctgcagctgagagaccagagcggcagcctgccctgcctgctgctggccaagcacagccagcccctgagcgaccccagactgatcggctgcctggtgagagccgagagattccagctgatcgtggagagagacgtgagaagcagcttccccagctggaaggagctgagcatgcccggcttcatccagaagcagcaggccagagtgtacgtgcagttcttcctggccgacgccctgatcctgcccgtgcccagaccctgcctgcacagcgccacccccagcaccccccagaccgaccccaccggccccgagggcccccacctgggccagagcagactgttcctgctgtgccacaaggaggccctgatgaagagaaacttctgcgtgccccccggcgccagccccgaggtgcccaagcccgccctgagcttctacgtgctgggcagctggctgggcggcacccagagaaaggagggcaccggctggggcctgcccgagccccagggcaacgacgacaacgaccagaaggtgcacctgatcttcttcggcagcagcgtgagatggttcgagttcctgcaccccggccaggtgtacagactgatcgcccccggccccgccacccccatgctgttcgagaaggacggcagcagctgcatcagcagaagacccctggagctggccggctgcgccagctgcctgaccgtgcaggacaactggaccctggagctggagagcagccaggacatccaggacgtgctggacgccaacaagagcctgcccgagagcagcctgaccgacctgctgagcgacaacttcaccgacagcctggtgagcttcagcgccgagatcctgagcagaaccctgtgcgagcccctggtggccagcctgtggatgaagctgggcaacaccggcgccatgagaagatgcgtgaagctgaccgtggccctggagaccgccgagtgcgagttccccccccacctggacgtgtacatcgaggacccccacctgccccccagcctgggcctgctgcccggcgccagagtgcacttcagccagctggagaagagagtgagcagaagccacaacgtgtactgctgcttcagaagcagcacctacgtgcaggtgctgagcttcccccccgagaccaccatcagcatccccctgccccacatctacctggccgagctgctgcagggcggccagagccccttccaggccaccgccagctgccacatcgtgagcgtgttcagcctgcagctgttctgggtgtgcgcctactgcaccagcatctgcagacaggcccccggcggcggctgggactgcagaagcagaggcgacctgtag

SEQ ID NO: 77856 - DNA, 843 bp, Artificial Sequence
  Description of Artificial Sequence: Synthetic coding sequence
atgcaggccaagtacagcagcaccagagacatgctggacgacgacggcgacaccaccatgagcctgcacagccagggcagcgccaccaccagacaccccgagcccagaagaaccgagcacagagcccccagcagcacctggagacccgtggccctgaccctgctgaccctgtgcctggtgctgctgatcggcctggccgccctgggcctgctgttcttccagtactaccagctgagcaacaccggccaggacaccatcagccagatggaggagagactgggcaacaccagccaggagctgcagagcctgcaggtgcagaacatcaagctggccggcagcctgcagcacgtggccgagaagctgtgcagagagctgtacaacaaggccggcgcccacagatgcagcccctgcaccgagcagtggaagtggcacggcgacaactgctaccagttctacaaggacagcaagagctgggaggactgcaagtacttctgcctgagcgagaacagcaccatgctgaagatcaacaagcaggaggacctggagttcgccgccagccagagctacagcgagttcttctacagctactggaccggcctgctgagacccgacagcggcaaggcctggctgtggatggacggcacccccttcaccagcgagctgttccacatcatcatcgacgtgaccagccccagaagcagagactgcgtggccatcctgaacggcatgatcttcagcaaggactgcaaggagctgaagagatgcgtgtgcgagagaagagccggcatggtgaagcccgagagcctgcacgtgccccccgagaccctgggcgagggcgactag

SEQ ID NO: 77857 - DNA, 213 bp, Artificial Sequence
  Description of Artificial Sequence: Synthetic coding sequence
atgcaggccaagtacagcagcaccagagacatgctggacgacgacggcgacaccaccatgagcctgcacagccagggcagcgccaccaccagacaccccgagcccagaagaaccgagcacagagcccccagcagcacctggagacccgtggccctgaccctgctgaccctgtgcctggtgctgctgatcggcctggccgccctgggcctgtag

SEQ ID NO: 77858 - DNA, 879 bp, Artificial Sequence
  Description of Artificial Sequence: Synthetic coding sequence
atgaccagaacctacgagaacttccagtacctggagaacaaggtgaaggtgcagggcttcaagaacggccccctgcccctgcagagcctgctgcagagactgtgcagcggcccctgccacctgctgctgagcctgggcctgggcctgctgctgctggtgatcatctgcgtggtgggcttccagaacagcaagttccagagagacctggtgaccctgagaaccgacttcagcaacttcaccagcaacaccgtggccgagatccaggccctgaccagccagggcagcagcctggaggagaccatcgccagcctgaaggccgaggtggagggcttcaagcaggagagacaggccgtgcacagcgagatgctgctgagagtgcagcagctggtgcaggacctgaagaagctgacctgccaggtggccaccctgaacaacaacggcgaggaggccagcaccgagggcacctgctgccccgtgaactgggtggagcaccaggacagctgctactggttcagccacagcggcatgagctgggccgaggccgagaagtactgccagctgaagaacgcccacctggtggtgatcaacagcagagaggagcagaacttcgtgcagaagtacctgggcagcgcctacacctggatgggcctgagcgaccccgagggcgcctggaagtgggtggacggcaccgactacgccaccggcttccagaactggaagcccggccagcccgacgactggcagggccacggcctgggcggcggcgaggactgcgcccacttccaccccgacggcagatggaacgacgacgtgtgccagagaccctaccactgggtgtgcgaggccggcctgggccagaccagccaggagagccactag

SEQ ID NO: 77859 - DNA, 951 bp, Artificial Sequence
  Description of Artificial Sequence: Synthetic coding sequence
atgaccagaacctacgagaacttccagtacctggagaacaaggtgaaggtgcagggcttcaagaacggccccctgcccctgcagagcctgctgcagagactgtgcagcggcccctgccacctgctgctgagcctgggcctgggcctgctgctgctggtgatcatctgcgtggtgggcttccagaacagcaagttccagagagacctggtgaccctgagaaccgacttcagcaacttcaccagcaacaccgtggccgagatccaggccctgaccagccagggcagcagcctggaggagaccatcgccagcctgaaggccgaggtggagggcttcaagcaggagagacaggccggcgtgagcgagctgcaggagcacaccacccagaaggcccacctgggccactgcccccactgccccagcgtgtgcgtgcccgtgcacagcgagatgctgctgagagtgcagcagctggtgcaggacctgaagaagctgacctgccaggtggccaccctgaacaacaacgccagcaccgagggcacctgctgccccgtgaactgggtggagcaccaggacagctgctactggttcagccacagcggcatgagctgggccgaggccgagaagtactgccagctgaagaacgcccacctggtggtgatcaacagcagagaggagcagaacttcgtgcagaagtacctgggcagcgcctacacctggatgggcctgagcgaccccgagggcgcctggaagtgggtggacggcaccgactacgccaccggcttccagaactggaagcccggccagcccgacgactggcagggccacggcctgggcggcggcgaggactgcgcccacttccaccccgacggcagatggaacgacgacgtgtgccagagaccctaccactgggtgtgcgaggccggcctgggccagaccagccaggagagccactag

SEQ ID NO: 77860 - DNA, 879 bp, Artificial Sequence; identical to SEQ ID NO: 77858
  Description of Artificial Sequence: Synthetic coding sequence

SEQ ID NO: 77861 - DNA, 798 bp, Artificial Sequence
  Description of Artificial Sequence: Synthetic coding sequence
atgagcgaggaggtgacctacgccgacctgcagttccagaacagcagcgagatggagaagatccccgagatcggcaagttcggcgagaaggccccccccgcccccagccacgtgtggagacccgccgccctgttcctgaccctgctgtgcctgctgctgctgatcggcctgggcgtgctggccagcatgttccacgtgaccctgaagatcgagatgaagaagatgaacaagctgcagaacatcagcgaggagctgcagagaaacatcagcctgcagctgatgagcaacatgaacatcagcaacaagatcagaaacctgagcaccaccctgcagaccatcgccaccaagctgtgcagagagctgtacagcaaggagcaggagcacaagtgcaagccctgccccagaagatggatctggcacaaggacagctgctacttcctgagcgacgacgtgcagacctggcaggagagcaagatggcctgcgccgcccagaacgccagcctgctgaagatcaacaacaagaacgccctggagttcatcaagagccagagcagaagctacgactactggctgggcctgagccccgaggaggacagcaccagaggcatgagagtggacaacatcatcaacagcagcgcctgggtgatcagaaacgcccccgacctgaacaacatgtactgcggctacatcaacagactgtacgtgcagtactaccactgcacctacaagaagagaatgatctgcgagaagatggccaaccccgtgcagctgggcagcacctacttcagagaggcctag

SEQ ID NO: 77862 - DNA, 699 bp, Artificial Sequence
  Description of Artificial Sequence: Synthetic coding sequence
atgagcgaggaggtgacctacgccgacctgcagttccagaacagcagcgagatggagaagatccccgagatcggcaagttcggcgagaaggtgcacgtgaccctgaagatcgagatgaagaagatgaacaagctgcagaacatcagcgaggagctgcagagaaacatcagcctgcagctgatgagcaacatgaacatcagcaacaagatcagaaacctgagcaccaccctgcagaccatcgccaccaagctgtgcagagagctgtacagcaaggagcaggagcacaagtgcaagccctgccccagaagatggatctggcacaaggacagctgctacttcctgagcgacgacgtgcagacctggcaggagagcaagatggcctgcgccgcccagaacgccagcctgctgaagatcaacaacaagaacgccctggagttcatcaagagccagagcagaagctacgactactggctgggcctgagccccgaggaggacagcaccagaggcatgagagtggacaacatcatcaacagcagcgcctgggtgatcagaaacgcccccgacctgaacaacatgtactgcggctacatcaacagactgtacgtgcagtactaccactgcacctacaagaagagaatgatctgcgagaagatggccaaccccgtgcagctgggcagcacctacttcagagaggcctag

SEQ ID NO: 77863 - DNA, 828 bp, Artificial Sequence
  Description of Artificial Sequence: Synthetic coding sequence
atgtggatcgacttcttcacctacagcagcatgagcgaggaggtgacctacgccgacctgcagttccagaacagcagcgagatggagaagatccccgagatcggcaagttcggcgagaaggccccccccgcccccagccacgtgtggagacccgccgccctgttcctgaccctgctgtgcctgctgctgctgatcggcctgggcgtgctggccagcatgttccacgtgaccctgaagatcgagatgaagaagatgaacaagctgcagaacatcagcgaggagctgcagagaaacatcagcctgcagctgatgagcaacatgaacatcagcaacaagatcagaaacctgagcaccaccctgcagaccatcgccaccaagctgtgcagagagctgtacagcaaggagcaggagcacaagtgcaagccctgccccagaagatggatctggcacaaggacagctgctacttcctgagcgacgacgtgcagacctggcaggagagcaagatggcctgcgccgcccagaacgccagcctgctgaagatcaacaacaagaacgccctggagttcatcaagagccagagcagaagctacgactactggctgggcctgagccccgaggaggacagcaccagaggcatgagagtggacaacatcatcaacagcagcgcctgggtgatcagaaacgcccccgacctgaacaacatgtactgcggctacatcaacagactgtacgtgcagtactaccactgcacctacaagaagagaatgatctgcgagaagatggccaaccccgtgcagctgggcagcacctacttcagagaggcctag

SEQ ID NO: 77864 - DNA, 264 bp, Artificial Sequence
  Description of Artificial Sequence: Synthetic coding sequence
cacaagtgcaagccctgccccagaagatggatctggcacaaggacagctgctacttcctgagcgacgacgtgcagacctggcaggagagcaagatggcctgcgccgcccagaacgccagcctgctgaagatcaacaacaagaacatcttcagcgtgatcaagaagaagaccgagaagttcttctggctgggcctgagctgggacagcagcggcagaagctggttctgggaggacggcagcgtgcccagccccagcctgtactag

SEQ ID NO: 77865 - DNA, 498 bp, Artificial Sequence
  Description of Artificial Sequence: Synthetic coding sequence
atgagcgaggaggtgacctacgccgacctgcagttccagaacagcagcgagatggagaagatccccgagatcggcaagttcggcgagaaggccccccccgcccccagccacgtgtggagacccgccgccctgttcctgaccctgctgtgcctgctgctgctgatcggcctgggcgtgctggccagcatgttccacgtgaccctgaagatcgagatgaagaagatgaacaagctgcagaacatcagcgaggagctgcagagaaacatcagcctgcagctgatgagcaacatgaacatcagcaacaagatcagaaacctgagcaccaccctgcagaccatcgccaccaagctgtgcagagagctgtacagcaaggagcaggagcacaagtgcaagccctgccccagaagatggatctggcacaaggacagctgctacttcctgagcgacgacgtgcagacctggcaggagagcaagatggcctgcgccgcccagaactag

SEQ ID NO: 77866 - DNA, 642 bp, Artificial Sequence
  Description of Artificial Sequence: Synthetic coding sequence
atgagcgaggaggtgacctacgccgacctgcagttccagaacagcagcgagatggagaagatccccgagatcggcaagttcggcgagaaggccccccccgcccccagccacgtgtggagacccgccgccctgttcctgaccctgctgtgcctgctgctgctgatcggcctgggcgtgctggccagcatgttccacgtgaccctgaagatcgagatgaagaagatgaacaagctgcagaacatcagcgaggagctgcagagaaacatcagcctgcagctgatgagcaacatgaacatcagcaacaagatcagaaacctgagcaccaccctgcagaccatcgccaccaagctgtgcagagagctgtacagcaaggagcaggagcacaagtgcaagccctgccccagaagatggatctggcacaaggacagctgctacttcctgagcgacgacgtgcagacctggcaggagagcaagatggcctgcgccgcccagaacgccagcctgctgaagatcaacaacaagaacgccctggagttcatcaagagccagagcagaagctacgactactggctgggcctgagccccgaggaggacagcaccagaggcatgagagtggacaacatcatcaacagcagcgcctag

SEQ ID NO: 77867 - DNA, 423 bp, Artificial Sequence
  Description of Artificial Sequence: Synthetic coding sequence
atggccgccaccggcttcagcgcccccaacggcagctgccacggcaccagcagaaccgtgaacagcgacgcccccatgagccccgagctgcccaagccccacctgcccgaccagctggtgatcgtgaacgagaccgaggccgacagcaagcccagcaagaacgtggccagaagcgccgccgtggagaccgccagcctgagccccagcctggtgcccgccagacagcccaccatcagcctgctgtgcgaggacaccgccgacaccctgagcgtggagagcctgaccctggtgccccccgtggacccccacagcctgagaagcctgaccggcatgccccccctgagcacccccgccgccgcctgcaccgagcccgtgggcgaggaggccgcctgcgccgagcccgtgggcaccgccgaggactag

SEQ ID NO: 77868 - DNA, 2721 bp, Artificial Sequence
  Description of Artificial Sequence: Synthetic coding sequence
atgttcggcagaagcagaagctgggtgggcggcggccacggcaagaccagcagaaacatccacagcctggaccacctgaagtacctgtaccacgtgctgaccaagaacaccaccgtgaccgagcagaacagaaacctgctggtggagaccatcagaagcatcaccgagatcctgatctggggcgaccagaacgacagcagcgtgttcgacttcttcctggagaagaacatgttcgtgttcttcctgaacatcctgagacagaagagcggcagatacgtgtgcgtgcagctgctgcagaccctgaacatcctgttcgagaacatcagccacgagaccagcctgtactacctgctgagcaacaactacgtgaacagcatcatcgtgcacaagttcgacttcagcgacgaggagatcatggcctactacatcagcttcctgaagaccctgagcctgaagctgaacaaccacaccgtgcacttcttctacaacgagcacaccaacgacttcgccctgtacaccgaggccatcaagttcttcaaccaccccgagagcatggtgagaatcgccgtgagaaccatcaccctgaacgtgtacaaggtggacaaccaggccatgctgcactacatcagagacaagaccgccgtgccctacttcagcaacctggtgtggttcatcggcagccacgtgatcgagctggacgactgcgtgcagaccgacgaggagcacagaaacagaggcaagctgagcgacctggtggccgagcacctggaccacctgcactacctgaacgacatcctgatcatcaactgcgagttcctgaacgacgtgctgaccgaccacctgctgaacagactgttcctgcccctgtacgtgtacagcctggagaaccaggacaagggcggcgagagacccaagatcagcctgcccgtgagcctgtacctgctgagccaggtgttcctgatcatccaccacgcccccctggtgaacagcctggccgaggtgatcctgaacggcgacctgagcgagatgtacgccaagaccgagcaggacatccagagaagcagcgccaagcccagcatcagatgcttcatcaagcccaccgagaccctggagagaagcctggagatgaacaagcacaagggcaagagaagagtgcagaagagacccaactacaagaacgtgggcgaggaggaggacgaggagaagggccccaccgaggacgcccaggaggacgccgagaaggccaaggagatcgagatggtgatcatggagagaagcaagctgagcgagctggccgccagcaccagcgtgcaggagcagaacaccaccgacgaggagaagagcgccgccgccacctgcagcgagagcacccagtggagcagacccttcctggacatggtgtaccacgccctggacagccccgacgacgactaccacgccctgttcgtgctgtgcctgctgtacgccatgagccacaacaagggcatggaccccgagaagctggagagaatccagctgcccgtgcccaacgccgccgagaagaccacctacaaccaccccctggccgagagactgatcagaatcatgaacaacgccgcccagcccgacggcaagatcagactggccaccctggagctgagctgcctgctgctgaagcagcaggtgctgatgagcgccggctgcatcatgaaggacgtgcacctggcctgcctggagggcgccagagaggagagcgtgcacctggtgagacacttctacaagggcgaggacatcttcctggacatgttcgaggacgagtacagaagcatgaccatgaagcccatgaacgtggagtacctgatgatggacgccagcatcctgctgccccccaccggcacccccctgaccggcatcgacttcgtgaagagactgccctgcggcgacgtggagaagaccagaagagccatcagagtgttcttcatgctgagaagcctgagcctgcagctgagaggcgagcccgagacccagctgcccctgaccagagaggaggacctgatcaagaccgacgacgtgctggacctgaacaacagcgacctgatcgcctgcaccgtgatcaccaaggacggcggcatggtgcagagattcctggccgtggacatctaccagatgagcctggtggagcccgacgtgagcagactgggctggggcgtggtgaagttcgccggcctgctgcaggacatgcaggtgaccggcgtggaggacgacagcagagccctgaacatcaccatccacaagcccgccagcagcccccacagcaagcccttccccatcctgcaggccaccttcatcttcagcgaccacatcagatgcatcatcgccaagcagagactggccaagggcagaatccaggccagaagaatgaagatgcagagaatcgccgccctgctggacctgcccatccagcccaccaccgaggtgctgggcttcggcctgggcagcagcaccagcacccagcacctgcccttcagattctacgaccagggcagaagaggcagcagcgaccccaccgtgcagagaagcgtgttcgccagcgtggacaaggtgcccggcgagcccgcccccagacccgccccccagctggtgcaccacggcggcagaagcagaagcttcagcctgtggagcctgtgcgagctgcccttcctgagccagaagcccagaagactggccgcccccgccagctag

SEQ ID NO: 77869 - DNA, 3162 bp, Artificial Sequence
  Description of Artificial Sequence: Synthetic coding sequence
atgttcggcagaagcagaagctgggtgggcggcggccacggcaagaccagcagaaacatccacagcctggaccacctgaagtacctgtaccacgtgctgaccaagaacaccaccgtgaccgagcagaacagaaacctgctggtggagaccatcagaagcatcaccgagatcctgatctggggcgaccagaacgacagcagcgtgttcgacttcttcctggagaagaacatgttcgtgttcttcctgaacatcctgagacagaagagcggcagatacgtgtgcgtgcagctgctgcagaccctgaacatcctgttcgagaacatcagccacgagaccagcctgtactacctgctgagcaacaactacgtgaacagcatcatcgtgcacaagttcgacttcagcgacgaggagatcatggcctactacatcagcttcctgaagaccctgagcctgaagctgaacaaccacaccgtgcacttcttctacaacgagcacaccaacgacttcgccctgtacaccgaggccatcaagttcttcaaccaccccgagagcatggtgagaatcgccgtgagaaccatcaccctgaacgtgtacaaggtgagcctggacaaccaggccatgctgcactacatcagagacaagaccgccgtgccctacttcagcaacctggtgtggttcatcggcagccacgtgatcgagctggacgactgcgtgcagaccgacgaggagcacagaaacagaggcaagctgagcgacctggtggccgagcacctggaccacctgcactacctgaacgacatcctgatcatcaactgcgagttcctgaacgacgtgctgaccgaccacctgctgaacagactgttcctgcccctgtacgtgtacagcctggagaaccaggacaagggcggcgagagacccaagatcagcctgcccgtgagcctgtacctgctgagccaggtgttcctgatcatccaccacgcccccctggtgaacagcctggccgaggtgatcctgaacggcgacctgagcgagatgtacgccaagaccgagcaggacatccagagaagcagcgccaagcccagcatcagatgcttcatcaagcccaccgagaccctggagagaagcctggagatgaacaagcacaagggcaagagaagagtgcagaagagacccaactacaagaacgtgggcgaggaggaggacgaggagaagggccccaccgaggacgcccaggaggacgccgagaaggccaagggcaccgagggcggcagcaagggcatcaagaccagcggcgagagcgaggagatcgagatggtgatcatggagagaagcaagctgagcgagctggccgccagcaccagcgtgcaggagcagaacaccaccgacgaggagaagagcgccgccgccacctgcagcgagagcacccagtggagcagacccttcctggacatggtgtaccacgccctggacagccccgacgacgactaccacgccctgttcgtgctgtgcctgctgtacgccatgagccacaacaagggcatggaccccgagaagctggagagaatccagctgcccgtgcccaacgccgccgagaagaccacctacaaccaccccctggccgagagactgatcagaatcatgaacaacgccgcccagcccgacggcaagatcagactggccaccctggagctgagctgcctgctgctgaagcagcaggtgctgatgagcgccggctgcatcatgaaggacgtgcacctggcctgcctggagggcgccagagaggagagcgtgcacctggtgagacacttctacaagggcgaggacatcttcctggacatgttcgaggacgagtacagaagcatgaccatgaagcccatgaacgtggagtacctgatgatggacgccagcatcctgctgccccccaccggcacccccctgaccggcatcgacttcgtgaagagactgccctgcggcgacgtggagaagaccagaagagccatcagagtgttcttcatgctgagaagcctgagcctgcagctgagaggcgagcccgagacccagctgcccctgaccagagaggaggacctgatcaagaccgacgacgtgctggacctgaacaacagcgacctgatcgcctgcaccgtgatcaccaaggacggcggcatggtgcagagattcctggccgtggacatctaccagatgagcctggtggagcccgacgtgagcagactgggctggggcgtggtgaagttcgccggcctgctgcaggacatgcaggtgaccggcgtggaggacgacagcagagccctgaacatcaccatccacaagcccgccagcagcccccacagcaagcccttccccatcctgcaggccaccttcatcttcagcgaccacatcagatgcatcatcgccaagcagagactggccaagggcagaatccaggccagaagaatgaagatgcagagaatcgccgccctgctggacctgcccatccagcccaccaccgaggtgctgggcttcggcctgggcagcagcaccagcacccagcacctgcccttcagattctacgaccagggcagaagaggcagcagcgaccccaccgtgcagagaagcgtgttcgccagcgtggacaaggtgcccggcttcgccgtggcccagtgcatcaaccagcacagcagccccagcctgagcagccagagcccccccagcgccagcggcagccccagcggcagcggcagcaccagccactgcgacagcggcggcaccagcagcagcagcacccccagcaccgcccagagccccgccgacgcccccatgagccccgagctgcccaagccccacctgcccgaccagctggtgatcgtgaacgagaccgaggccgacagcaagcccagcaagaacgtggccagaagcgccgccgtggagaccgccagcctgagccccagcctggtgcccgccagacagcccaccatcagcctgctgtgcgaggacaccgccgacaccctgagcgtggagagcctgaccctggtgccccccgtggacccccacagcctgagaagcctgaccggcatgccccccctgagcacccccgccgccgcctgcaccgagcccgtgggcgaggaggccgcctgcgccgagcccgtgggcaccgccgaggactag

SEQ ID NO: 77870 - DNA, 3162 bp, Artificial Sequence
  Description of Artificial Sequence: Synthetic coding sequence
atgttcggcagaagcagaagctgggtgggcggcggccacggcaagaccagcagaaacatccacagcctggaccacctgaagtacctgtaccacgtgctgaccaagaacaccaccgtgaccgagcagaacagaaacctgctggtggagaccatcagaagcatcaccgagatcctgatctggggcgaccagaacgacagcagcgtgttcgacttcttcctggagaagaacatgttcgtgttcttcctgaacatcctgagacagaagagcggcagatacgtgtgcgtgcagctgctgcagaccctgaacatcctgttcgagaacatcagccacgagaccagcctgtactacctgctgagcaacaactacgtgaacagcatcatcgtgcacaagttcgacttcagcgacgaggagatcatggcctactacatcagcttcctgaagaccctgagcctgaagctgaacaaccacaccgtgcacttcttctacaacgagcacaccaacgacttcgccctgtacaccgaggccatcaagttcttcaaccaccccgagagcatggtgagaatcgccgtgagaaccatcaccctgaacgtgtacaaggtgagcgtggacaaccaggccatgctgcactacatcagagacaagaccgccgtgccctacttcagcaacctggtgtggttcatcggcagccacgtgatcgagctggacgactgcgtgcagaccgacgaggagcacagaaacagaggcaagctgagcgacctggtggccgagcacctggaccacctgcactacctgaacgacatcctgatcatcaactgcgagttcctgaacgacgtgctgaccgaccacctgctgaacagactgttcctgcccctgtacgtgtacagcctggagaaccaggacaagggcggcgagagacccaagatcagcctgcccgtgagcctgtacctgctgagccaggtgttcctgatcatccaccacgcccccctggtgaacagcctggccgaggtgatcctgaacggcgacctgagcgagatgtacgccaagaccgagcaggacatccagagaagcagcgccaagcccagcatcagatgcttcatcaagcccaccgagaccctggagagaagcctggagatgaacaagcacaagggcaagagaagagtgcagaagagacccaactacaagaacgtgggcgaggaggaggacgaggagaagggccccaccgaggacgcccaggaggacgccgagaaggccaagggcaccgagggcggcagcaagggcatcaagaccagcggcgagagcgaggagatcgagatggtgatcatggagagaagcaagctgagcgagctggccgccagcaccagcgtgcaggagcagaacaccaccgacgaggagaagagcgccgccgccacctgcagcgagagcacccagtggagcagacccttcctggacatggtgtaccacgccctggacagccccgacgacgactaccacgccctgttcgtgctgtgcctgctgtacgccatgagccacaacaagggcatggaccccgagaagctggagagaatccagctgcccgtgcccaacgccgccgagaagaccacctacaaccaccccctggccgagagactgatcagaatcatgaacaacgccgcccagcccgacggcaagatcagactggccaccctggagctgagctgcctgctgctgaagcagcaggtgctgatgagcgccggctgcatcatgaaggacgtgcacctggcctgcctggagggcgccagagaggagagcgtgcacctggtgagacacttctacaagggcgaggacatcttcctggacatgttcgaggacgagtacagaagcatgaccatgaagcccatgaacgtggagtacctgatgatggacgccagcatcctgctgccccccaccggcacccccctgaccggcatcgacttcgtgaagagactgccctgcggcgacgtggagaagaccagaagagccatcagagtgttcttcatgctgagaagcctgagcctgcagctgagaggcgagcccgagacccagctgcccctgaccagagaggaggacctgatcaagaccgacgacgtgctggacctgaacaacagcgacctgatcgcctgcaccgtgatcaccaaggacggcggcatggtgcagagattcctggccgtggacatctaccagatgagcctggtggagcccgacgtgagcagactgggctggggcgtggtgaagttcgccggcctgctgcaggacatgcaggtgaccggcgtggaggacgacagcagagccctgaacatcaccatccacaagcccgccagcagcccccacagcaagcccttccccatcctgcaggccaccttcatcttcagcgaccacatcagatgcatcatcgccaagcagagactggccaagggcagaatccaggccagaagaatgaagatgcagagaatcgccgccctgctggacctgcccatccagcccaccaccgaggtgctgggcttcggcctgggcagcagcaccagcacccagcacctgcccttcagattctacgaccagggcagaagaggcagcagcgaccccaccgtgcagagaagcgtgttcgccagcgtggacaaggtgcccggcttcgccgtggcccagtgcatcaaccagcacagcagccccagcctgagcagccagagcccccccagcgccagcggcagccccagcggcagcggcagcaccagccactgcgacagcggcggcaccagcagcagcagcacccccagcaccgcccagagccccgccgacgcccccatgagccccgagctgcccaagccccacctgcccgaccagctggtgatcgtgaacgagaccgaggccgacagcaagcccagcaagaacgtggccagaagcgccgccgtggagaccgccagcctgagccccagcctggtgcccgccagacagcccaccatcagcctgctgtgcgaggacaccgccgacaccctgagcgtggagagcctgaccctggtgccccccgtggacccccacagcctgagaagcctgaccggcatgccccccctgagcacccccgccgccgcctgcaccgagcccgtgggcgaggaggccgcctgcgccgagcccgtgggcaccgccgaggactag

SEQ ID NO: 77871 - DNA, 288 bp, Artificial Sequence
  Description of Artificial Sequence: Synthetic coding sequence
atgcacgacagcaacaacgtggagaaggacatcacccccagcgagctgcccgccaaccccgccatcagagccaactgccaccaggagcccagcgtgtgcctgcaggccgcctgccccgagagctggatcggcttccagagaaagtgcttctacttcagcgacgacaccaagaactggaccagcagccagagattctgcgacagccaggacgccgacctggcccaggtggagagcttccaggagctggtgagctaccccggcagcagaagagtgtgcctgttcgagtag

SEQ ID NO: 77872 - DNA, 525 bp, Artificial Sequence
  Description of Artificial Sequence: Synthetic coding sequence
atgatcaaccccgagctgagagacggcagagccgacggcttcatccacagaatcgtgcccaagctgatccagaactggaagatcggcctgatgtgcttcctgagcatcatcatcaccaccgtgtgcatcatcatgatcgccacctggagcaagcacgccaagcccgtggcctgcagcggcgactggctgggcgtgagagacaagtgcttctacttcagcgacgacaccagaaactggaccgccagcaagatcttctgcagcctgcagaaggccgagctggcccagatcgacacccaggaggacatggagttcctgaagagatacgccggcaccgacatgcactggatcggcctgagcagaaagcagggcgacagctggaagtggaccaacggcaccaccttcaacggctggttcgagatcatcggcaacggcagcttcgccttcctgagcgccgacggcgtgcacagcagcagaggcttcatcgacatcaagtggatctgcagcaagcccaagtacttcctgtag

SEQ ID NO: 77873 - DNA, 2406 bp, Artificial Sequence
  Description of Artificial Sequence: Synthetic coding sequence
atgcaccacagaatgaacgagatgaacctgagccccgtgggcatggagcagctgaccagcagcagcgtgagcaacgccctgcccgtgagcggcagccacctgggcctggccgccagccccacccacagcgccatccccgcccccggcctgcccgtggccatccccaacctgggccccagcctgagcagcctgcccagcgccctgagcctgatgctgcccatgggcatcggcgacagaggcgtgatgtgcggcctgcccgagagaaactacaccctgcccccccccccctacccccacctggagagcagctacttcagaaccatcctgcccggcatcctgagctacctggccgacagaccccccccccagtacatccaccccaacagcatcaacgtggacggcaacaccgccctgagcatcaccaacaaccccagcgccctggacccctaccagagcaacggcaacgtgggcctggagcccggcatcgtgagcatcgacagcagaagcgtgaacacccacggcgcccagagcctgcaccccagcgacggccacgaggtggccctggacaccgccatcaccatggagaacgtgagcagagtgaccagccccatcagcaccgacggcatggccgaggagctgaccatggacggcgtggccggcgagcacagccagatccccaacggcagcagaagccacgagcccctgagcgtggacagcgtgagcaacaacctggccgccgacgccgtgggccacggcggcgtgatccccatgcacggcaacggcctggagctgcccgtggtgatggagaccgaccacatcgccagcagagtgaacggcatgagcgacagcgccctgagcgacagcatccacaccgtggccatgagcaccaacagcgtgagcgtggccctgagcaccagccacaacctggccagcctggagagcgtgagcctgcacgaggtgggcctgagcctggagcccgtggccgtgagcagcatcacccaggaggtggccatgggcaccggccacgtggacgtgagcagcgacagcctgagcttcgtgagccccagcctgcagatggaggacagcaacagcaacaaggagaacatggccaccctgttcaccatctggtgcaccctgtgcgacagagcctaccccagcgactgccccgagcacggccccgtgaccttcgtgcccgacacccccatcgagagcagagccagactgagcctgcccaagcagctggtgctgagacagagcatcgtgggcgccgaggtgggcgtgtggaccggcgagaccatccccgtgagaacctgcttcggccccctgatcggccagcagagccacagcatggaggtggccgagtggaccgacaaggccgtgaaccacatctggaagatctaccacaacggcgtgctggagttctgcatcatcaccaccgacgagaacgagtgcaactggatgatgttcgtgagaaaggccagaaacagagaggagcagaacctggtggcctacccccacgacggcaagatcttcttctgcaccagccaggacatcccccccgagaacgagctgctgttctactacagcagagactacgcccagcagatcggcgtgcccgagcaccccgacgtgcacctgtgcaactgcggcaaggagtgcaacagctacaccgagttcaaggcccacctgaccagccacatccacaaccacctgcccacccagggccacagcggcagccacggccccagccacagcaaggagagaaagtggaagtgcagcatgtgcccccaggccttcatcagccccagcaagctgcacgtgcacttcatgggccacatgggcatgaagccccacaagtgcgacttctgcagcaaggccttcagcgaccccagcaacctgagaacccacctgaagatccacaccggccagaagaactacagatgcaccctgtgcgacaagagcttcacccagaaggcccacctggagagccacatggtgatccacaccggcgagaagaacctgaagtgcgactactgcgacaagctgttcatgagaagacaggacctgaagcagcacgtgctgatccacacccaggagagacagatcaagtgccccaagtgcgacaagctgttcctgagaaccaaccacctgaagaagcacctgaacagccacgagggcaagagagactacgtgtgcgagaagtgcaccaaggcctacctgaccaagtaccacctgaccagacacctgaagacctgcaagggccccaccagcagcagcagcgcccccgaggaggaggaggaggacgacagcgaggaggaggacctggccgacagcgtgggcaccgaggactgcagaatcaacagcgccgtgtacagcgccgacgagagcctgagcgcccacaagtag

SEQ ID NO: 77874 - DNA, 465 bp, Artificial Sequence
  Description of Artificial Sequence: Synthetic coding sequence
atgcacgacagcaacaacgtggagaaggacatcacccccagcgagctgcccgccaaccccgccatcagagccaactgccaccaggagcccagcgtgtgcctgcaggccgcctgccccgagagctggatcggcttccagagaaagtgcttctacttcagcgacgacaccaagaactggaccagcagccagagattctgcgacagccaggacgccgacctggcccaggtggagagcttccaggagctgaacttcctgctgagatacaagggccccagcgaccactggatcggcctgagcagagagcagggccagccctggaagtggatcaacggcaccgagtggaccagacagttccccatcctgggcgccggcgagtgcgcctacctgaacgacaagggcgccagcagcgccagacactacaccgagagaaagtggatctgcagcaagagcgacatccacgtgtag

SEQ ID NO: 77875 - DNA, 585 bp, Artificial Sequence
  Description of Artificial Sequence: Synthetic coding sequence
atgcacgacagcaacaacgtggagaaggacatcacccccagcgagctgcccgccaaccccggctgcctgcacagcaaggagcacagcatcaaggccaccctgatctggagactgttcttcctgatcatgttcctgaccatcatcgtgtgcggcatggtggccgccctgagcgccatcagagccaactgccaccaggagcccagcgtgtgcctgcaggccgcctgccccgagagctggatcggcttccagagaaagtgcttctacttcagcgacgacaccaagaactggaccagcagccagagattctgcgacagccaggacgccgacctggcccaggtggagagcttccaggagctgaacttcctgctgagatacaagggccccagcgaccactggatcggcctgagcagagagcagggccagccctggaagtggatcaacggcaccgagtggaccagacagctggtgatgaaggaggacggcgccaacctgtacgtggccaaggtgagccaggtgcccagaatgaaccccagacccgtgatggtgagctaccccggcagcagaagagtgtgcctgttcgagtag

SEQ ID NO: 77876 - DNA, 576 bp, Artificial Sequence
  Description of Artificial Sequence: Synthetic coding sequence
atgcacgacagcaacaacgtggagaaggacatcacccccagcgagctgcccgccaaccccggctgcctgcacagcaaggagcacagcatcaaggccaccctgatctggagactgttcttcctgatcatgttcctgaccatcatcgtgtgcggcatggtggccgccctgagcgccatcagagccaactgccaccaggagcccagcgtgtgcctgcaggccgcctgccccgagagctggatcggcttccagagaaagtgcttctacttcagcgacgacaccaagaactggaccagcagccagagattctgcgacagccaggacgccgacctggcccaggtggagagcttccaggagctgaacttcctgctgagatacaagggccccagcgaccactggatcggcctgagcagagagcagggccagccctggaagtggatcaacggcaccgagtggaccagacagttccccatcctgggcgccggcgagtgcgcctacctgaacgacaagggcgccagcagcgccagacactacaccgagagaaagtggatctgcagcaagagcgacatccacgtgtag

SEQ ID NO: 77877 - DNA, 399 bp, Artificial Sequence
  Description of Artificial Sequence: Synthetic coding sequence
atgcacgacagcaacaacgtggagaaggacatcacccccagcgagctgcccgccaaccccggctgcctgcacagcaaggagcacagcatcaaggccaccctgatctggagactgttcttcctgatcatgttcctgaccatcatcgtgtgcggcatggtggccgccctgagcgccatcagagccaactgccaccaggagcccagcgtgtgcctgcaggccgcctgccccgagagctggatcggcttccagagaaagtgcttctacttcagcgacgacaccaagaactggaccagcagccagagattctgcgacagccaggacgccgacctggcccaggtggagagcttccaggagctggtgagctaccccggcagcagaagagtgtgcctgttcgagtag

SEQ ID NO: 77878 - DNA, 891 bp, Artificial Sequence
  Description of Artificial Sequence: Synthetic coding sequence
atgagcgacagcaaggagcccagagtgcagcagctgggcctgctgggctgcctgggccacggcgccctggtgctgcagctgctgagcttcatgctgctggccggcgtgctggtggccatcctggtgcaggtgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtgggcgagctgcccgaccagagcaagcagcagcagatctaccaggagctgaccgacctgaagaccgccttcgagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagctgcccgccgtgctggagcagtggagaacccagcagtag

SEQ ID NO: 77879 - DNA, 2379 bp, Artificial Sequence
  Description of Artificial Sequence: Synthetic coding sequence
atggccgcccccagcctgctgaactggagaagagtgagcagcttcaccggccccgtgcccagagccagacacggccacagagccgtggccatcagagagctgatgatcatcttcggcggcggcaacgagggcatcgccgacgagctgcacgtgtacaacaccgccaccaaccagtggttcctgcccgccgtgagaggcgacatcccccccggctgcgccgcccacggcttcgtgtgcgacggcaccagaatcctggtgttcggcggcatggtggagtacggcagatacagcaacgagctgtacgagctgcaggccagcagatggctgtggaagaaggtgaagccccaccccccccccagcggcctgcccccctgccccagactgggccacagcttcagcctgtacggcaacaagtgctacctgttcggcggcctggccaacgagagcgaggacagcaacaacaacgtgcccagatacctgaacgacttctacgagctggagctgcagcacggcagcggcgtggtgggctggagcatccccgtgaccaagggcgtggtgcccagccccagagagagccacaccgccgtgatctactgcaagaaggacagcggcagccccaagatgtacgtgttcggcggcatgtgcggcgccagactggacgacctgtggcagctggacctggagaccatgagctggagcaagcccgagaccaagggcaccgtgcccctgcccagaagcctgcacaccgccagcgtgatcggcaacaagatgtacatcttcggcggctgggtgccccacaagggcgagaacaccgagaccagcccccacgactgcgagtggagatgcaccagcagcttcagctacctgaacctggacaccaccgagtggaccaccctggtgagcgacagccaggaggacaagaagaacagcagacccagacccagagccggccactgcgccgtggccatcggcaccagactgtacttctggagcggcagagacggctacaagaaggccctgaacagccaggtgtgctgcaaggacctgtggtacctggacaccgagaagccccccgcccccagccaggtgcagctgatcaaggccaccaccaacagcttccacgtgaagtgggacgaggtgagcaccgtggagggctacctgctgcagctgagcaccgacctgccctaccaggccgccagcagcgacagcagcgccgcccccaacatgcagggcgtgagaatggacccccacagacagggcagcaacaacatcgtgcccaacagcatcaacgacaccatcaacagcaccaagaccgagcagcccgccaccaaggagaccagcatgaagaacaagcccgacttcaaggccctgaccgacagcaacgccatcctgtaccccagcctggccagcaacgccagcaaccacaacagccacgtggtggacatgctgagaaagaacgagggcccccacaccagcgccaacgtgggcgtgctgagcagctgcctggacgtgagaaccgtgatccccgagaccagcgtgagcagcaccgtgagcagcacccagaccatggtgacccagcagaccatcaagaccgagagcagcagcaccaacggcgccgtggtgaaggacgagaccagcctgaccaccttcagcaccaagagcgaggtggacgagacctacgccctgcccgccaccaagatcagcagagtggagacccacgccaccgccacccccttcagcaaggagacccccagcaaccccgtggccaccgtgaaggccggcgagagacagtggtgcgacgtgggcatcttcaagaacaacaccgccctggtgagccagttctacctgctgcccaagggcaagcagagcatcagcaaggtgggcaacgccgacgtgcccgactacagcctgctgaagaagcaggacctggtgcccggcaccggctacagattcagagtggccgccatcaacggctgcggcatcggccccttcagcaagatcagcgagttcaagacctgcatccccggcttccccggcgcccccagcgccgtgagaatcagcaagaacgtggagggcatccacctgagctgggagccccccaccagccccagcggcaacatcctggagtacagcgcctacctggccatcagaaccgcccagatccaggacaaccccagccagctggtgttcatgagaatctactgcggcctgaagaccagctgcatcgtgaccgccggccagctggccaacgcccacatcgactacaccagcagacccgccatcgtgttcagaatcagcgccaagaacgagaagggctacggccccgccacccaggtgagatggctgcagggcaacaacaagaaggcccccctgaactag

SEQ ID NO: 77880 - DNA, 498 bp, Artificial Sequence
  Description of Artificial Sequence: Synthetic coding sequence
atgaccagcgagatcacctacgccgaggtgagattcaagaacgagttcaagagcagcggcatcaacaccgccagcagcgccgagaccgcctggagctgctgccccaagaactggaagagcttcagcagcaactgctacttcatcagcaccgagagcgccagctggcaggacagcgagaaggactgcgccagaatggaggcccacctgctggtgatcaacacccaggaggagcaggacttcatcttccagaacctgcaggaggagagcgcctacttcgtgggcctgagcgaccccgagggccagagacactggcagtgggtggaccagaccccctacaacgagagcagcaccttctggcaccccagagagcccagcgaccccaacgagagatgcgtggtgctgaacttcagaaagagccccaagagatggggctggaacgacgtgaactgcctgggcccccagagaagcgtgtgcgagatgatgaagatccacctgtag

SEQ ID NO: 77881 - DNA, 615 bp, Artificial Sequence
  Description of Artificial Sequence: Synthetic coding sequence
atgaccagcgagatcacctacgccgaggtgagattcaagaacgagttcaagagcagcggcatcaacaccgccagcagcgccgccagcaaggagagaaccgccccccacaagagcaacaccggcttccccaagctgctgtgcgccagcctgctgatcttcttcctgctgctggccatcagcttcttcatcgccttcgtgaagaccgcctggagctgctgccccaagaactggaagagcttcagcagcaactgctacttcatcagcaccgagagcgccagctggcaggacagcgagaaggactgcgccagaatggaggcccacctgctggtgatcaacacccaggaggagcaggacttcatcttccagaacctgcaggaggagagcgcctacttcgtgggcctgagcgaccccgagggccagagacactggcagtgggtggaccagaccccctacaacgagagcagcaccttctggcaccccagagagcccagcgaccccaacgagagatgcgtggtgctgaacttcagaaagagccccaagagatggggctggaacgacgtgaactgcctgggcccccagagaagcgtgtgcgagatgatgaagatccacctgtag

SEQ ID NO: 77882 - DNA, 597 bp, Artificial Sequence
  Description of Artificial Sequence: Synthetic coding sequence
atgaccagcgagatcacctacgccgaggtgagattcaagaacgagttcaagagcagcggcatcaacaccgccagcagcgccgtgttcttccagaagtacagccagctgctggagaagaagaccaccaaggagctggtgcacaccaccctggagtgcgtgaagaagaacatgcccgtggaggagaccgcctggagctgctgccccaagaactggaagagcttcagcagcaactgctacttcatcagcaccgagagcgccagctggcaggacagcgagaaggactgcgccagaatggaggcccacctgctggtgatcaacacccaggaggagcaggacttcatcttccagaacctgcaggaggagagcgcctacttcgtgggcctgagcgaccccgagggccagagacactggcagtgggtggaccagaccccctacaacgagagcagcaccttctggcaccccagagagcccagcgaccccaacgagagatgcgtggtgctgaacttcagaaagagccccaagagatggggctggaacgacgtgaactgcctgggcccccagagaagcgtgtgcgagatgatgaagatccacctgtag

SEQ ID NO: 77883 - DNA, 549 bp, Artificial Sequence
  Description of Artificial Sequence: Synthetic coding sequence
atggtgcccgaggaggagccccaggacagagtgccccacaacttcatgtacagcaagaccgtgaagagactgagcaagctgagagagtaccagcagtaccaccccagcctgacctgcgtgatggagggcaaggacatcgaggactggagctgctgccccaccccctggaccagcttccagagcagctgctacttcatcagcaccggcatgcagagctggaccaagagccagaagaactgcagcgtgatgggcgccgacctggtggtgatcaacaccagagaggagcaggacttcatcatccagaacctgaagagaaacagcagctacttcctgggcctgagcgaccccggcggcagaagacactggcagtgggtggaccagaccccctacaacgagaacgtgaccttctggcacagcggcgagcccaacaacctggacgagagatgcgccatcatcaacttcagaagcagcgaggagtggggctggaacgacatccactgccacgtgccccagaagagcatctgcaagatgaagaagatctacatctag

SEQ ID NO: 77884 - DNA, 642 bp, Artificial Sequence
  Description of Artificial Sequence: Synthetic coding sequence
atggtgcccgaggaggagccccaggacagagagaagggcctgtggtggttccagctgaaggtgtggagcatggccgtggtgagcatcctgctgctgagcgtgtgcttcaccgtgagcagcgtggtgccccacaacttcatgtacagcaagaccgtgaagagactgagcaagctgagagagtaccagcagtaccaccccagcctgacctgcgtgatggagggcaaggacatcgaggactggagctgctgccccaccccctggaccagcttccagagcagctgctacttcatcagcaccggcatgcagagctggaccaagagccagaagaactgcagcgtgatgggcgccgacctggtggtgatcaacaccagagaggagcaggacttcatcatccagaacctgaagagaaacagcagctacttcctgggcctgagcgaccccggcggcagaagacactggcagtgggtggaccagaccccctacaacgagaacgtgaccttctggcacagcggcgagcccaacaacctggacgagagatgcgccatcatcaacttcagaagcagcgaggagtggggctggaacgacatccactgccacgtgccccagaagagcatctgcaagatgaagaagatctacatctag

SEQ ID NO: 77885 - DNA, 549 bp, Artificial Sequence; identical to SEQ ID NO: 77883
  Description of Artificial Sequence: Synthetic coding sequence

SEQ ID NO: 77886 - DNA, 642 bp, Artificial Sequence; identical to SEQ ID NO: 77884
  Description of Artificial Sequence: Synthetic coding sequence

SEQ ID NO: 77887 - DNA, 648 bp, Artificial Sequence
  Description of Artificial Sequence: Synthetic coding sequence
atgggcctggagaagccccagagcaagctggagggcggcatgcacccccagctgatccccagcgtgatcgccgtggtgttcatcctgctgctgagcgtgtgcttcatcgccagctgcctggtgacccaccacaacttcagcagatgcaagagaggcaccggcgtgcacaagctggagcaccacgccaagctgaagtgcatcaaggagaagagcgagctgaagagcgccgagggcagcacctggaactgctgccccatcgactggagagccttccagagcaactgctacttccccctgaccgacaacaagacctgggccgagagcgagagaaactgcagcggcatgggcgcccacctgatgaccatcagcaccgaggccgagcagaacttcatcatccagttcctggacagaagactgagctacttcctgggcctgagagacgagaacgccaagggccagtggagatgggtggaccagacccccttcaaccccagaagagtgttctggcacaagaacgagcccgacaacagccagggcgagaactgcgtggtgctggtgtacaaccaggacaagtgggcctggaacgacgtgccctgcaacttcgaggccagcagaatctgcaagatccccggcaccaccctgaactag

SEQ ID NO: 77888 - DNA, 435 bp, Artificial Sequence
  Description of Artificial Sequence: Synthetic coding sequence
atgggcctggagaagccccagagcaagctggagggcggcatgcacccccagctgatccccagcgtgatcgccgtggtgttcatcctgctgctgagcgtgtgcttcatcgccagctgcctggtgacccaccacaacttcagcagatgcaagagaggcaccggcgtgcacaagctggagcaccacgccaagctgaagtgcatcaaggagaagagcgagctgaagagcgccgagggcagcacctggaactgctgccccatcgactggagagccttccagagcaactgctacttccccctgaccgacaacaagacctgggccgagagcgagagaaactgcagcggcatgggcgcccacctgatgaccatcagcaccgaggccgagcagaacttcatcatccagttcctggacagaagactgagctacttcctgggctag

SEQ ID NO: 77889 - DNA, 660 bp, Artificial Sequence
  Description of Artificial Sequence: Synthetic coding sequence
atgaacagcagcaagagcagcgagacccagtgcaccgagagaggctgcttcagcagccagatgttcctgtggaccgtggccggcatccccatcctgttcctgagcgcctgcttcatcaccagatgcgtggtgaccttcagaatcttccagacctgcgacgagaagaagttccagctgcccgagaacttcaccgagctgagctgctacaactacggcagcggcagcgtgaagaactgctgccccctgaactgggagtacttccagagcagctgctacttcttcagcaccgacaccatcagctgggccctgagcctgaagaactgcagcgccatgggcgcccacctggtggtgatcaacagccaggaggagcaggagttcctgagctacaagaagcccaagatgagagagttcttcatcggcctgagcgaccaggtggtggagggccagtggcagtgggtggacggcacccccctgaccaagagcctgagcttctgggacgtgggcgagcccaacaacatcgccaccctggaggactgcgccaccatgagagacagcagcaaccccagacagaactggaacgacgtgacctgcttcctgaactacttcagaatctgcgagatggtgggcatcaaccccctgaacaagggcaagagcctgtag

SEQ ID NO: 77890 - DNA, 1134 bp, Artificial Sequence
  Description of Artificial Sequence: Synthetic coding sequence
atgagcgacagcaaggagcccagagtgcagcagctgggcctgctggaggaggaccccaccaccagcggcatcagactgttccccagagacttccagttccagcagatccacggccacaagagcagcaccggctgcctgggccacggcgccctggtgctgcagctgctgagcttcatgctgctggccggcgtgctggtggccatcctggtgcaggtgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtggtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtgggcgagctgcccgaccagagcaagcagcagcagatctaccaggagctgaccgacctgaagaccgccttcgagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagaacttcctgcagctgcagaccagcagaagcaacagattcagctggatgggcctgagcgacctgaaccaggagggcacctggcagtgggtggacggcagccccctgagccccagcttccagagatactggaacagcggcgagcccaacaacagcggcaacgaggactgcgccgagttcagcggcagcggctggaacgacaacagatgcgacgtggacaactactggatctgcaagaagcccgccgcctgcttcagagacgagtag

SEQ ID NO: 77891 - DNA, 1200 bp, Artificial Sequence
  Description of Artificial Sequence: Synthetic coding sequence
atgagcgacagcaaggagcccagagtgcagcagctgggcctgctggaggaggaccccaccaccagcggcatcagactgttccccagagacttccagttccagcagatccacggccacaagagcagcaccggctgcctgggccacggcgccctggtgctgcagctgctgagcttcatgctgctggccggcgtgctggtggccatcctggtgcaggtgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtgggcgagctgcccgaccagagcaagcagcagcagatctaccaggagctgaccgacctgaagaccgccttcgagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagaacttcctgcagctgcagaccagcagaagcaacagattcagctggatgggcctgagcgacctgaaccaggagggcacctggcagtgggtggacggcagccccctgagccccagcttccagagatactggaacagcggcgagcccaacaacagcggcaacgaggactgcgccgagttcagcggcagcggctggaacgacaacagatgcgacgtggacaactactggatctgcaagaagcccgccgcctgcttcagagacgagtag

SEQ ID NO: 77892 - DNA, 1047 bp, Artificial Sequence
  Description of Artificial Sequence: Synthetic coding sequence
atgagcgacagcaaggagcccagagtgcagcagctgggcctgctgggctgcctgggccacggcgccctggtgctgcagctgctgagcttcatgctgctggccggcgtgctggtggccatcctggtgcaggtgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtgggcgagctgcccgaccagagcaagcagcagcagatctaccaggagctgaccgacctgaagaccgccttcgagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagaacttcctgcagctgcagaccagcagaagcaacagattcagctggatgggcctgagcgacctgaaccaggagggcacctggcagtgggtggacggcagccccctgagccccagcttccagagatactggaacagcggcgagcccaacaacagcggcaacgaggactgcgccgagttcagcggcagcggctggaacgacaacagatgcgacgtggacaactactggatctgcaagaagcccgccgcctgcttcagagacgagtag

SEQ ID NO: 77893 - DNA, 975 bp, Artificial Sequence
  Description of Artificial Sequence: Synthetic coding sequence
atgagcgacagcaaggagcccagagtgcagcagctgggcctgctggaggaggaccccaccaccagcggcatcagactgttccccagagacttccagttccagcagatccacggccacaagagcagcaccggctgcctgggccacggcgccctggtgctgcagctgctgagcttcatgctgctggccggcgtgctggtggccatcctggtgcaggtgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtgggcgagctgcccgaccagagcaagcagcagcagatctaccaggagctgaccgacctgaagaccgccttcgagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagctgcccgccgtgctggagcagtggagaacccagcagtag

SEQ ID NO: 77894 - DNA, 771 bp, Artificial Sequence
  Description of Artificial Sequence: Synthetic coding sequence
atgagcgacagcaaggagcccagagtgcagcagctgggcctgctggtgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtgggcgagctgcccgaccagagcaagcagcagcagatctaccaggagctgaccgacctgaagaccgccttcgagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagtag

SEQ ID NO: 77895 - DNA, 999 bp, Artificial Sequence
  Description of Artificial Sequence: Synthetic coding sequence
atgagcgacagcaaggagcccagagtgcagcagctgggcctgctggaggaggaccccaccaccagcggcatcagactgttccccagagacttccagttccagcagatccacggccacaagagcagcaccgtgcccttcctgctgggccccgtgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtggagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagaacttcctgcagctgcagaccagcagaagcaacagattcagctggatgggcctgagcgacctgaaccaggagggcacctggcagtgggtggacggcagccccctgagccccagcttccagagatactggaacagcggcgagcccaacaacagcggcaacgaggactgcgccgagttcagcggcagcggctggaacgacaacagatgcgacgtggacaactactggatctgcaagaagcccgccgcctgcttcagagacgagtag

SEQ ID NO: 77896 - DNA, 1164 bp, Artificial Sequence
  Description of Artificial Sequence: Synthetic coding sequence
atgagcgacagcaaggagcccagagtgcagcagctgggcctgctggaggaggaccccaccaccaacttccagttccagcagatccacggccacaagagcagcaccggctgcctgggccacggcgccctggtgctgcagctgctgagcttcatgctgctggccggcgtgctgcccagactgagcaaggtgcccagcagcctgagccaggagcagagcgagcaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccagactgaaggccgccgtgggcgagctgcccgagaagagcaagctgcaggagatctaccaggagctgaccgagctgaaggccgccgtgggcgagctgcccgagaagagcaagctgcaggagatctaccaggagctgacccagctgaaggccgccgtgggcgagctgcccgaccagagcaagcagcagcagatctaccaggagctgaccgacctgaagaccgccttcgagagactgtgcagacactgccccaaggactggaccttcttccagggcaactgctacttcatgagcaacagccagagaaactggcacgacagcgtgaccgcctgccaggaggtgagagcccagctggtggtgatcaagaccgccgaggagcagaacttcctgcagctgcagaccagcagaagcaacagattcagctggatgggcctgagcgacctgaaccaggagggcacctggcagtgggtggacggcagccccctgagccccagcttccagagatactggaacagcggcgagcccaacaacagcggcaacgaggactgcgccgagttcagcggcagcggctggaacgacaacagatgcgacgtggacaactactggatctgcaagaagcccgccgcctgcttcagagacgagtag

SEQ ID NO: 77897 - DNA, 567 bp, Artificial Sequence
  Description of Artificial Sequence: Synthetic coding sequence
atgaactggcacatgatcatcagcggcctgatcgtggtggtgctgaaggtggtgggcatgaccctgttcctgctgtacttcccccagatcttcaacaagagcaacgacggcttcaccaccaccagaagctacggcaccgtgagccagatcttcggcagcagcagccccagccccaacggcttcatcaccaccagaagctacggcaccgtgtgccccaaggactgggagttctaccaggccagatgcttcttcctgagcaccagcgagagcagctggaacgagagcagagacttctgcaagggcaagggcagcaccctggccatcgtgaacacccccgagaagctgaagttcctgcaggacatcaccgacgccgagaagtacttcatcggcctgatctaccacagagaggagaagagatggagatggatcaacaacagcgtgttcaacggcaacgtgaccaaccagaaccagaacttcaactgcgccaccatcggcctgaccaagaccttcgacgccgccagctgcgacatcagctacagaagaatctgcgagaagaacgccaagtag

SEQ ID NO: 77898 - DNA, 630 bp, Artificial Sequence
  Description of Artificial Sequence: Synthetic coding sequence
atgatgcaggagcagcagccccagagcaccgagaagagaggctggctgagcctgagactgtggagcgtggccggcatcagcatcgccctgctgagcgcctgcttcatcgtgagctgcgtggtgacctaccacttcacctacggcgagaccggcaagagactgagcgagctgcacagctaccacagcagcctgacctgcttcagcgagggcaccaaggtgcccgcctggggctgctgccccgccagctggaagagcttcggcagcagctgctacttcatcagcagcgaggagaaggtgtggagcaagagcgagcagaactgcgtggagatgggcgcccacctggtggtgttcaacaccgaggccgagcagaacttcatcgtgcagcagctgaacgagagcttcagctacttcctgggcctgagcgacccccagggcaacaacaactggcagtggatcgacaagaccccctacgagaagaacgtgagattctggcacctgggcgagcccaaccacagcgccgagcagtgcgccagcatcgtgttctggaagcccaccggctggggctggaacgacgtgatctgcgagaccagaagaaacagcatctgcgagatgaacaagatctacctgtag

SEQ ID NO: 77899 - DNA, 432 bp, Artificial Sequence
  Description of Artificial Sequence: Synthetic coding sequence
atggagtaccaccccgacctggagaacctggacgaggacggctacacccagctgcacttcgacagccagagcaacaccagaatcgccgtggtgagcgagaagggcagctgcgccgccagccccccctggagactgatcgccgtgatcctgggcatcctgtgcctggtgatcctggtgatcgccgtggtgctgggcaccatgggcgtgctgagcagcccctgcccccccaactggatcatctacgagaagagctgctacctgttcagcatgagcctgaacagctgggacggcagcaagagacagtgctggcagctgggcagcaacctgctgaagatcgacagcagcaacgagctgatcagcgaccagaaccacagctaccccagaaagcccatcagcaagctgtgcatggacagcagagtgagccacctgtag

SEQ ID NO: 77900 - DNA, 744 bp, Artificial Sequence
  Description of Artificial Sequence: Synthetic coding sequence
atggagtaccaccccgacctggagaacctggacgaggacggctacacccagctgcacttcgacagccagagcaacaccagaatcgccgtggtgagcgagaagggcagctgcgccgccagccccccctggagactgatcgccgtgatcctgggcatcctgtgcctggtgatcctggtgatcgccgtggtgctgggcaccatggccatctggagaagcaacagcggcagcaacaccctggagaacggctacttcctgagcagaaacaaggagaaccacagccagcccacccagagcagcctggaggacagcgtgacccccaccaaggccgtgaagaccaccggcgtgctgagcagcccctgcccccccaactggatcatctacgagaagagctgctacctgttcagcatgagcctgaacagctgggacggcagcaagagacagtgctggcagctgggcagcaacctgctgaagatcgacagcagcaacgagctgggcttcatcgtgaagcaggtgagcagccagcccgacaacagcttctggatcggcctgagcagaccccagaccgaggtgccctggctgtgggaggacggcagcaccttcagcagcaacctgttccagatcagaaccaccgccacccaggagaaccccagccccaactgcgtgtggatccacgtgagcgtgatctacgaccagctgtgcagcgtgcccagctacagcatctgcgagaagaagttcagcatgtag

SEQ ID NO: 77901 - DNA, 234 bp, Artificial Sequence
  Description of Artificial Sequence: Synthetic coding sequence
atggagtaccaccccgacctggagaacctggacgaggacggctacacccagctgcacttcgacagccagagcaacaccagaatcgccgtggtgagcgagaagggcagctgcgccgccagccccccctggagactgatcgccgtgatcctgggcatcctgtgcctggtgatcctggtgatcgccgtggtgctgggcaccatggccggcttcaaggccgtggagttcaagggctag

SEQ ID NO: 77902 - DNA, 606 bp, Artificial Sequence
  Description of Artificial Sequence: Synthetic coding sequence
atggagtaccaccccgacctggagaacctggacgaggacggctacacccagctgcacttcgacagccagagcaacaccagaatcgccgtggtgagcgagaagggcagctgcgccgccagccccccctggagactgatcgccgtgatcctgggcatcctgtgcctggtgatcctggtgatcgccgtggtgctgggcaccatgggcgtgctgagcagcccctgcccccccaactggatcatctacgagaagagctgctacctgttcagcatgagcctgaacagctgggacggcagcaagagacagtgctggcagctgggcagcaacctgctgaagatcgacagcagcaacgagctgggcttcatcgtgaagcaggtgagcagccagcccgacaacagcttctggatcggcctgagcagaccccagaccgaggtgccctggctgtgggaggacggcagcaccttcagcagcaacctgttccagatcagaaccaccgccacccaggagaaccccagccccaactgcgtgtggatccacgtgagcgtgatctacgaccagctgtgcagcgtgcccagctacagcatctgcgagaagaagttcagcatgtag

SEQ ID NO: 77903 - DNA, 507 bp, Artificial Sequence
  Description of Artificial Sequence: Synthetic coding sequence
atggagtaccaccccgacctggagaacctggacgaggacggctacacccagctgcacttcgacagccagagcaacaccagaatcgccgtggtgagcgagaagggcgtgctgagcagcccctgcccccccaactggatcatctacgagaagagctgctacctgttcagcatgagcctgaacagctgggacggcagcaagagacagtgctggcagctgggcagcaacctgctgaagatcgacagcagcaacgagctgggcttcatcgtgaagcaggtgagcagccagcccgacaacagcttctggatcggcctgagcagaccccagaccgaggtgccctggctgtgggaggacggcagcaccttcagcagcaacctgttccagatcagaaccaccgccacccaggagaaccccagccccaactgcgtgtggatccacgtgagcgtgatctacgaccagctgtgcagcgtgcccagctacagcatctgcgagaagaagttcagcatgtag

SEQ ID NO: 77904 - DNA, 351 bp, Artificial Sequence
  Description of Artificial Sequence: Synthetic coding sequence
atggagtaccaccccgacctggagaacctggacgaggacggctacacccagctgcacttcgacagccagagcaacaccagaatcgccgtggtgagcgagaagggcagctgcgccgccagccccccctggagactgatcgccgtgatcctgggcatcctgtgcctggtgatcctggtgatcgccgtggtgctgggcaccatgggcaccggccagttcctgaaggacctgagcttcctgaacaacagaagaaagctgttcggcgaccccatccaggaggccacccactggagaatggccaccttctaccaggagatcaagagaaccaccgtgaacccccacaaccacctgtag

SEQ ID NO: 77905 - DNA, 744 bp, Artificial Sequence; identical to SEQ ID NO: 77900
  Description of Artificial Sequence: Synthetic coding sequence

SEQ ID NO: 77906 - DNA, 570 bp, Artificial Sequence
  Description of Artificial Sequence: Synthetic coding sequence
atggagtaccaccccgacctggagaacctggacgaggacggctacacccagctgcacttcgacagccagagcaacaccagaatcgccgtggtgagcgagaagggcagctgcgccgccagccccccctggagactgatcgccgtgatcctgggcatcctgtgcctggtgatcctggtgatcgccgtggtgctgggcaccatggccatctggagaagcaacagcggcagcaacaccctggagaacggctacttcctgagcagaaacaaggagaaccacagccagcccacccagagcagcctggaggacagcgtgacccccaccaaggccgtgaagaccaccggcgtgctgagcagcccctgcccccccaactggatcatctacgagaagagctgctacctgttcagcatgagcctgaacagctgggacggcagcaagagacagtgctggcagctgggcagcaacctgctgaagatcgacagcagcaacgagctgatcagcgaccagaaccacagctaccccagaaagcccatcagcaagctgtgcatggacagcagagtgagccacctgtag

SEQ ID NO: 77907 - DNA, 10281 bp, Artificial Sequence
  Description of Artificial Sequence: Synthetic coding sequence
gtgctgcccagccacacctgcggcaaccccggcgagatcctgaagggcgtgctgcacggcaccagattcaacatcggcgacaagatcagatacagctgcctgcccggctacatcctggagggccacgccatcctgacctgcatcgtgagccccggcaacggcgccagctgggacttccccgcccccttctgcagagccgagggcgcctgcggcggcaccctgagaggcaccagcagcagcatcagcagcccccacttccccagcgagtacgagaacaacgccgactgcacctggaccatcctggccgagcccggcgacaccatcgccctggtgttcaccgacttccagctggaggagggctacgacttcctggagatcagcggcaccgaggcccccagcatctggctgaccggcatgaacctgcccagccccgtgatcagcagcaagaactggctgagactgcacttcaccagcgacagcaaccacagaagaaagggcttcaacgcccagttccaggtgaagaaggccatcgagctgaagagcagaggcgtgaagatgctgcccagcaaggacggcagccacaagaacagcgtgctgagccagggcggcgtggccctggtgagcgacatgtgccccgaccccggcatccccgagaacggcagaagagccggcagcgacttcagcagagtgggcgccaacgtgcagttcagctgcgaggacaactacgtgctgcagggcagcaagagcatcacctgccagagagtgaccgagaccctggccgcctggagcgaccacagacccatctgcagagccagaacctgcggcagcaacctgagaggccccagcggcgtgatcaccagccccaactaccccgtgcagtacgaggacaacgcccactgcgtgtgggtgatcaccaccaccgaccccgacaaggtgatcaagctggccttcgaggagttcgagctggagagaggctacgacaccctgaccgtgggcgacgccggcaaggtgggcgacaccagaagcgtgctgtacgtgctgaccggcagcagcgtgcccgacctgatcgtgagcatgagcaaccagatgtggctgcacctgcagagcgacgacagcatcggcagccccggcttcaaggccgtgtaccaggagatcgagaagggcggctgcggcgaccccggcatccccgcctacggcaagagaaccggcagcagcttcctgcacggcgacaccctgaccttcgagtgccccgccgccttcgagctggtgggcgagagagtgatcacctgccagcagaacaaccagtggagcggcaacaagcccagctgcgtgttcagctgcttcttcaacttcaccgccagcagcggcatcatcctgagccccaactaccccgaggagtacggcaacaacatgaactgcgtgtggctgatcatcagcgagcccggcagcagaatccacctgatcttcaacgacttcgacgtggagccccagttcgacttcctggccgtgaaggacgacggcatcagcgacatcaccgtgctgggcaccttcagcggcaacgaggtgcccagccagctggccagcagcggccacatcgtgagactggagttccagagcgaccacagcaccaccggcagaggcttcaacatcacctacaccaccttcggccagaacgagtgccacgaccccggcatccccatcaacggcagaagattcggcgacagattcctgctgggcagcagcgtgagcttccactgcgacgacggcttcgtgaagacccagggcagcgagagcatcacctgcatcctgcaggacggcaacgtggtgtggagcagcaccgtgcccagatgcgaggccccctgcggcggccacctgaccgccagcagcggcgtgatcctgccccccggctggcccggctactacaaggacagcctgcactgcgagtggatcatcgaggccaagcccggccacagcatcaagatcaccttcgacagattccagaccgaggtgaactacgacaccctggaggtgagagacggccccgccagcagcagccccctgatcggcgagtaccacggcacccaggccccccagttcctgatcagcaccggcaacttcatgtacctgctgttcaccaccgacaacagcagaagcagcatcggcttcctgatccactacgagagcgtgaccctggagagcgacagctgcctggaccccggcatccccgtgaacggccacagacacggcggcgacttcggcatcagaagcaccgtgaccttcagctgcgaccccggctacaccctgagcgacgacgagcccctggtgtgcgagagaaaccaccagtggaaccacgccctgcccagctgcgacgccctgtgcggcggctacatccagggcaagagcggcaccgtgctgagccccggcttccccgacttctaccccaacagcctgaactgcacctggaccatcgaggtgagccacggcaagggcgtgcagatgatcttccacaccttccacctggagagcagccacgactacctgctgatcaccgaggacggcagcttcagcgagcccgtggccagactgaccggcagcgtgctgccccacaccatcaaggccggcctgttcggcaacttcaccgcccagctgagattcatcagcgacttcagcatcagctacgagggcttcaacatcaccttcagcgagtacgacctggagccctgcgacgaccccggcgtgcccgccttcagcagaagaatcggcttccacttcggcgtgggcgacagcctgaccttcagctgcttcctgggctacagactggagggcgccaccaagctgacctgcctgggcggcggcagaagagtgtggagcgcccccctgcccagatgcgtggccgagtgcggcgccagcgtgaagggcaacgagggcaccctgctgagccccaacttccccagcaactacgacaacaaccacgagtgcatctacaagatcgagaccgaggccggcaagggcatccacctgagaaccagaagcttccagctgttcgagggcgacaccctgaaggtgtacgacggcaaggacagcagcagcagacccctgggcaccttcaccaagaacgagctgctgggcctgatcctgaacagcaccagcaaccacctgtggctggagttcaacaccaacggcagcgacaccgaccagggcttccagctgacctacaccagcttcgacctggtgaagtgcgaggaccccggcatccccaactacggctacagaatcagagacgagggccacttcaccgacaccgtggtgctgtacagctgcaaccccggctacgccatgcacggcagcaacaccctgacctgcctgagcggcgacagaagagtgtgggacaagcccctgcccagctgcatcgccgagtgcggcggccagatccacgccgccaccagcggcagaatcctgagccccggctaccccgccccctacgacaacaacctgcactgcacctggatcatcgaggccgaccccggcaagaccatcagcctgcacttcatcgtgttcgacaccgagatggcccacgacatcctgaaggtgtgggacggccccgtggacagcgacatcctgctgaaggagtggagcggcagcgccctgcccgaggacatccacagcaccttcaacagcctgaccctgcagttcgacagcgacttcttcatcagcaagagcggcttcagcatccagttcagcaccagcatcgccgccacctgcaacgaccccggcatgccccagaacggcaccagatacggcgacagcagagaggccggcgacaccgtgaccttccagtgcgaccccggctaccagctgcagggccaggccaagatcacctgcgtgcagctgaacaacagattcttctggcagcccgacccccccacctgcatcgccgcctgcggcggcaacctgaccggccccgccggcgtgatcctgagccccaactacccccagccctacccccccggcaaggagtgcgactggagagtgaaggtgaaccccgacttcgtgatcgccctgatcttcaagagcttcaacatggagcccagctacgacttcctgcacatctacgagggcgaggacagcaacagccccctgatcggcagctaccagggcagccaggcccccgagagaatcgagagcagcggcaacagcctgttcctggccttcagaagcgacgccagcgtgggcctgagcggcttcgccatcgagttcaaggagaagcccagagaggcctgcttcgaccccggcaacatcatgaacggcaccagagtgggcaccgacttcaagctgggcagcaccatcacctaccagtgcgacagcggctacaagatcctggaccccagcagcatcacctgcgtgatcggcgccgacggcaagcccagctgggaccaggtgctgcccagctgcaacgccccctgcggcggccagtacaccggcagcgagggcgtggtgctgagccccaactacccccacaactacaccgccggccagatctgcctgtacagcatcaccgtgcccaaggagttcgtggtgttcggccagttcgcctacttccagaccgccctgaacgacctggccgagctgttcgacggcacccacgcccaggccagactgctgagcagcctgagcggcagccacagcggcgagaccctgcccctggccaccagcaaccagatcctgctgagattcagcgccaagagcggcgccagcgccagaggcttccacttcgtgtaccaggccgtgcccagaaccagcgacacccagtgcagcagcgtgcccgagcccagatacggcagaagaatcggcagcgagttcagcgccggcagcatcgtgagattcgagtgcaaccccggctacctgctgcagggcagcaccgccctgcactgccagagcgtgcccaacgccctggcccagtggaacgacaccatccccagctgcgtggtgccctgcagcggcaacttcacccagagaagaggcaccatcctgagccccggctaccccgagccctacggcaacaacctgaactgcatctggaagatcatcgtgaccgagggcagcggcatccaggaccccagcgaccagttctgccacggcgccgagctgggcctggagatccacgacggcggcgacgtgaccgcccccagactgggcagcttcagcggcaccaccgtgcccgccctgctgaacagcaccagcaaccagctgtacctgcacttccagagcgacatcagcgtggccgccgccggcttccacctggagtacaagaccgtgggcctggccgcctgccaggagcccgccctgcccagcaacagcatcaagatcggcgacagatacatggtgaacgacgtgctgagcttccagtgcgagcccggctacaccctgcagggcagaagccacatcagctgcatgcccggcaccgtgagaagatggaactaccccagccccctgtgcatcgccacctgcggcggcaccctgagcaccctgggcggcgtgatcctgagccccggcttccccggcagctaccccaacaacctggactgcacctggagaatcagcctgcccatcggctacggcgcccacatccagttcctgaacttcagcaccgaggccaaccacgacttcctggagatccagaacggcccctaccacaccagccccatgatcggccagttcagcggcaccgacctgcccgccgccctgctgagcaccacccacgagaccctgatccacttctacagcgaccacagccagaacagacagggcttcaagctggcctaccaggcctacgagctgcagaactgccccgaccccccccccttccagaacggctacatgatcaacagcgactacagcgtgggccagagcgtgagcttcgagtgctaccccggctacatcctgatcggccaccccgtgctgacctgccagcacggcatcaacagaaactggaactaccccttccccagatgcgacgccccctgcggctacaacgtgaccagccagaacggcaccatctacagccccggcttccccgacgagtaccccatcctgaaggactgcatctggctgatcaccgtgccccccggccacggcgtgtacatcaacttcaccctgctgcagaccgaggccgtgaacgactacatcgccgtgtgggacggccccgaccagaacagcccccagctgggcgtgttcagcggcaacaccgccctggagaccgcctacagcagcaccaaccaggtgctgctgaagttccacagcgacttcagcaacggcggcttcttcgtgctgaacttccacgccttccagctgaagaagtgccagcccccccccgccgtgccccaggccgagatgctgaccgaggacgacgacttcgagatcggcgacttcgtgaagtaccagtgccaccccggctacaccctggtgggcaccgacatcctgacctgcaagctgagcagccagctgcagttcgagggcagcctgcccacctgcgaggcccagtgccccgccaacgaggtgagaaccggcagcagcggcgtgatcctgagccccggctaccccggcaactacttcaacagccagacctgcagctggagcatcaaggtggagcccaactacaacatcaccatcttcgtggacaccttccagagcgagaagcagttcgacgccctggaggtgttcgacggcagcagcggccagagccccctgctggtggtgctgagcggcaaccacaccgagcagagcaacttcaccagcagaagcaaccagctgtacctgagatggagcaccgaccacgccaccagcaagaagggcttcaagatcagatacgccgccccctactgcagcctgacccaccccctgaagaacggcggcatcctgaacagaaccgccggcgccgtgggcagcaaggtgcactacttctgcaagcccggctacagaatggtgggccacagcaacgccacctgcagaagaaaccccctgggcatgtaccagtgggacagcctgacccccctgtgccaggccgtgagctgcggcatccccgagagccccggcaacggcagcttcaccggcaacgagttcaccctggacagcaaggtggtgtacgagtgccacgagggcttcaagctggagagcagccagcaggccaccgccgtgtgccaggaggacggcctgtggagcaacaagggcaagccccccacctgcaagcccgtggcctgccccagcatcgaggcccagctgagcgagcacgtgatctggagactggtgagcggcagcctgaacgagtacggcgcccaggtgctgctgagctgcagccccggctactacctggagggctggagactgctgagatgccaggccaacggcacctggaacatcggcgacgagagacccagctgcagagtgatcagctgcggcagcctgagcttcccccccaacggcaacaagatcggcaccctgaccgtgtacggcgccaccgccatcttcacctgcaacaccggctacaccctggtgggcagccacgtgagagagtgcctggccaacggcctgtggagcggcagcgagaccagatgcctggccggccactgcggcagccccgaccccatcgtgaacggccacatcagcggcgacggcttcagctacagagacaccgtggtgtaccagtgcaaccccggcttcagactggtgggcaccagcgtgagaatctgcctgcaggaccacaagtggagcggccagacccccgtgtgcgtgcccatcacctgcggccaccccggcaaccccgcccacggcttcaccaacggcagcgagttcaacctgaacgacgtggtgaacttcacctgcaacaccggctacctgctgcagggcgtgagcagagcccagtgcagaagcaacggccagtggagcagccccctgcccacctgcagagtggtgaactgcagcgaccccggcttcgtggagaacgccatcagacacggccagcagaacttccccgagagcttcgagtacggcatgagcatcctgtaccactgcaagaagggcttctacctgctgggcagcagcgccctgacctgcatggccaacggcctgtgggacagaagcctgcccaagtgcctggccatcagctgcggccaccccggcgtgcccgccaacgccgtgctgaccggcgagctgttcacctacggcgccgtggtgcactacagctgcagaggcagcgagagcctgatcggcaacgacaccagagtgtgccaggaggacagccactggagcggcgccctgccccactgcaccggcaacaaccccggcttctgcggcgaccccggcacccccgcccacggcagcagactgggcgacgacttcaagaccaagagcctgctgagattcagctgcgagatgggccaccagctgagaggcagccccgagagaacctgcctgctgaacggcagctggagcggcctgcagcccgtgtgcgaggccgtgagctgcggcaaccccggcacccccaccaacggcatgatcgtgagcagcgacggcatcctgttcagcagcagcgtgatctacgcctgctgggagggctacaagaccagcggcctgatgaccagacactgcaccgccaacggcacctggaccggcaccgcccccgactgcaccatcatcagctgcggcgaccccggcaccctggccaacggcatccagttcggcaccgacttcaccttcaacaagaccgtgagctaccagtgcaaccccggctacgtgatggaggccgtgaccagcgccaccatcagatgcaccaaggacggcagatggaaccccagcaagcccgtgtgcaaggccgtgctgtgcccccagcccccccccgtgcagaacggcaccgtggagggcagcgacttcagatggggcagcagcatcagctacagctgcatggacggctaccagctgagccacagcgccatcctgagctgcgagggcagaggcgtgtggaagggcgagatcccccagtgcctgcccgtgttctgcggcgaccccggcatccccgccgagggcagactgagcggcaagagcttcacctacaagagcgaggtgttcttccagtgcaagagccccttcatcctggtgggcagcagcagaagagtgtgccaggccgacggcacctggagcggcatccagcccacctgcatcgaccccgcccacaacacctgccccgaccccggcaccccccacttcggcatccagaacagcagcagaggctacgaggtgggcagcaccgtgttcttcagatgcagaaagggctaccacatccagggcagcaccaccagaacctgcctggccaacctgacctggagcggcatccagaccgagtgcatcccccacgcctgcagacagcccgagacccccgcccacgccgacgtgagagccatcgacctgcccaccttcggctacaccctggtgtacacctgccaccccggcttcttcctggccggcggcagcgagcacagaacctgcaaggccgacatgaagtggaccggcaagagccccgtgtgcaagagcaagggcgtgagagaggtgaacgagaccgtgaccaagacccccgtgcccagcgacgtgttcttcgtgaacagcctgtggaagggctactacgagtacctgggcaagagacagcccgccaccctgaccgtggactggttcaacgccaccagcagcaaggtgaacgccaccttcagcgaggccagccccgtggagctgaagctgaccggcatctacaagaaggaggaggcccacctgctgctgaaggccttccagatcaagggccaggccgacatcttcgtgagcaagttcgagaacgacaactggggcctggacggctacgtgagcagcggcctggagagaggcggcttcaccttccagggcgacatccacggcaaggacttcggcaagttcaagctggagagacaggaccccctgaaccccgaccaggacagcagcagccactaccacggcaccagcagcggcagcgtggccgccgccatcctggtgcccttcttcgccctgatcctgagcggcttcgccttctacctgtacaagcacagaaccagacccaaggtgcagtacaacggctacgccggccacgagaacagcaacggccaggccagcttcgagaaccccatgtacgacaccaacctgaagcccaccgaggccaaggccgtgagattcgacaccaccctgaacaccgtgtgcaccgtggtgtag

SEQ ID NO: 77908 - DNA, 10167 bp, Artificial Sequence
  Description of Artificial Sequence: Synthetic coding sequence
atgaccgcctggagaagattccagagcctgctgctgctgctgggcctgctggtgctgtgcgccagactgctgaccgccgccaagggccagaactgcggcggcctggtgcagggccccaacggcaccatcgagagccccggcttcccccacggctaccccaactacgccaactgcacctggatcatcatcaccggcgagagaaacagaatccagctgagcttccacaccttcgccctggaggaggacttcgacatcctgagcgtgtacgacggccagccccagcagggcaacctgaaggtgagactgagcggcttccagctgcccagcagcatcgtgagcaccggcagcatcctgaccctgtggttcaccaccgacttcgccgtgagcgcccagggcttcaaggccctgtacgaggtgctgcccagccacacctgcggcaaccccggcgagatcctgaagggcgtgctgcacggcaccagattcaacatcggcgacaagatcagatacagctgcctgcccggctacatcctggagggccacgccatcctgacctgcatcgtgagccccggcaacggcgccagctgggacttccccgcccccttctgcagagccgagggcgcctgcggcggcaccctgagaggcaccagcagcagcatcagcagcccccacttccccagcgagtacgagaacaacgccgactgcacctggaccatcctggccgagcccggcgacaccatcgccctggtgttcaccgacttccagctggaggagggctacgacttcctggagatcagcggcaccgaggcccccagcatctggctgaccggcatgaacctgcccagccccgtgatcagcagcaagaactggctgagactgcacttcaccagcgacagcaaccacagaagaaagggcttcaacgcccagttccaggtgaagaaggccatcgagctgaagagcagaggcgtgaagatgctgcccagcaaggacggcagccacaagaacagcgtgctgagccagggcggcgtggccctggtgagcgacatgtgccccgaccccggcatccccgagaacggcagaagagccggcagcgacttcagcagagtgggcgccaacgtgcagttcagctgcgaggacaactacgtgctgcagggcagcaagagcatcacctgccagagagtgaccgagaccctggccgcctggagcgaccacagacccatctgcagagccagaacctgcggcagcaacctgagaggccccagcggcgtgatcaccagccccaactaccccgtgcagtacgaggacaacgcccactgcgtgtgggtgatcaccaccaccgaccccgacaaggtgatcaagctggccttcgaggagttcgagctggagagaggctacgacaccctgaccgtgggcgacgccggcaaggtgggcgacaccagaagcgtgctgtacgtgctgaccggcagcagcgtgcccgacctgatcgtgagcatgagcaaccagatgtggctgcacctgcagagcgacgacagcatcggcagccccggcttcaaggccgtgtaccaggagatcgagaagggcggctgcggcgaccccggcatccccgcctacggcaagagaaccggcagcagcttcctgcacggcgacaccctgaccttcgagtgccccgccgccttcgagctggtgggcgagagagtgatcacctgccagcagaacaaccagtggagcggcaacaagcccagctgcgtgttcagctgcttcttcaacttcaccgccagcagcggcatcatcctgagccccaactaccccgaggagtacggcaacaacatgaactgcgtgtggctgatcatcagcgagcccggcagcagaatccacctgatcttcaacgacttcgacgtggagccccagttcgacttcctggccgtgaaggacgacggcatcagcgacatcaccgtgctgggcaccttcagcggcaacgaggtgcccagccagctggccagcagcggccacatcgtgagactggagttccagagcgaccacagcaccaccggcagaggcttcaacatcacctacaccaccttcggccagaacgagtgccacgaccccggcatccccatcaacggcagaagattcggcgacagattcctgctgggcagcagcgtgagcttccactgcgacgacggcttcgtgaagacccagggcagcgagagcatcacctgcatcctgcaggacggcaacgtggtgtggagcagcaccgtgcccagatgcgaggccccctgcggcggccacctgaccgccagcagcggcgtgatcctgccccccggctggcccggctactacaaggacagcctgcactgcgagtggatcatcgaggccaagcccggccacagcatcaagatcaccttcgacagattccagaccgaggtgaactacgacaccctggaggtgagagacggccccgccagcagcagccccctgatcggcgagtaccacggcacccaggccccccagttcctgatcagcaccggcaacttcatgtacctgctgttcaccaccgacaacagcagaagcagcatcggcttcctgatccactacgagagcgtgaccctggagagcgacagctgcctggaccccggcatccccgtgaacggccacagacacggcggcgacttcggcatcagaagcaccgtgaccttcagctgcgaccccggctacaccctgagcgacgacgagcccctggtgtgcgagagaaaccaccagtggaaccacgccctgcccagctgcgacgccctgtgcggcggctacatccagggcaagagcggcaccgtgctgagccccggcttccccgacttctaccccaacagcctgaactgcacctggaccatcgaggtgagccacggcaagggcgtgcagatgatcttccacaccttccacctggagagcagccacgactacctgctgatcaccgaggacggcagcttcagcgagcccgtggccagactgaccggcagcgtgctgccccacaccatcaaggccggcctgttcggcaacttcaccgcccagctgagattcatcagcgacttcagcatcagctacgagggcttcaacatcaccttcagcgagtacgacctggagccctgcgacgaccccggcgtgcccgccttcagcagaagaatcggcttccacttcggcgtgggcgacagcctgaccttcagctgcttcctgggctacagactggagggcgccaccaagctgacctgcctgggcggcggcagaagagtgtggagcgcccccctgcccagatgcgtggccgagtgcggcgccagcgtgaagggcaacgagggcaccctgctgagccccaacttccccagcaactacgacaacaaccacgagtgcatctacaagatcgagaccgaggccggcaagggcatccacctgagaaccagaagcttccagctgttcgagggcgacaccctgaaggtgtacgacggcaaggacagcagcagcagacccctgggcaccttcaccaagaacgagctgctgggcctgatcctgaacagcaccagcaaccacctgtggctggagttcaacaccaacggcagcgacaccgaccagggcttccagctgacctacaccagcttcgacctggtgaagtgcgaggaccccggcatccccaactacggctacagaatcagagacgagggccacttcaccgacaccgtggtgctgtacagctgcaaccccggctacgccatgcacggcagcaacaccctgacctgcctgagcggcgacagaagagtgtgggacaagcccctgcccagctgcatcgccgagtgcggcggccagatccacgccgccaccagcggcagaatcctgagccccggctaccccgccccctacgacaacaacctgcactgcacctggatcatcgaggccgaccccggcaagaccatcagcctgcacttcatcgtgttcgacaccgagatggcccacgacatcctgaaggtgtgggacggccccgtggacagcgacatcctgctgaaggagtggagcggcagcgccctgcccgaggacatccacagcaccttcaacagcctgaccctgcagttcgacagcgacttcttcatcagcaagagcggcttcagcatccagttcagcaccagcatcgccgccacctgcaacgaccccggcatgccccagaacggcaccagatacggcgacagcagagaggccggcgacaccgtgaccttccagtgcgaccccggctaccagctgcagggccaggccaagatcacctgcgtgcagctgaacaacagattcttctggcagcccgacccccccacctgcatcgccgcctgcggcggcaacctgaccggccccgccggcgtgatcctgagccccaactacccccagccctacccccccggcaaggagtgcgactggagagtgaaggtgaaccccgacttcgtgatcgccctgatcttcaagagcttcaacatggagcccagctacgacttcctgcacatctacgagggcgaggacagcaacagccccctgatcggcagctaccagggcagccaggcccccgagagaatcgagagcagcggcaacagcctgttcctggccttcagaagcgacgccagcgtgggcctgagcggcttcgccatcgagttcaaggagaagcccagagaggcctgcttcgaccccggcaacatcatgaacggcaccagagtgggcaccgacttcaagctgggcagcaccatcacctaccagtgcgacagcggctacaagatcctggaccccagcagcatcacctgcgtgatcggcgccgacggcaagcccagctgggaccaggtgctgcccagctgcaacgccccctgcggcggccagtacaccggcagcgagggcgtggtgctgagccccaactacccccacaactacaccgccggccagatctgcctgtacagcatcaccgtgcccaaggagttcgtggtgttcggccagttcgcctacttccagaccgccctgaacgacctggccgagctgttcgacggcacccacgcccaggccagactgctgagcagcctgagcggcagccacagcggcgagaccctgcccctggccaccagcaaccagatcctgctgagattcagcgccaagagcggcgccagcgccagaggcttccacttcgtgtaccaggccgtgcccagaaccagcgacacccagtgcagcagcgtgcccgagcccagatacggcagaagaatcggcagcgagttcagcgccggcagcatcgtgagattcgagtgcaaccccggctacctgctgcagggcagcaccgccctgcactgccagagcgtgcccaacgccctggcccagtggaacgacaccatccccagctgcgtggtgccctgcagcggcaacttcacccagagaagaggcaccatcctgagccccggctaccccgagccctacggcaacaacctgaactgcatctggaagatcatcgtgaccgagggcagcggcatccagatccaggtgatcagcttcgccaccgagcagaactgggacagcctggagatccacgacggcggcgacgtgaccgcccccagactgggcagcttcagcggcaccaccgtgcccgccctgctgaacagcaccagcaaccagctgtacctgcacttccagagcgacatcagcgtggccgccgccggcttccacctggagtacaagaccgtgggcctggccgcctgccaggagcccgccctgcccagcaacagcatcaagatcggcgacagatacatggtgaacgacgtgctgagcttccagtgcgagcccggctacaccctgcagggcagaagccacatcagctgcatgcccggcaccgtgagaagatggaactaccccagccccctgtgcatcgccacctgcggcggcaccctgagcaccctgggcggcgtgatcctgagccccggcttccccggcagctaccccaacaacctggactgcacctggagaatcagcctgcccatcggctacggcgcccacatccagttcctgaacttcagcaccgaggccaaccacgacttcctggagatccagaacggcccctaccacaccagccccatgatcggccagttcagcggcaccgacctgcccgccgccctgctgagcaccacccacgagaccctgatccacttctacagcgaccacagccagaacagacagggcttcaagctggcctaccaggcctacgagctgcagaactgccccgaccccccccccttccagaacggctacatgatcaacagcgactacagcgtgggccagagcgtgagcttcgagtgctaccccggctacatcctgatcggccaccccgtgctgacctgccagcacggcatcaacagaaactggaactaccccttccccagatgcgacgccccctgcggctacaacgtgaccagccagaacggcaccatctacagccccggcttccccgacgagtaccccatcctgaaggactgcatctggctgatcaccgtgccccccggccacggcgtgtacatcaacttcaccctgctgcagaccgaggccgtgaacgactacatcgccgtgtgggacggccccgaccagaacagcccccagctgggcgtgttcagcggcaacaccgccctggagaccgcctacagcagcaccaaccaggtgctgctgaagttccacagcgacttcagcaacggcggcttcttcgtgctgaacttccacgccttccagctgaagaagtgccagcccccccccgccgtgccccaggccgagatgctgaccgaggacgacgacttcgagatcggcgacttcgtgaagtaccagtgccaccccggctacaccctggtgggcaccgacatcctgacctgcaagctgagcagccagctgcagttcgagggcagcctgcccacctgcgaggcccagtgccccgccaacgaggtgagaaccggcagcagcggcgtgatcctgagccccggctaccccggcaactacttcaacagccagacctgcagctggagcatcaaggtggagcccaactacaacatcaccatcttcgtggacaccttccagagcgagaagcagttcgacgccctggaggtgttcgacggcagcagcggccagagccccctgctggtggtgctgagcggcaaccacaccgagcagagcaacttcaccagcagaagcaaccagctgtacctgagatggagcaccgaccacgccaccagcaagaagggcttcaagatcagatacgccgccccctactgcagcctgacccaccccctgaagaacggcggcatcctgaacagaaccgccggcgccgtgggcagcaaggtgcactacttctgcaagcccggctacagaatggtgggccacagcaacgccacctgcagaagaaaccccctgggcatgtaccagtgggacagcctgacccccctgtgccaggccgtgagctgcggcatccccgagagccccggcaacggcagcttcaccggcaacgagttcaccctggacagcaaggtggtgtacgagtgccacgagggcttcaagctggagagcagccagcaggccaccgccgtgtgccaggaggacggcctgtggagcaacaagggcaagccccccacctgcaagcccgtggcctgccccagcatcgaggcccagctgagcgagcacgtgatctggagactggtgagcggcagcctgaacgagtacggcgcccaggtgctgctgagctgcagccccggctactacctggagggctggagactgctgagatgccaggccaacggcacctggaacatcggcgacgagagacccagctgcagagccggccactgcggcagccccgaccccatcgtgaacggccacatcagcggcgacggcttcagctacagagacaccgtggtgtaccagtgcaaccccggcttcagactggtgggcaccagcgtgagaatctgcctgcaggaccacaagtggagcggccagacccccgtgtgcgtgcccatcacctgcggccaccccggcaaccccgcccacggcttcaccaacggcagcgagttcaacctgaacgacgtggtgaacttcacctgcaacaccggctacctgctgcagggcgtgagcagagcccagtgcagaagcaacggccagtggagcagccccctgcccacctgcagagtggtgaactgcagcgaccccggcttcgtggagaacgccatcagacacggccagcagaacttccccgagagcttcgagtacggcatgagcatcctgtaccactgcaagaagggcttctacctgctgggcagcagcgccctgacctgcatggccaacggcctgtgggacagaagcctgcccaagtgcctggccatcagctgcggccaccccggcgtgcccgccaacgccgtgctgaccggcgagctgttcacctacggcgccgtggtgcactacagctgcagaggcagcgagagcctgatcggcaacgacaccagagtgtgccaggaggacagccactggagcggcgccctgccccactgcaccggcaacaaccccggcttctgcggcgaccccggcacccccgcccacggcagcagactgggcgacgacttcaagaccaagagcctgctgagattcagctgcgagatgggccaccagctgagaggcagccccgagagaacctgcctgctgaacggcagctggagcggcctgcagcccgtgtgcgaggccgtgctgtgcccccagcccccccccgtgcagaacggcaccgtggagggcagcgacttcagatggggcagcagcatcagctacagctgcatggacggctaccagctgagccacagcgccatcctgagctgcgagggcagaggcgtgtggaagggcgagatcccccagtgcctgcccgtgttctgcggcgaccccggcatccccgccgagggcagactgagcggcaagagcttcacctacaagagcgaggtgttcttccagtgcaagagccccttcatcctggtgggcagcagcagaagagtgtgccaggccgacggcacctggagcggcatccagcccacctgcatcgaccccgcccacaacacctgccccgaccccggcaccccccacttcggcatccagaacagcagcagaggctacgaggtgggcagcaccgtgttcttcagatgcagaaagggctaccacatccagggcagcaccaccagaacctgcctggccaacctgacctggagcggcatccagaccgagtgcatcccccacgcctgcagacagcccgagacccccgcccacgccgacgtgagagccatcgacctgcccaccttcggctacaccctggtgtacacctgccaccccggcttcttcctggccggcggcagcgagcacagaacctgcaaggccgacatgaagtggaccggcaagagccccgtgtgcaagagcaagggcgtgagagaggtgaacgagaccgtgaccaagacccccgtgcccagcgacgtgttcttcgtgaacagcctgtggaagggctactacgagtacctgggcaagagacagcccgccaccctgaccgtggactggttcaacgccaccagcagcaaggtgaacgccaccttcagcgaggccagccccgtggagctgaagctgaccggcatctacaagaaggaggaggcccacctgctgctgaaggccttccagatcaagggccaggccgacatcttcgtgagcaagttcgagaacgacaactggggcctggacggctacgtgagcagcggcctggagagaggcggcttcaccttccagggcgacatccacggcaaggacttcggcaagttcaagctggagagacaggaccccctgaaccccgaccaggacagcagcagccactaccacggcaccagcagcggcagcgtggccgccgccatcctggtgcccttcttcgccctgatcctgagcggcttcgccttctacctgtacaagcacagaaccagacccaaggtgcagtacaacggctacgccggccacgagaacagcaacggccaggccagcttcgagaaccccatgtacgacaccaacctgaagcccaccgaggccaaggccgtgagattcgacaccaccctgaacaccgtgtgcaccgtggtgtag

SEQ ID NO: 77909 - DNA, 10698 bp, Artificial Sequence
  Description of Artificial Sequence: Synthetic coding sequence
atgaccgcctggagaagattccagagcctgctgctgctgctgggcctgctggtgctgtgcgccagactgctgaccgccgccaagggccagaactgcggcggcctggtgcagggccccaacggcaccatcgagagccccggcttcccccacggctaccccaactacgccaactgcacctggatcatcatcaccggcgagagaaacagaatccagctgagcttccacaccttcgccctggaggaggacttcgacatcctgagcgtgtacgacggccagccccagcagggcaacctgaaggtgagactgagcggcttccagctgcccagcagcatcgtgagcaccggcagcatcctgaccctgtggttcaccaccgacttcgccgtgagcgcccagggcttcaaggccctgtacgaggtgctgcccagccacacctgcggcaaccccggcgagatcctgaagggcgtgctgcacggcaccagattcaacatcggcgacaagatcagatacagctgcctgcccggctacatcctggagggccacgccatcctgacctgcatcgtgagccccggcaacggcgccagctgggacttccccgcccccttctgcagagccgagggcgcctgcggcggcaccctgagaggcaccagcagcagcatcagcagcccccacttccccagcgagtacgagaacaacgccgactgcacctggaccatcctggccgagcccggcgacaccatcgccctggtgttcaccgacttccagctggaggagggctacgacttcctggagatcagcggcaccgaggcccccagcatctggctgaccggcatgaacctgcccagccccgtgatcagcagcaagaactggctgagactgcacttcaccagcgacagcaaccacagaagaaagggcttcaacgcccagttccaggtgaagaaggccatcgagctgaagagcagaggcgtgaagatgctgcccagcaaggacggcagccacaagaacagcgtgctgagccagggcggcgtggccctggtgagcgacatgtgccccgaccccggcatccccgagaacggcagaagagccggcagcgacttcagcagagtgggcgccaacgtgcagttcagctgcgaggacaactacgtgctgcagggcagcaagagcatcacctgccagagagtgaccgagaccctggccgcctggagcgaccacagacccatctgcagagccagaacctgcggcagcaacctgagaggccccagcggcgtgatcaccagccccaactaccccgtgcagtacgaggacaacgcccactgcgtgtgggtgatcaccaccaccgaccccgacaaggtgatcaagctggccttcgaggagttcgagctggagagaggctacgacaccctgaccgtgggcgacgccggcaaggtgggcgacaccagaagcgtgctgtacgtgctgaccggcagcagcgtgcccgacctgatcgtgagcatgagcaaccagatgtggctgcacctgcagagcgacgacagcatcggcagccccggcttcaaggccgtgtaccaggagatcgagaagggcggctgcggcgaccccggcatccccgcctacggcaagagaaccggcagcagcttcctgcacggcgacaccctgaccttcgagtgccccgccgccttcgagctggtgggcgagagagtgatcacctgccagcagaacaaccagtggagcggcaacaagcccagctgcgtgttcagctgcttcttcaacttcaccgccagcagcggcatcatcctgagccccaactaccccgaggagtacggcaacaacatgaactgcgtgtggctgatcatcagcgagcccggcagcagaatccacctgatcttcaacgacttcgacgtggagccccagttcgacttcctggccgtgaaggacgacggcatcagcgacatcaccgtgctgggcaccttcagcggcaacgaggtgcccagccagctggccagcagcggccacatcgtgagactggagttccagagcgaccacagcaccaccggcagaggcttcaacatcacctacaccaccttcggccagaacgagtgccacgaccccggcatccccatcaacggcagaagattcggcgacagattcctgctgggcagcagcgtgagcttccactgcgacgacggcttcgtgaagacccagggcagcgagagcatcacctgcatcctgcaggacggcaacgtggtgtggagcagcaccgtgcccagatgcgaggccccctgcggcggccacctgaccgccagcagcggcgtgatcctgccccccggctggcccggctactacaaggacagcctgcactgcgagtggatcatcgaggccaagcccggccacagcatcaagatcaccttcgacagattccagaccgaggtgaactacgacaccctggaggtgagagacggccccgccagcagcagccccctgatcggcgagtaccacggcacccaggccccccagttcctgatcagcaccggcaacttcatgtacctgctgttcaccaccgacaacagcagaagcagcatcggcttcctgatccactacgagagcgtgaccctggagagcgacagctgcctggaccccggcatccccgtgaacggccacagacacggcggcgacttcggcatcagaagcaccgtgaccttcagctgcgaccccggctacaccctgagcgacgacgagcccctggtgtgcgagagaaaccaccagtggaaccacgccctgcccagctgcgacgccctgtgcggcggctacatccagggcaagagcggcaccgtgctgagccccggcttccccgacttctaccccaacagcctgaactgcacctggaccatcgaggtgagccacggcaagggcgtgcagatgatcttccacaccttccacctggagagcagccacgactacctgctgatcaccgaggacggcagcttcagcgagcccgtggccagactgaccggcagcgtgctgccccacaccatcaaggccggcctgttcggcaacttcaccgcccagctgagattcatcagcgacttcagcatcagctacgagggcttcaacatcaccttcagcgagtacgacctggagccctgcgacgaccccggcgtgcccgccttcagcagaagaatcggcttccacttcggcgtgggcgacagcctgaccttcagctgcttcctgggctacagactggagggcgccaccaagctgacctgcctgggcggcggcagaagagtgtggagcgcccccctgcccagatgcgtggccgagtgcggcgccagcgtgaagggcaacgagggcaccctgctgagccccaacttccccagcaactacgacaacaaccacgagtgcatctacaagatcgagaccgaggccggcaagggcatccacctgagaaccagaagcttccagctgttcgagggcgacaccctgaaggtgtacgacggcaaggacagcagcagcagacccctgggcaccttcaccaagaacgagctgctgggcctgatcctgaacagcaccagcaaccacctgtggctggagttcaacaccaacggcagcgacaccgaccagggcttccagctgacctacaccagcttcgacctggtgaagtgcgaggaccccggcatccccaactacggctacagaatcagagacgagggccacttcaccgacaccgtggtgctgtacagctgcaaccccggctacgccatgcacggcagcaacaccctgacctgcctgagcggcgacagaagagtgtgggacaagcccctgcccagctgcatcgccgagtgcggcggccagatccacgccgccaccagcggcagaatcctgagccccggctaccccgccccctacgacaacaacctgcactgcacctggatcatcgaggccgaccccggcaagaccatcagcctgcacttcatcgtgttcgacaccgagatggcccacgacatcctgaaggtgtgggacggccccgtggacagcgacatcctgctgaaggagtggagcggcagcgccctgcccgaggacatccacagcaccttcaacagcctgaccctgcagttcgacagcgacttcttcatcagcaagagcggcttcagcatccagttcagcaccagcatcgccgccacctgcaacgaccccggcatgccccagaacggcaccagatacggcgacagcagagaggccggcgacaccgtgaccttccagtgcgaccccggctaccagctgcagggccaggccaagatcacctgcgtgcagctgaacaacagattcttctggcagcccgacccccccacctgcatcgccgcctgcggcggcaacctgaccggccccgccggcgtgatcctgagccccaactacccccagccctacccccccggcaaggagtgcgactggagagtgaaggtgaaccccgacttcgtgatcgccctgatcttcaagagcttcaacatggagcccagctacgacttcctgcacatctacgagggcgaggacagcaacagccccctgatcggcagctaccagggcagccaggcccccgagagaatcgagagcagcggcaacagcctgttcctggccttcagaagcgacgccagcgtgggcctgagcggcttcgccatcgagttcaaggagaagcccagagaggcctgcttcgaccccggcaacatcatgaacggcaccagagtgggcaccgacttcaagctgggcagcaccatcacctaccagtgcgacagcggctacaagatcctggaccccagcagcatcacctgcgtgatcggcgccgacggcaagcccagctgggaccaggtgctgcccagctgcaacgccccctgcggcggccagtacaccggcagcgagggcgtggtgctgagccccaactacccccacaactacaccgccggccagatctgcctgtacagcatcaccgtgcccaaggagttcgtggtgttcggccagttcgcctacttccagaccgccctgaacgacctggccgagctgttcgacggcacccacgcccaggccagactgctgagcagcctgagcggcagccacagcggcgagaccctgcccctggccaccagcaaccagatcctgctgagattcagcgccaagagcggcgccagcgccagaggcttccacttcgtgtaccaggccgtgcccagaaccagcgacacccagtgcagcagcgtgcccgagcccagatacggcagaagaatcggcagcgagttcagcgccggcagcatcgtgagattcgagtgcaaccccggctacctgctgcagggcagcaccgccctgcactgccagagcgtgcccaacgccctggcccagtggaacgacaccatccccagctgcgtggtgccctgcagcggcaacttcacccagagaagaggcaccatcctgagccccggctaccccgagccctacggcaacaacctgaactgcatctggaagatcatcgtgaccgagggcagcggcatccagatccaggtgatcagcttcgccaccgagcagaactgggacagcctggagatccacgacggcggcgacgtgaccgcccccagactgggcagcttcagcggcaccaccgtgcccgccctgctgaacagcaccagcaaccagctgtacctgcacttccagagcgacatcagcgtggccgccgccggcttccacctggagtacaagaccgtgggcctggccgcctgccaggagcccgccctgcccagcaacagcatcaagatcggcgacagatacatggtgaacgacgtgctgagcttccagtgcgagcccggctacaccctgcagggcagaagccacatcagctgcatgcccggcaccgtgagaagatggaactaccccagccccctgtgcatcgccacctgcggcggcaccctgagcaccctgggcggcgtgatcctgagccccggcttccccggcagctaccccaacaacctggactgcacctggagaatcagcctgcccatcggctacggcgcccacatccagttcctgaacttcagcaccgaggccaaccacgacttcctggagatccagaacggcccctaccacaccagccccatgatcggccagttcagcggcaccgacctgcccgccgccctgctgagcaccacccacgagaccctgatccacttctacagcgaccacagccagaacagacagggcttcaagctggcctaccaggcctacgagctgcagaactgccccgaccccccccccttccagaacggctacatgatcaacagcgactacagcgtgggccagagcgtgagcttcgagtgctaccccggctacatcctgatcggccaccccgtgctgacctgccagcacggcatcaacagaaactggaactaccccttccccagatgcgacgccccctgcggctacaacgtgaccagccagaacggcaccatctacagccccggcttccccgacgagtaccccatcctgaaggactgcatctggctgatcaccgtgccccccggccacggcgtgtacatcaacttcaccctgctgcagaccgaggccgtgaacgactacatcgccgtgtgggacggccccgaccagaacagcccccagctgggcgtgttcagcggcaacaccgccctggagaccgcctacagcagcaccaaccaggtgctgctgaagttccacagcgacttcagcaacggcggcttcttcgtgctgaacttccacgccttccagctgaagaagtgccagcccccccccgccgtgccccaggccgagatgctgaccgaggacgacgacttcgagatcggcgacttcgtgaagtaccagtgccaccccggctacaccctggtgggcaccgacatcctgacctgcaagctgagcagccagctgcagttcgagggcagcctgcccacctgcgaggcccagtgccccgccaacgaggtgagaaccggcagcagcggcgtgatcctgagccccggctaccccggcaactacttcaacagccagacctgcagctggagcatcaaggtggagcccaactacaacatcaccatcttcgtggacaccttccagagcgagaagcagttcgacgccctggaggtgttcgacggcagcagcggccagagccccctgctggtggtgctgagcggcaaccacaccgagcagagcaacttcaccagcagaagcaaccagctgtacctgagatggagcaccgaccacgccaccagcaagaagggcttcaagatcagatacgccgccccctactgcagcctgacccaccccctgaagaacggcggcatcctgaacagaaccgccggcgccgtgggcagcaaggtgcactacttctgcaagcccggctacagaatggtgggccacagcaacgccacctgcagaagaaaccccctgggcatgtaccagtgggacagcctgacccccctgtgccaggccgtgagctgcggcatccccgagagccccggcaacggcagcttcaccggcaacgagttcaccctggacagcaaggtggtgtacgagtgccacgagggcttcaagctggagagcagccagcaggccaccgccgtgtgccaggaggacggcctgtggagcaacaagggcaagccccccacctgcaagcccgtggcctgccccagcatcgaggcccagctgagcgagcacgtgatctggagactggtgagcggcagcctgaacgagtacggcgcccaggtgctgctgagctgcagccccggctactacctggagggctggagactgctgagatgccaggccaacggcacctggaacatcggcgacgagagacccagctgcagagtgatcagctgcggcagcctgagcttcccccccaacggcaacaagatcggcaccctgaccgtgtacggcgccaccgccatcttcacctgcaacaccggctacaccctggtgggcagccacgtgagagagtgcctggccaacggcctgtggagcggcagcgagaccagatgcctggccggccactgcggcagccccgaccccatcgtgaacggccacatcagcggcgacggcttcagctacagagacaccgtggtgtaccagtgcaaccccggcttcagactggtgggcaccagcgtgagaatctgcctgcaggaccacaagtggagcggccagacccccgtgtgcgtgcccatcacctgcggccaccccggcaaccccgcccacggcttcaccaacggcagcgagttcaacctgaacgacgtggtgaacttcacctgcaacaccggctacctgctgcagggcgtgagcagagcccagtgcagaagcaacggccagtggagcagccccctgcccacctgcagagtggtgaactgcagcgaccccggcttcgtggagaacgccatcagacacggccagcagaacttccccgagagcttcgagtacggcatgagcatcctgtaccactgcaagaagggcttctacctgctgggcagcagcgccctgacctgcatggccaacggcctgtgggacagaagcctgcccaagtgcctggccatcagctgcggccaccccggcgtgcccgccaacgccgtgctgaccggcgagctgttcacctacggcgccgtggtgcactacagctgcagaggcagcgagagcctgatcggcaacgacaccagagtgtgccaggaggacagccactggagcggcgccctgccccactgcaccggcaacaaccccggcttctgcggcgaccccggcacccccgcccacggcagcagactgggcgacgacttcaagaccaagagcctgctgagattcagctgcgagatgggccaccagctgagaggcagccccgagagaacctgcctgctgaacggcagctggagcggcctgcagcccgtgtgcgaggccgtgagctgcggcaaccccggcacccccaccaacggcatgatcgtgagcagcgacggcatcctgttcagcagcagcgtgatctacgcctgctgggagggctacaagaccagcggcctgatgaccagacactgcaccgccaacggcacctggaccggcaccgcccccgactgcaccatcatcagctgcggcgaccccggcaccctggccaacggcatccagttcggcaccgacttcaccttcaacaagaccgtgagctaccagtgcaaccccggctacgtgatggaggccgtgaccagcgccaccatcagatgcaccaaggacggcagatggaaccccagcaagcccgtgtgcaaggccgtgctgtgcccccagcccccccccgtgcagaacggcaccgtggagggcagcgacttcagatggggcagcagcatcagctacagctgcatggacggctaccagctgagccacagcgccatcctgagctgcgagggcagaggcgtgtggaagggcgagatcccccagtgcctgcccgtgttctgcggcgaccccggcatccccgccgagggcagactgagcggcaagagcttcacctacaagagcgaggtgttcttccagtgcaagagccccttcatcctggtgggcagcagcagaagagtgtgccaggccgacggcacctggagcggcatccagcccacctgcatcgaccccgcccacaacacctgccccgaccccggcaccccccacttcggcatccagaacagcagcagaggctacgaggtgggcagcaccgtgttcttcagatgcagaaagggctaccacatccagggcagcaccaccagaacctgcctggccaacctgacctggagcggcatccagaccgagtgcatcccccacgcctgcagacagcccgagacccccgcccacgccgacgtgagagccatcgacctgcccaccttcggctacaccctggtgtacacctgccaccccggcttcttcctggccggcggcagcgagcacagaacctgcaaggccgacatgaagtggaccggcaagagccccgtgtgcaagagcaagggcgtgagagaggtgaacgagaccgtgaccaagacccccgtgcccagcgacgtgttcttcgtgaacagcctgtggaagggctactacgagtacctgggcaagagacagcccgccaccctgaccgtggactggttcaacgccaccagcagcaaggtgaacgccaccttcagcgaggccagccccgtggagctgaagctgaccggcatctacaagaaggaggaggcccacctgctgctgaaggccttccagatcaagggccaggccgacatcttcgtgagcaagttcgagaacgacaactggggcctggacggctacgtgagcagcggcctggagagaggcggcttcaccttccagggcgacatccacggcaaggacttcggcaagttcaagctggagagacaggaccccctgaaccccgaccaggacagcagcagccactaccacggcaccagcagcggcagcgtggccgccgccatcctggtgcccttcttcgccctgatcctgagcggcttcgccttctacctgtacaagcacagaaccagacccaaggtgcagtacaacggctacgccggccacgagaacagcaacggccaggccagcttcgagaaccccatgtacgacaccaacctgaagcccaccgaggccaaggccgtgagattcgacaccaccctgaacaccgtgtgcaccgtggtgtag

SEQ ID NO: 77910 - DNA, 10695 bp, Artificial Sequence
  Description of Artificial Sequence: Synthetic coding sequence
atgaccgcctggagaagattccagagcctgctgctgctgctgggcctgctggtgctgtgcgccagactgctgaccgccgccaagggccagaactgcggcggcctggtgcagggccccaacggcaccatcgagagccccggcttcccccacggctaccccaactacgccaactgcacctggatcatcatcaccggcgagagaaacagaatccagctgagcttccacaccttcgccctggaggaggacttcgacatcctgagcgtgtacgacggccagccccagcagggcaacctgaaggtgagactgagcggcttccagctgcccagcagcatcgtgagcaccggcagcatcctgaccctgtggttcaccaccgacttcgccgtgagcgcccagggcttcaaggccctgtacgaggtgctgcccagccacacctgcggcaaccccggcgagatcctgaagggcgtgctgcacggcaccagattcaacatcggcgacaagatcagatacagctgcctgcccggctacatcctggagggccacgccatcctgacctgcatcgtgagccccggcaacggcgccagctgggacttccccgcccccttctgcagagccgagggcgcctgcggcggcaccctgagaggcaccagcagcagcatcagcagcccccacttccccagcgagtacgagaacaacgccgactgcacctggaccatcctggccgagcccggcgacaccatcgccctggtgttcaccgacttccagctggaggagggctacgacttcctggagatcagcggcaccgaggcccccagcatctggctgaccggcatgaacctgcccagccccgtgatcagcagcaagaactggctgagactgcacttcaccagcgacagcaaccacagaagaaagggcttcaacgcccagttccaggtgaagaaggccatcgagctgaagagcagaggcgtgaagatgctgcccagcaaggacggcagccacaagaacagcgtgctgagccagggcggcgtggccctggtgagcgacatgtgccccgaccccggcatccccgagaacggcagaagagccggcagcgacttcagagtgggcgccaacgtgcagttcagctgcgaggacaactacgtgctgcagggcagcaagagcatcacctgccagagagtgaccgagaccctggccgcctggagcgaccacagacccatctgcagagccagaacctgcggcagcaacctgagaggccccagcggcgtgatcaccagccccaactaccccgtgcagtacgaggacaacgcccactgcgtgtgggtgatcaccaccaccgaccccgacaaggtgatcaagctggccttcgaggagttcgagctggagagaggctacgacaccctgaccgtgggcgacgccggcaaggtgggcgacaccagaagcgtgctgtacgtgctgaccggcagcagcgtgcccgacctgatcgtgagcatgagcaaccagatgtggctgcacctgcagagcgacgacagcatcggcagccccggcttcaaggccgtgtaccaggagatcgagaagggcggctgcggcgaccccggcatccccgcctacggcaagagaaccggcagcagcttcctgcacggcgacaccctgaccttcgagtgccccgccgccttcgagctggtgggcgagagagtgatcacctgccagcagaacaaccagtggagcggcaacaagcccagctgcgtgttcagctgcttcttcaacttcaccgccagcagcggcatcatcctgagccccaactaccccgaggagtacggcaacaacatgaactgcgtgtggctgatcatcagcgagcccggcagcagaatccacctgatcttcaacgacttcgacgtggagccccagttcgacttcctggccgtgaaggacgacggcatcagcgacatcaccgtgctgggcaccttcagcggcaacgaggtgcccagccagctggccagcagcggccacatcgtgagactggagttccagagcgaccacagcaccaccggcagaggcttcaacatcacctacaccaccttcggccagaacgagtgccacgaccccggcatccccatcaacggcagaagattcggcgacagattcctgctgggcagcagcgtgagcttccactgcgacgacggcttcgtgaagacccagggcagcgagagcatcacctgcatcctgcaggacggcaacgtggtgtggagcagcaccgtgcccagatgcgaggccccctgcggcggccacctgaccgccagcagcggcgtgatcctgccccccggctggcccggctactacaaggacagcctgcactgcgagtggatcatcgaggccaagcccggccacagcatcaagatcaccttcgacagattccagaccgaggtgaactacgacaccctggaggtgagagacggccccgccagcagcagccccctgatcggcgagtaccacggcacccaggccccccagttcctgatcagcaccggcaacttcatgtacctgctgttcaccaccgacaacagcagaagcagcatcggcttcctgatccactacgagagcgtgaccctggagagcgacagctgcctggaccccggcatccccgtgaacggccacagacacggcggcgacttcggcatcagaagcaccgtgaccttcagctgcgaccccggctacaccctgagcgacgacgagcccctggtgtgcgagagaaaccaccagtggaaccacgccctgcccagctgcgacgccctgtgcggcggctacatccagggcaagagcggcaccgtgctgagccccggcttccccgacttctaccccaacagcctgaactgcacctggaccatcgaggtgagccacggcaagggcgtgcagatgatcttccacaccttccacctggagagcagccacgactacctgctgatcaccgaggacggcagcttcagcgagcccgtggccagactgaccggcagcgtgctgccccacaccatcaaggccggcctgttcggcaacttcaccgcccagctgagattcatcagcgacttcagcatcagctacgagggcttcaacatcaccttcagcgagtacgacctggagccctgcgacgaccccggcgtgcccgccttcagcagaagaatcggcttccacttcggcgtgggcgacagcctgaccttcagctgcttcctgggctacagactggagggcgccaccaagctgacctgcctgggcggcggcagaagagtgtggagcgcccccctgcccagatgcgtggccgagtgcggcgccagcgtgaagggcaacgagggcaccctgctgagccccaacttccccagcaactacgacaacaaccacgagtgcatctacaagatcgagaccgaggccggcaagggcatccacctgagaaccagaagcttccagctgttcgagggcgacaccctgaaggtgtacgacggcaaggacagcagcagcagacccctgggcaccttcaccaagaacgagctgctgggcctgatcctgaacagcaccagcaaccacctgtggctggagttcaacaccaacggcagcgacaccgaccagggcttccagctgacctacaccagcttcgacctggtgaagtgcgaggaccccggcatccccaactacggctacagaatcagagacgagggccacttcaccgacaccgtggtgctgtacagctgcaaccccggctacgccatgcacggcagcaacaccctgacctgcctgagcggcgacagaagagtgtgggacaagcccctgcccagctgcatcgccgagtgcggcggccagatccacgccgccaccagcggcagaatcctgagccccggctaccccgccccctacgacaacaacctgcactgcacctggatcatcgaggccgaccccggcaagaccatcagcctgcacttcatcgtgttcgacaccgagatggcccacgacatcctgaaggtgtgggacggccccgtggacagcgacatcctgctgaaggagtggagcggcagcgccctgcccgaggacatccacagcaccttcaacagcctgaccctgcagttcgacagcgacttcttcatcagcaagagcggcttcagcatccagttcagcaccagcatcgccgccacctgcaacgaccccggcatgccccagaacggcaccagatacggcgacagcagagaggccggcgacaccgtgaccttccagtgcgaccccggctaccagctgcagggccaggccaagatcacctgcgtgcagctgaacaacagattcttctggcagcccgacccccccacctgcatcgccgcctgcggcggcaacctgaccggccccgccggcgtgatcctgagccccaactacccccagccctacccccccggcaaggagtgcgactggagagtgaaggtgaaccccgacttcgtgatcgccctgatcttcaagagcttcaacatggagcccagctacgacttcctgcacatctacgagggcgaggacagcaacagccccctgatcggcagctaccagggcagccaggcccccgagagaatcgagagcagcggcaacagcctgttcctggccttcagaagcgacgccagcgtgggcctgagcggcttcgccatcgagttcaaggagaagcccagagaggcctgcttcgaccccggcaacatcatgaacggcaccagagtgggcaccgacttcaagctgggcagcaccatcacctaccagtgcgacagcggctacaagatcctggaccccagcagcatcacctgcgtgatcggcgccgacggcaagcccagctgggaccaggtgctgcccagctgcaacgccccctgcggcggccagtacaccggcagcgagggcgtggtgctgagccccaactacccccacaactacaccgccggccagatctgcctgtacagcatcaccgtgcccaaggagttcgtggtgttcggccagttcgcctacttccagaccgccctgaacgacctggccgagctgttcgacggcacccacgcccaggccagactgctgagcagcctgagcggcagccacagcggcgagaccctgcccctggccaccagcaaccagatcctgctgagattcagcgccaagagcggcgccagcgccagaggcttccacttcgtgtaccaggccgtgcccagaaccagcgacacccagtgcagcagcgtgcccgagcccagatacggcagaagaatcggcagcgagttcagcgccggcagcatcgtgagattcgagtgcaaccccggctacctgctgcagggcagcaccgccctgcactgccagagcgtgcccaacgccctggcccagtggaacgacaccatccccagctgcgtggtgccctgcagcggcaacttcacccagagaagaggcaccatcctgagccccggctaccccgagccctacggcaacaacctgaactgcatctggaagatcatcgtgaccgagggcagcggcatccagatccaggtgatcagcttcgccaccgagcagaactgggacagcctggagatccacgacggcggcgacgtgaccgcccccagactgggcagcttcagcggcaccaccgtgcccgccctgctgaacagcaccagcaaccagctgtacctgcacttccagagcgacatcagcgtggccgccgccggcttccacctggagtacaagaccgtgggcctggccgcctgccaggagcccgccctgcccagcaacagcatcaagatcggcgacagatacatggtgaacgacgtgctgagcttccagtgcgagcccggctacaccctgcagggcagaagccacatcagctgcatgcccggcaccgtgagaagatggaactaccccagccccctgtgcatcgccacctgcggcggcaccctgagcaccctgggcggcgtgatcctgagccccggcttccccggcagctaccccaacaacctggactgcacctggagaatcagcctgcccatcggctacggcgcccacatccagttcctgaacttcagcaccgaggccaaccacgacttcctggagatccagaacggcccctaccacaccagccccatgatcggccagttcagcggcaccgacctgcccgccgccctgctgagcaccacccacgagaccctgatccacttctacagcgaccacagccagaacagacagggcttcaagctggcctaccaggcctacgagctgcagaactgccccgaccccccccccttccagaacggctacatgatcaacagcgactacagcgtgggccagagcgtgagcttcgagtgctaccccggctacatcctgatcggccaccccgtgctgacctgccagcacggcatcaacagaaactggaactaccccttccccagatgcgacgccccctgcggctacaacgtgaccagccagaacggcaccatctacagccccggcttccccgacgagtaccccatcctgaaggactgcatctggctgatcaccgtgccccccggccacggcgtgtacatcaacttcaccctgctgcagaccgaggccgtgaacgactacatcgccgtgtgggacggccccgaccagaacagcccccagctgggcgtgttcagcggcaacaccgccctggagaccgcctacagcagcaccaaccaggtgctgctgaagttccacagcgacttcagcaacggcggcttcttcgtgctgaacttccacgccttccagctgaagaagtgccagcccccccccgccgtgccccaggccgagatgctgaccgaggacgacgacttcgagatcggcgacttcgtgaagtaccagtgccaccccggctacaccctggtgggcaccgacatcctgacctgcaagctgagcagccagctgcagttcgagggcagcctgcccacctgcgaggcccagtgccccgccaacgaggtgagaaccggcagcagcggcgtgatcctgagccccggctaccccggcaactacttcaacagccagacctgcagctggagcatcaaggtggagcccaactacaacatcaccatcttcgtggacaccttccagagcgagaagcagttcgacgccctggaggtgttcgacggcagcagcggccagagccccctgctggtggtgctgagcggcaaccacaccgagcagagcaacttcaccagcagaagcaaccagctgtacctgagatggagcaccgaccacgccaccagcaagaagggcttcaagatcagatacgccgccccctactgcagcctgacccaccccctgaagaacggcggcatcctgaacagaaccgccggcgccgtgggcagcaaggtgcactacttctgcaagcccggctacagaatggtgggccacagcaacgccacctgcagaagaaaccccctgggcatgtaccagtgggacagcctgacccccctgtgccaggccgtgagctgcggcatccccgagagccccggcaacggcagcttcaccggcaacgagttcaccctggacagcaaggtggtgtacgagtgccacgagggcttcaagctggagagcagccagcaggccaccgccgtgtgccaggaggacggcctgtggagcaacaagggcaagccccccacctgcaagcccgtggcctgccccagcatcgaggcccagctgagcgagcacgtgatctggagactggtgagcggcagcctgaacgagtacggcgcccaggtgctgctgagctgcagccccggctactacctggagggctggagactgctgagatgccaggccaacggcacctggaacatcggcgacgagagacccagctgcagagtgatcagctgcggcagcctgagcttcccccccaacggcaacaagatcggcaccctgaccgtgtacggcgccaccgccatcttcacctgcaacaccggctacaccctggtgggcagccacgtgagagagtgcctggccaacggcctgtggagcggcagcgagaccagatgcctggccggccactgcggcagccccgaccccatcgtgaacggccacatcagcggcgacggcttcagctacagagacaccgtggtgtaccagtgcaaccccggcttcagactggtgggcaccagcgtgagaatctgcctgcaggaccacaagtggagcggccagacccccgtgtgcgtgcccatcacctgcggccaccccggcaaccccgcccacggcttcaccaacggcagcgagttcaacctgaacgacgtggtgaacttcacctgcaacaccggctacctgctgcagggcgtgagcagagcccagtgcagaagcaacggccagtggagcagccccctgcccacctgcagagtggtgaactgcagcgaccccggcttcgtggagaacgccatcagacacggccagcagaacttccccgagagcttcgagtacggcatgagcatcctgtaccactgcaagaagggcttctacctgctgggcagcagcgccctgacctgcatggccaacggcctgtgggacagaagcctgcccaagtgcctggccatcagctgcggccaccccggcgtgcccgccaacgccgtgctgaccggcgagctgttcacctacggcgccgtggtgcactacagctgcagaggcagcgagagcctgatcggcaacgacaccagagtgtgccaggaggacagccactggagcggcgccctgccccactgcaccggcaacaaccccggcttctgcggcgaccccggcacccccgcccacggcagcagactgggcgacgacttcaagaccaagagcctgctgagattcagctgcgagatgggccaccagctgagaggcagccccgagagaacctgcctgctgaacggcagctggagcggcctgcagcccgtgtgcgaggccgtgagctgcggcaaccccggcacccccaccaacggcatgatcgtgagcagcgacggcatcctgttcagcagcagcgtgatctacgcctgctgggagggctacaagaccagcggcctgatgaccagacactgcaccgccaacggcacctggaccggcaccgcccccgactgcaccatcatcagctgcggcgaccccggcaccctggccaacggcatccagttcggcaccgacttcaccttcaacaagaccgtgagctaccagtgcaaccccggctacgtgatggaggccgtgaccagcgccaccatcagatgcaccaaggacggcagatggaaccccagcaagcccgtgtgcaaggccgtgctgtgcccccagcccccccccgtgcagaacggcaccgtggagggcagcgacttcagatggggcagcagcatcagctacagctgcatggacggctaccagctgagccacagcgccatcctgagctgcgagggcagaggcgtgtggaagggcgagatcccccagtgcctgcccgtgttctgcggcgaccccggcatccccgccgagggcagactgagcggcaagagcttcacctacaagagcgaggtgttcttccagtgcaagagccccttcatcctggtgggcagcagcagaagagtgtgccaggccgacggcacctggagcggcatccagcccacctgcatcgaccccgcccacaacacctgccccgaccccggcaccccccacttcggcatccagaacagcagcagaggctacgaggtgggcagcaccgtgttcttcagatgcagaaagggctaccacatccagggcagcaccaccagaacctgcctggccaacctgacctggagcggcatccagaccgagtgcatcccccacgcctgcagacagcccgagacccccgcccacgccgacgtgagagccatcgacctgcccaccttcggctacaccctggtgtacacctgccaccccggcttcttcctggccggcggcagcgagcacagaacctgcaaggccgacatgaagtggaccggcaagagccccgtgtgcaagagcaagggcgtgagagaggtgaacgagaccgtgaccaagacccccgtgcccagcgacgtgttcttcgtgaacagcctgtggaagggctactacgagtacctgggcaagagacagcccgccaccctgaccgtggactggttcaacgccaccagcagcaaggtgaacgccaccttcagcgaggccagccccgtggagctgaagctgaccggcatctacaagaaggaggaggcccacctgctgctgaaggccttccagatcaagggccaggccgacatcttcgtgagcaagttcgagaacgacaactggggcctggacggctacgtgagcagcggcctggagagaggcggcttcaccttccagggcgacatccacggcaaggacttcggcaagttcaagctggagagacaggaccccctgaaccccgaccaggacagcagcagccactaccacggcaccagcagcggcagcgtggccgccgccatcctggtgcccttcttcgccctgatcctgagcggcttcgccttctacctgtacaagcacagaaccagacccaaggtgcagtacaacggctacgccggccacgagaacagcaacggccaggccagcttcgagaaccccatgtacgacaccaacctgaagcccaccgaggccaaggccgtgagattcgacaccaccctgaacaccgtgtgcaccgtggtgtag

SEQ ID NO: 77911 - DNA, 6330 bp, Artificial Sequence
  Description of Artificial Sequence: Synthetic coding sequence
atgaccgcctggagaagattccagagcctgctgctgctgctgggcctgctggtgctgtgcgccagactgctgaccgccgccaagggccagaactgcggcggcctggtgcagggccccaacggcaccatcgagagccccggcttcccccacggctaccccaactacgccaactgcacctggatcatcatcaccggcgagagaaacagaatccagctgagcttccacaccttcgccctggaggaggacttcgacatcctgagcgtgtacgacggccagccccagcagggcaacctgaaggtgagactgagcggcttccagctgcccagcagcatcgtgagcaccggcagcatcctgaccctgtggttcaccaccgacttcgccgtgagcgcccagggcttcaaggccctgtacgaggtgctgcccagccacacctgcggcaaccccggcgagatcctgaagggcgtgctgcacggcaccagattcaacatcggcgacaagatcagatacagctgcctgcccggctacatcctggagggccacgccatcctgacctgcatcgtgagccccggcaacggcgccagctgggacttccccgcccccttctgcagagccgagggcgcctgcggcggcaccctgagaggcaccagcagcagcatcagcagcccccacttccccagcgagtacgagaacaacgccgactgcacctggaccatcctggccgagcccggcgacaccatcgccctggtgttcaccgacttccagctggaggagggctacgacttcctggagatcagcggcaccgaggcccccagcatctggctgaccggcatgaacctgcccagccccgtgatcagcagcaagaactggctgagactgcacttcaccagcgacagcaaccacagaagaaagggcttcaacgcccagttccaggtgaagaaggccatcgagctgaagagcagaggcgtgaagatgctgcccagcaaggacggcagccacaagaacagcgtgctgagccagggcggcgtggccctggtgagcgacatgtgccccgaccccggcatccccgagaacggcagaagagccggcagcgacttcagagtgggcgccaacgtgcagttcagctgcgaggacaactacgtgctgcagggcagcaagagcatcacctgccagagagtgaccgagaccctggccgcctggagcgaccacagacccatctgcagagccagaacctgcggcagcaacctgagaggccccagcggcgtgatcaccagccccaactaccccgtgcagtacgaggacaacgcccactgcgtgtgggtgatcaccaccaccgaccccgacaaggtgatcaagctggccttcgaggagttcgagctggagagaggctacgacaccctgaccgtgggcgacgccggcaaggtgggcgacaccagaagcgtgctgtacgtgctgaccggcagcagcgtgcccgacctgatcgtgagcatgagcaaccagatgtggctgcacctgcagagcgacgacagcatcggcagccccggcttcaaggccgtgtaccaggagatcgagaagggcggctgcggcgaccccggcatccccgcctacggcaagagaaccggcagcagcttcctgcacggcgacaccctgaccttcgagtgccccgccgccttcgagctggtgggcgagagagtgatcacctgccagcagaacaaccagtggagcggcaacaagcccagctgcgtgttcagctgcttcttcaacttcaccgccagcagcggcatcatcctgagccccaactaccccgaggagtacggcaacaacatgaactgcgtgtggctgatcatcagcgagcccggcagcagaatccacctgatcttcaacgacttcgacgtggagccccagttcgacttcctggccgtgaaggacgacggcatcagcgacatcaccgtgctgggcaccttcagcggcaacgaggtgcccagccagctggccagcagcggccacatcgtgagactggagttccagagcgaccacagcaccaccggcagaggcttcaacatcacctacaccaccttcggccagaacgagtgccacgaccccggcatccccatcaacggcagaagattcggcgacagattcctgctgggcagcagcgtgagcttccactgcgacgacggcttcgtgaagacccagggcagcgagagcatcacctgcatcctgcaggacggcaacgtggtgtggagcagcaccgtgcccagatgcgaggccccctgcggcggccacctgaccgccagcagcggcgtgatcctgccccccggctggcccggctactacaaggacagcctgcactgcgagtggatcatcgaggccaagcccggccacagcatcaagatcaccttcgacagattccagaccgaggtgaactacgacaccctggaggtgagagacggccccgccagcagcagccccctgatcggcgagtaccacggcacccaggccccccagttcctgatcagcaccggcaacttcatgtacctgctgttcaccaccgacaacagcagaagcagcatcggcttcctgatccactacgagagcgtgaccctggagagcgacagctgcctggaccccggcatccccgtgaacggccacagacacggcggcgacttcggcatcagaagcaccgtgaccttcagctgcgaccccggctacaccctgagcgacgacgagcccctggtgtgcgagagaaaccaccagtggaaccacgccctgcccagctgcgacgccctgtgcggcggctacatccagggcaagagcggcaccgtgctgagccccggcttccccgacttctaccccaacagcctgaactgcacctggaccatcgaggtgagccacggcaagggcgtgcagatgatcttccacaccttccacctggagagcagccacgactacctgctgatcaccgaggacggcagcttcagcgagcccgtggccagactgaccggcagcgtgctgccccacaccatcaaggccggcctgttcggcaacttcaccgcccagctgagattcatcagcgacttcagcatcagctacgagggcttcaacatcaccttcagcgagtacgacctggagccctgcgacgaccccggcgtgcccgccttcagcagaagaatcggcttccacttcggcgtgggcgacagcctgaccttcagctgcttcctgggctacagactggagggcgccaccaagctgacctgcctgggcggcggcagaagagtgtggagcgcccccctgcccagatgcgtggccgagtgcggcgccagcgtgaagggcaacgagggcaccctgctgagccccaacttccccagcaactacgacaacaaccacgagtgcatctacaagatcgagaccgaggccggcaagggcatccacctgagaaccagaagcttccagctgttcgagggcgacaccctgaaggtgtacgacggcaaggacagcagcagcagacccctgggcaccttcaccaagaacgagctgctgggcctgatcctgaacagcaccagcaaccacctgtggctggagttcaacaccaacggcagcgacaccgaccagggcttccagctgacctacaccagcttcgacctggtgaagtgcgaggaccccggcatccccaactacggctacagaatcagagacgagggccacttcaccgacaccgtggtgctgtacagctgcaaccccggctacgccatgcacggcagcaacaccctgacctgcctgagcggcgacagaagagtgtgggacaagcccctgcccagctgcatcgccgagtgcggcggccagatccacgccgccaccagcggcagaatcctgagccccggctaccccgccccctacgacaacaacctgcactgcacctggatcatcgaggccgaccccggcaagaccatcagcctgcacttcatcgtgttcgacaccgagatggcccacgacatcctgaaggtgtgggacggccccgtggacagcgacatcctgctgaaggagtggagcggcagcgccctgcccgaggacatccacagcaccttcaacagcctgaccctgcagttcgacagcgacttcttcatcagcaagagcggcttcagcatccagttcagcaccagcatcgccgccacctgcaacgaccccggcatgccccagaacggcaccagatacggcgacagcagagaggccggcgacaccgtgaccttccagtgcgaccccggctaccagctgcagggccaggccaagatcacctgcgtgcagctgaacaacagattcttctggcagcccgacccccccacctgcatcgccgcctgcggcggcaacctgaccggccccgccggcgtgatcctgagccccaactacccccagccctacccccccggcaaggagtgcgactggagagtgaaggtgaaccccgacttcgtgatcgccctgatcttcaagagcttcaacatggagcccagctacgacttcctgcacatctacgagggcgaggacagcaacagccccctgatcggcagctaccagggcagccaggcccccgagagaatcgagagcagcggcaacagcctgttcctggccttcagaagcgacgccagcgtgggcctgagcggcttcgccatcgagttcaaggagaagcccagagaggcctgcttcgaccccggcaacatcatgaacggcaccagagtgggcaccgacttcaagctgggcagcaccatcacctaccagtgcgacagcggctacaagatcctggaccccagcagcatcacctgcgtgatcggcgccgacggcaagcccagctgggaccaggtgctgcccagctgcaacgccccctgcggcggccagtacaccggcagcgagggcgtggtgctgagccccaactacccccacaactacaccgccggccagatctgcctgtacagcatcaccgtgcccaaggagttcgtggtgttcggccagttcgcctacttccagaccgccctgaacgacctggccgagctgttcgacggcacccacgcccaggccagactgctgagcagcctgagcggcagccacagcggcgagaccctgcccctggccaccagcaaccagatcctgctgagattcagcgccaagagcggcgccagcgccagaggcttccacttcgtgtaccaggccgtgcccagaaccagcgacacccagtgcagcagcgtgcccgagcccagatacggcagaagaatcggcagcgagttcagcgccggcagcatcgtgagattcgagtgcaaccccggctacctgctgcagggcagcaccgccctgcactgccagagcgtgcccaacgccctggcccagtggaacgacaccatccccagctgcgtggtgccctgcagcggcaacttcacccagagaagaggcaccatcctgagccccggctaccccgagccctacggcaacaacctgaactgcatctggaagatcatcgtgaccgagggcagcggcatccagatccaggtgatcagcttcgccaccgagcagaactgggacagcctggagatccacgacggcggcgacgtgaccgcccccagactgggcagcttcagcggcaccaccgtgcccgccctgctgaacagcaccagcaaccagctgtacctgcacttccagagcgacatcagcgtggccgccgccggcttccacctggagtacaagaccgtgggcctggccgcctgccaggagcccgccctgcccagcaacagcatcaagatcggcgacagatacatggtgaacgacgtgctgagcttccagtgcgagcccggctacaccctgcagggcagaagccacatcagctgcatgcccggcaccgtgagaagatggaactaccccagccccctgtgcatcgccacctgcggcggcaccctgagcaccctgggcggcgtgatcctgagccccggcttccccggcagctaccccaacaacctggactgcacctggagaatcagcctgcccatcggctacggcgcccacatccagttcctgaacttcagcaccgaggccaaccacgacttcctggagatccagaacggcccctaccacaccagccccatgatcggccagttcagcggcaccgacctgcccgccgccctgctgagcaccacccacgagaccctgatccacttctacagcgaccacagccagaacagacagggcttcaagctggcctaccagggcggcagcggcaacatcggccccgccttcccctgcctggacacccccttccaggccagatgccagggcgaggagagaaccttcaactag

SEQ ID NO: 77912 - DNA, 10164 bp, Artificial Sequence
  Description of Artificial Sequence: Synthetic coding sequence
atgaccgcctggagaagattccagagcctgctgctgctgctgggcctgctggtgctgtgcgccagactgctgaccgccgccaagggccagaactgcggcggcctggtgcagggccccaacggcaccatcgagagccccggcttcccccacggctaccccaactacgccaactgcacctggatcatcatcaccggcgagagaaacagaatccagctgagcttccacaccttcgccctggaggaggacttcgacatcctgagcgtgtacgacggccagccccagcagggcaacctgaaggtgagactgagcggcttccagctgcccagcagcatcgtgagcaccggcagcatcctgaccctgtggttcaccaccgacttcgccgtgagcgcccagggcttcaaggccctgtacgaggtgctgcccagccacacctgcggcaaccccggcgagatcctgaagggcgtgctgcacggcaccagattcaacatcggcgacaagatcagatacagctgcctgcccggctacatcctggagggccacgccatcctgacctgcatcgtgagccccggcaacggcgccagctgggacttccccgcccccttctgcagagccgagggcgcctgcggcggcaccctgagaggcaccagcagcagcatcagcagcccccacttccccagcgagtacgagaacaacgccgactgcacctggaccatcctggccgagcccggcgacaccatcgccctggtgttcaccgacttccagctggaggagggctacgacttcctggagatcagcggcaccgaggcccccagcatctggctgaccggcatgaacctgcccagccccgtgatcagcagcaagaactggctgagactgcacttcaccagcgacagcaaccacagaagaaagggcttcaacgcccagttccaggtgaagaaggccatcgagctgaagagcagaggcgtgaagatgctgcccagcaaggacggcagccacaagaacagcgtgctgagccagggcggcgtggccctggtgagcgacatgtgccccgaccccggcatccccgagaacggcagaagagccggcagcgacttcagagtgggcgccaacgtgcagttcagctgcgaggacaactacgtgctgcagggcagcaagagcatcacctgccagagagtgaccgagaccctggccgcctggagcgaccacagacccatctgcagagccagaacctgcggcagcaacctgagaggccccagcggcgtgatcaccagccccaactaccccgtgcagtacgaggacaacgcccactgcgtgtgggtgatcaccaccaccgaccccgacaaggtgatcaagctggccttcgaggagttcgagctggagagaggctacgacaccctgaccgtgggcgacgccggcaaggtgggcgacaccagaagcgtgctgtacgtgctgaccggcagcagcgtgcccgacctgatcgtgagcatgagcaaccagatgtggctgcacctgcagagcgacgacagcatcggcagccccggcttcaaggccgtgtaccaggagatcgagaagggcggctgcggcgaccccggcatccccgcctacggcaagagaaccggcagcagcttcctgcacggcgacaccctgaccttcgagtgccccgccgccttcgagctggtgggcgagagagtgatcacctgccagcagaacaaccagtggagcggcaacaagcccagctgcgtgttcagctgcttcttcaacttcaccgccagcagcggcatcatcctgagccccaactaccccgaggagtacggcaacaacatgaactgcgtgtggctgatcatcagcgagcccggcagcagaatccacctgatcttcaacgacttcgacgtggagccccagttcgacttcctggccgtgaaggacgacggcatcagcgacatcaccgtgctgggcaccttcagcggcaacgaggtgcccagccagctggccagcagcggccacatcgtgagactggagttccagagcgaccacagcaccaccggcagaggcttcaacatcacctacaccaccttcggccagaacgagtgccacgaccccggcatccccatcaacggcagaagattcggcgacagattcctgctgggcagcagcgtgagcttccactgcgacgacggcttcgtgaagacccagggcagcgagagcatcacctgcatcctgcaggacggcaacgtggtgtggagcagcaccgtgcccagatgcgaggccccctgcggcggccacctgaccgccagcagcggcgtgatcctgccccccggctggcccggctactacaaggacagcctgcactgcgagtggatcatcgaggccaagcccggccacagcatcaagatcaccttcgacagattccagaccgaggtgaactacgacaccctggaggtgagagacggccccgccagcagcagccccctgatcggcgagtaccacggcacccaggccccccagttcctgatcagcaccggcaacttcatgtacctgctgttcaccaccgacaacagcagaagcagcatcggcttcctgatccactacgagagcgtgaccctggagagcgacagctgcctggaccccggcatccccgtgaacggccacagacacggcggcgacttcggcatcagaagcaccgtgaccttcagctgcgaccccggctacaccctgagcgacgacgagcccctggtgtgcgagagaaaccaccagtggaaccacgccctgcccagctgcgacgccctgtgcggcggctacatccagggcaagagcggcaccgtgctgagccccggcttccccgacttctaccccaacagcctgaactgcacctggaccatcgaggtgagccacggcaagggcgtgcagatgatcttccacaccttccacctggagagcagccacgactacctgctgatcaccgaggacggcagcttcagcgagcccgtggccagactgaccggcagcgtgctgccccacaccatcaaggccggcctgttcggcaacttcaccgcccagctgagattcatcagcgacttcagcatcagctacgagggcttcaacatcaccttcagcgagtacgacctggagccctgcgacgaccccggcgtgcccgccttcagcagaagaatcggcttccacttcggcgtgggcgacagcctgaccttcagctgcttcctgggctacagactggagggcgccaccaagctgacctgcctgggcggcggcagaagagtgtggagcgcccccctgcccagatgcgtggccgagtgcggcgccagcgtgaagggcaacgagggcaccctgctgagccccaacttccccagcaactacgacaacaaccacgagtgcatctacaagatcgagaccgaggccggcaagggcatccacctgagaaccagaagcttccagctgttcgagggcgacaccctgaaggtgtacgacggcaaggacagcagcagcagacccctgggcaccttcaccaagaacgagctgctgggcctgatcctgaacagcaccagcaaccacctgtggctggagttcaacaccaacggcagcgacaccgaccagggcttccagctgacctacaccagcttcgacctggtgaagtgcgaggaccccggcatccccaactacggctacagaatcagagacgagggccacttcaccgacaccgtggtgctgtacagctgcaaccccggctacgccatgcacggcagcaacaccctgacctgcctgagcggcgacagaagagtgtgggacaagcccctgcccagctgcatcgccgagtgcggcggccagatccacgccgccaccagcggcagaatcctgagccccggctaccccgccccctacgacaacaacctgcactgcacctggatcatcgaggccgaccccggcaagaccatcagcctgcacttcatcgtgttcgacaccgagatggcccacgacatcctgaaggtgtgggacggccccgtggacagcgacatcctgctgaaggagtggagcggcagcgccctgcccgaggacatccacagcaccttcaacagcctgaccctgcagttcgacagcgacttcttcatcagcaagagcggcttcagcatccagttcagcaccagcatcgccgccacctgcaacgaccccggcatgccccagaacggcaccagatacggcgacagcagagaggccggcgacaccgtgaccttccagtgcgaccccggctaccagctgcagggccaggccaagatcacctgcgtgcagctgaacaacagattcttctggcagcccgacccccccacctgcatcgccgcctgcggcggcaacctgaccggccccgccggcgtgatcctgagccccaactacccccagccctacccccccggcaaggagtgcgactggagagtgaaggtgaaccccgacttcgtgatcgccctgatcttcaagagcttcaacatggagcccagctacgacttcctgcacatctacgagggcgaggacagcaacagccccctgatcggcagctaccagggcagccaggcccccgagagaatcgagagcagcggcaacagcctgttcctggccttcagaagcgacgccagcgtgggcctgagcggcttcgccatcgagttcaaggagaagcccagagaggcctgcttcgaccccggcaacatcatgaacggcaccagagtgggcaccgacttcaagctgggcagcaccatcacctaccagtgcgacagcggctacaagatcctggaccccagcagcatcacctgcgtgatcggcgccgacggcaagcccagctgggaccaggtgctgcccagctgcaacgccccctgcggcggccagtacaccggcagcgagggcgtggtgctgagccccaactacccccacaactacaccgccggccagatctgcctgtacagcatcaccgtgcccaaggagttcgtggtgttcggccagttcgcctacttccagaccgccctgaacgacctggccgagctgttcgacggcacccacgcccaggccagactgctgagcagcctgagcggcagccacagcggcgagaccctgcccctggccaccagcaaccagatcctgctgagattcagcgccaagagcggcgccagcgccagaggcttccacttcgtgtaccaggccgtgcccagaaccagcgacacccagtgcagcagcgtgcccgagcccagatacggcagaagaatcggcagcgagttcagcgccggcagcatcgtgagattcgagtgcaaccccggctacctgctgcagggcagcaccgccctgcactgccagagcgtgcccaacgccctggcccagtggaacgacaccatccccagctgcgtggtgccctgcagcggcaacttcacccagagaagaggcaccatcctgagccccggctaccccgagccctacggcaacaacctgaactgcatctggaagatcatcgtgaccgagggcagcggcatccagatccaggtgatcagcttcgccaccgagcagaactgggacagcctggagatccacgacggcggcgacgtgaccgcccccagactgggcagcttcagcggcaccaccgtgcccgccctgctgaacagcaccagcaaccagctgtacctgcacttccagagcgacatcagcgtggccgccgccggcttccacctggagtacaagaccgtgggcctggccgcctgccaggagcccgccctgcccagcaacagcatcaagatcggcgacagatacatggtgaacgacgtgctgagcttccagtgcgagcccggctacaccctgcagggcagaagccacatcagctgcatgcccggcaccgtgagaagatggaactaccccagccccctgtgcatcgccacctgcggcggcaccctgagcaccctgggcggcgtgatcctgagccccggcttccccggcagctaccccaacaacctggactgcacctggagaatcagcctgcccatcggctacggcgcccacatccagttcctgaacttcagcaccgaggccaaccacgacttcctggagatccagaacggcccctaccacaccagccccatgatcggccagttcagcggcaccgacctgcccgccgccctgctgagcaccacccacgagaccctgatccacttctacagcgaccacagccagaacagacagggcttcaagctggcctaccaggcctacgagctgcagaactgccccgaccccccccccttccagaacggctacatgatcaacagcgactacagcgtgggccagagcgtgagcttcgagtgctaccccggctacatcctgatcggccaccccgtgctgacctgccagcacggcatcaacagaaactggaactaccccttccccagatgcgacgccccctgcggctacaacgtgaccagccagaacggcaccatctacagccccggcttccccgacgagtaccccatcctgaaggactgcatctggctgatcaccgtgccccccggccacggcgtgtacatcaacttcaccctgctgcagaccgaggccgtgaacgactacatcgccgtgtgggacggccccgaccagaacagcccccagctgggcgtgttcagcggcaacaccgccctggagaccgcctacagcagcaccaaccaggtgctgctgaagttccacagcgacttcagcaacggcggcttcttcgtgctgaacttccacgccttccagctgaagaagtgccagcccccccccgccgtgccccaggccgagatgctgaccgaggacgacgacttcgagatcggcgacttcgtgaagtaccagtgccaccccggctacaccctggtgggcaccgacatcctgacctgcaagctgagcagccagctgcagttcgagggcagcctgcccacctgcgaggcccagtgccccgccaacgaggtgagaaccggcagcagcggcgtgatcctgagccccggctaccccggcaactacttcaacagccagacctgcagctggagcatcaaggtggagcccaactacaacatcaccatcttcgtggacaccttccagagcgagaagcagttcgacgccctggaggtgttcgacggcagcagcggccagagccccctgctggtggtgctgagcggcaaccacaccgagcagagcaacttcaccagcagaagcaaccagctgtacctgagatggagcaccgaccacgccaccagcaagaagggcttcaagatcagatacgccgccccctactgcagcctgacccaccccctgaagaacggcggcatcctgaacagaaccgccggcgccgtgggcagcaaggtgcactacttctgcaagcccggctacagaatggtgggccacagcaacgccacctgcagaagaaaccccctgggcatgtaccagtgggacagcctgacccccctgtgccaggccgtgagctgcggcatccccgagagccccggcaacggcagcttcaccggcaacgagttcaccctggacagcaaggtggtgtacgagtgccacgagggcttcaagctggagagcagccagcaggccaccgccgtgtgccaggaggacggcctgtggagcaacaagggcaagccccccacctgcaagcccgtggcctgccccagcatcgaggcccagctgagcgagcacgtgatctggagactggtgagcggcagcctgaacgagtacggcgcccaggtgctgctgagctgcagccccggctactacctggagggctggagactgctgagatgccaggccaacggcacctggaacatcggcgacgagagacccagctgcagagccggccactgcggcagccccgaccccatcgtgaacggccacatcagcggcgacggcttcagctacagagacaccgtggtgtaccagtgcaaccccggcttcagactggtgggcaccagcgtgagaatctgcctgcaggaccacaagtggagcggccagacccccgtgtgcgtgcccatcacctgcggccaccccggcaaccccgcccacggcttcaccaacggcagcgagttcaacctgaacgacgtggtgaacttcacctgcaacaccggctacctgctgcagggcgtgagcagagcccagtgcagaagcaacggccagtggagcagccccctgcccacctgcagagtggtgaactgcagcgaccccggcttcgtggagaacgccatcagacacggccagcagaacttccccgagagcttcgagtacggcatgagcatcctgtaccactgcaagaagggcttctacctgctgggcagcagcgccctgacctgcatggccaacggcctgtgggacagaagcctgcccaagtgcctggccatcagctgcggccaccccggcgtgcccgccaacgccgtgctgaccggcgagctgttcacctacggcgccgtggtgcactacagctgcagaggcagcgagagcctgatcggcaacgacaccagagtgtgccaggaggacagccactggagcggcgccctgccccactgcaccggcaacaaccccggcttctgcggcgaccccggcacccccgcccacggcagcagactgggcgacgacttcaagaccaagagcctgctgagattcagctgcgagatgggccaccagctgagaggcagccccgagagaacctgcctgctgaacggcagctggagcggcctgcagcccgtgtgcgaggccgtgctgtgcccccagcccccccccgtgcagaacggcaccgtggagggcagcgacttcagatggggcagcagcatcagctacagctgcatggacggctaccagctgagccacagcgccatcctgagctgcgagggcagaggcgtgtggaagggcgagatcccccagtgcctgcccgtgttctgcggcgaccccggcatccccgccgagggcagactgagcggcaagagcttcacctacaagagcgaggtgttcttccagtgcaagagccccttcatcctggtgggcagcagcagaagagtgtgccaggccgacggcacctggagcggcatccagcccacctgcatcgaccccgcccacaacacctgccccgaccccggcaccccccacttcggcatccagaacagcagcagaggctacgaggtgggcagcaccgtgttcttcagatgcagaaagggctaccacatccagggcagcaccaccagaacctgcctggccaacctgacctggagcggcatccagaccgagtgcatcccccacgcctgcagacagcccgagacccccgcccacgccgacgtgagagccatcgacctgcccaccttcggctacaccctggtgtacacctgccaccccggcttcttcctggccggcggcagcgagcacagaacctgcaaggccgacatgaagtggaccggcaagagccccgtgtgcaagagcaagggcgtgagagaggtgaacgagaccgtgaccaagacccccgtgcccagcgacgtgttcttcgtgaacagcctgtggaagggctactacgagtacctgggcaagagacagcccgccaccctgaccgtggactggttcaacgccaccagcagcaaggtgaacgccaccttcagcgaggccagccccgtggagctgaagctgaccggcatctacaagaaggaggaggcccacctgctgctgaaggccttccagatcaagggccaggccgacatcttcgtgagcaagttcgagaacgacaactggggcctggacggctacgtgagcagcggcctggagagaggcggcttcaccttccagggcgacatccacggcaaggacttcggcaagttcaagctggagagacaggaccccctgaaccccgaccaggacagcagcagccactaccacggcaccagcagcggcagcgtggccgccgccatcctggtgcccttcttcgccctgatcctgagcggcttcgccttctacctgtacaagcacagaaccagacccaaggtgcagtacaacggctacgccggccacgagaacagcaacggccaggccagcttcgagaaccccatgtacgacaccaacctgaagcccaccgaggccaaggccgtgagattcgacaccaccctgaacaccgtgtgcaccgtggtgtag

SEQ ID NO: 77913 - DNA, 10464 bp, Artificial Sequence
  Description of Artificial Sequence: Synthetic coding sequence
atgagactgatcagcatcgcccccggccccagatggcaggtgcagagccaccaccccagaagcgccggccagaactgcaccttccagctgcacggccccaacggcaccgtggagagccccggcttcccctacggctaccccaactacgccaactgcacctggaccatcaccgccgaggagcagcacagaatccagctggtgttccagagcttcgccctggaggaggacttcgacgtgctgagcgtgttcgacggccccccccagcccgagaacctgagaaccagactgaccggcttccagctgcccgccaccatcgtgagcgccgccaccaccctgagcctgagactgatcagcgactacgccgtgagcgcccagggcttccacgccacctacgaggtgctgcccagccacacctgcggcaaccccggcagactgcccaacggcatccagcagggcagcaccttcaacctgggcgacaaggtgagatacagctgcaacctgggcttcttcctggagggccacgccgtgctgacctgccacgccggcagcgagaacagcgccacctgggacttccccctgcccagctgcagagccgacgacgcctgcggcggcaccctgagaggccagagcggcatcatcagcagcccccacttccccagcgagtaccacaacaacgccgactgcacctggaccatcctggccgagctgggcgacaccatcgccctggtgttcatcgacttccagctggaggacggctacgacttcctggaggtgaccggcaccgagggcagcagcctgtggttcaccggcgccagcctgcccgcccccgtgatcagcagcaagaactggctgagactgcacttcaccagcgacggcaaccacagacagagaggcttcagcgcccagtaccaggtgaagaagcagatcgagctgaagagcagaggcgtgaagctgatgcccagcaaggacaacagccagaagaccagcgtgctgacccaggtgggcgtgagccagggccacaacatgtgccccgaccccggcatccccgagagaggcaagagactgggcagcgacttcagactgggcagcagcgtgcagttcacctgcaacgagggctacgacctgcagggcagcaagagaatcacctgcatgaaggtgagcgacatgttcgccgcctggagcgaccacagacccgtgtgcagagccagaatgtgcgacgcccacctgagaggccccagcggcatcatcaccagccccaacttccccatccagtacgacaacaacgcccactgcgtgtggatcatcaccgccctgaaccccagcaaggtgatcaagctggccttcgaggagttcgacctggagagaggctacgacaccctgaccgtgggcgacggcggccaggacggcgaccagaagaccgtgctgtacatcctgaccggcaccagcgtgcccgacctgatcgtgagcaccaaccaccagatgtggctgctgttccagaccgacggcagcggcagcagcctgggcttcaaggccagctacgaggagatcgagcagggcagctgcggcgaccccggcatccccgcctacggcagaagagagggcagcagattccaccacggcgacaccctgaagttcgagtgccagcccgccttcgagctggtgggccagaaggccatcacctgccagaagaacaaccagtggagcgccaagaagcccggctgcgtgttcagctgcttcttcaacttcaccagccccagcggcgtggtgctgagccccaactaccccgaggactacggcaaccacctgcactgcgtgtggctgatcctggccagacccgagagcagaatccacctggccttcaacgacatcgacgtggagccccagttcgacttcctggtgatcaaggacggcgccaccgccgaggcccccgtgctgggcaccttcagcggcaaccagctgcccagcagcatcaccagcagcggccacgtggccagactggagttccagaccgaccacagcaccggcaagagaggcttcaacatcaccttcaccaccttcagacacaacgagtgccccgaccccggcgtgcccgtgaacggcaagagattcggcgacagcctgcagctgggcagcagcatcagcttcctgtgcgacgagggcttcctgggcacccagggcagcgagaccatcacctgcgtgctgaaggagggcagcgtggtgtggaacagcgccgtgctgagatgcgaggccccctgcggcggccacctgaccagccccagcggcaccatcctgagccccggctggcccggcttctacaaggacgccctgagctgcgcctgggtgatcgaggcccagcccggctaccccatcaagatcaccttcgacagattcaagaccgaggtgaactacgacaccctggaggtgagagacggcagaacctacagcgcccccctgatcggcgtgtaccacggcacccaggtgccccagttcctgatcagcaccagcaactacctgtacctgctgttcagcaccgacaagagccacagcgacatcggcttccagctgagatacgagaccatcaccctgcagagcgaccactgcctggaccccggcatccccgtgaacggccagagacacggcaacgacttctacgtgggcgccctggtgaccttcagctgcgacagcggctacaccctgagcgacggcgagcccctggagtgcgagcccaacttccagtggagcagagccctgcccagctgcgaggccctgtgcggcggcttcatccagggcagcagcggcaccatcctgagccccggcttccccgacttctaccccaacaacctgaactgcacctggatcatcgagaccagccacggcaagggcgtgttcttcaccttccacaccttccacctggagagcggccacgactacctgctgatcaccgagaacggcagcttcacccagcccctgagacagctgaccggcagcagactgcccgcccccatcagcgccggcctgtacggcaacttcaccgcccaggtgagattcatcagcgacttcagcatgagctacgagggcttcaacatcaccttcagcgagtacgacctggagccctgcgaggagcccgaggtgcccgcctacagcatcagaaagggcctgcagttcggcgtgggcgacaccctgaccttcagctgcttccccggctacagactggagggcaccgccagaatcacctgcctgggcggcagaagaagactgtggagcagccccctgcccagatgcgtggccgagtgcggcaacagcgtgaccggcacccagggcaccctgctgagccccaacttccccgtgaactacaacaacaaccacgagtgcatctacagcatccagacccagcccggcaagggcatccagctgaaggccagagccttcgagctgagcgagggcgacgtgctgaaggtgtacgacggcaacaacaacagcgccagactgctgggcgtgttcagccacagcgagatgatgggcgtgaccctgaacagcaccagcagcagcctgtggctggacttcatcaccgacgccgagaacaccagcaagggcttcgagctgcacttcagcagcttcgagctgatcaagtgcgaggaccccggcacccccaagttcggctacaaggtgcacgacgagggccacttcgccggcagcagcgtgagcttcagctgcgaccccggctacagcctgagaggcagcgaggagctgctgtgcctgagcggcgagagaagaacctgggacagacccctgcccacctgcgtggccgagtgcggcggcaccgtgagaggcgaggtgagcggccaggtgctgagccccggctaccccgccccctacgagcacaacctgaactgcatctggaccatcgaggccgaggccggctgcaccatcggcctgcacttcctggtgttcgacaccgaggaggtgcacgacgtgctgagaatctgggacggccccgtggagagcggcgtgctgctgaaggagctgagcggccccgccctgcccaaggacctgcacagcaccttcaacagcgtggtgctgcagttcagcaccgacttcttcaccagcaagcagggcttcgccatccagttcagcgtgagcaccgccaccagctgcaacgaccccggcatcccccagaacggcagcagaagcggcgacagctgggaggccggcgacagcaccgtgttccagtgcgaccccggctacgccctgcagggcagcgccgagatcagctgcgtgaagatcgagaacagattcttctggcagcccagcccccccacctgcatcgccccctgcggcggcgacctgaccggccccagcggcgtgatcctgagccccaactaccccgagccctacccccccggcaaggagtgcgactggaaggtgaccgtgagccccgactacgtgatcgccctggtgttcaacatcttcaacctggagcccggctacgacttcctgcacatctacgacggcagagacagcctgagccccctgatcggcagcttctacggcagccagctgcccggcagaatcgagagcagcagcaacagcctgttcctggccttcagaagcgacgccagcgtgagcaacgccggcttcgtgatcgactacaccgagaaccccagagagagctgcttcgaccccggcagcatcaagaacggcaccagagtgggcagcgacctgaagctgggcagcagcgtgacctactactgccacggcggctacgaggtggagggcaccagcaccctgagctgcatcctgggccccgacggcaagcccgtgtggaacaaccccagacccgtgtgcaccgccccctgcggcggccagtacgtgggcagcgacggcgtggtgctgagccccaactacccccagaactacaccagcggccagatctgcctgtacttcgtgaccgtgcccaaggactacgtggtgttcggccagttcgccttcttccacaccgccctgaacgacgtggtggaggtgcacgacggccacagccagcacagcagactgctgagcagcctgagcggcagccacaccggcgagagcctgcccctggccaccagcaaccaggtgctgatcaagttcagcgccaagggcctggcccccgccagaggcttccacttcgtgtaccaggccgtgcccagaaccagcgccacccagtgcagcagcgtgcccgagcccagatacggcaagagactgggcagcgacttcagcgtgggcgccatcgtgagattcgagtgcaacagcggctacgccctgcagggcagccccgagatcgagtgcctgcccgtgcccggcgccctggcccagtggaacgtgagcgcccccacctgcgtggtgccctgcggcggcaacctgaccgagagaagaggcaccatcctgagccccggcttccccgagccctacctgaacagcctgaactgcgtgtggaagatcgtggtgcccgagggcgccggcatccagatccaggtggtgagcttcgtgaccgagcagaactgggacagcctggaggtgttcgacggcgccgacaacaccgtgaccatgctgggcagcttcagcggcaccaccgtgcccgccctgctgaacagcaccagcaaccagctgtacctgcacttctacagcgacatcagcgtgagcgccgccggcttccacctggagtacaagaccgtgggcctgagcagctgccccgagcccgccgtgcccagcaacggcgtgaagaccggcgagagatacctggtgaacgacgtggtgagcttccagtgcgagcccggctacgccctgcagggccacgcccacatcagctgcatgcccggcaccgtgagaagatggaactaccccccccccctgtgcatcgcccagtgcggcggcaccgtggaggagatggagggcgtgatcctgagccccggcttccccggcaactaccccagcaacatggactgcagctggaagatcgccctgcccgtgggcttcggcgcccacatccagttcctgaacttcagcaccgagcccaaccacgactacatcgagatcagaaacggcccctacgagaccagcagaatgatgggcagattcagcggcagcgagctgcccagcagcctgctgagcaccagccacgagaccaccgtgtacttccacagcgaccacagccagaacagacccggcttcaagctggagtaccaggacctgacctacagccaccagatcagcagcttcctgagaggcttcgacctgagcgagctggagagaaccaacagcaccccccccgtggccgccagctacgtgtgggacctggaccccggctgcgaggcctacgagctgcaggagtgccccgaccccgagcccttcgccaacggcatcgtgagaggcgccggctacaacgtgggccagagcgtgaccttcgagtgcctgcccggctaccagctgaccggccaccccgtgctgacctgccagcacggcaccaacagaaactgggaccaccccctgcccaagtgcgaggtgccctgcggcggcaacatcaccagcagcaacggcaccgtgtacagccccggcttccccagcccctacagcagcagccaggactgcgtgtggctgatcaccgtgcccatcggccacggcgtgagactgaacctgagcctgctgcagaccgagcccagcggcgacttcatcaccatctgggacggcccccagcagaccgcccccagactgggcgtgttcaccagaagcatggccaagaagaccgtgcagagcagcagcaaccaggtgctgctgaagttccacagagacgccgccaccggcggcatcttcgccatcgccttcagcgcctaccccctgaccaagtgccccccccccaccatcctgcccaacgccgaggtggtgaccgagaacgaggagttcaacatcggcgacatcgtgagatacagatgcctgcccggcttcaccctggtgggcaacgagatcctgacctgcaagctgggcacctacctgcagttcgagggccccccccccatctgcgaggtgcactgccccaccaacgagctgctgaccgacagcaccggcgtgatcctgagccagagctaccccggcagctacccccagttccagacctgcagctggctggtgagagtggagcccgactacaacatcagcctgaccgtggagtacttcctgagcgagaagcagtacgacgagttcgagatcttcgacggccccagcggccagagccccctgctgaaggccctgagcggcaactacagcgcccccctgatcgtgaccagcagcagcaacagcgtgtacctgagatggagcagcgaccacgcctacaacagaaagggcttcaagatcagatacagcgccccctactgcagcctgcccagagcccccctgcacggcttcatcctgggccagaccagcacccagcccggcggcagcatccacttcggctgcaacgccggctacagactggtgggccacagcatggccatctgcaccagacacccccagggctaccacctgtggagcgaggccatccccctgtgccaggccctgagctgcggcctgcccgaggcccccaagaacggcatggtgttcggcaaggagtacaccgtgggcaccaaggccatgtacagctgcagcgagggctaccacctgcaggccggcgccgaggccaccgccgagtgcctggacaccggcctgtggagcaacagaaacgtgcccccccagtgcgtgcccgtgacctgccccgacgtgagcagcatcagcgtggagcacggcagatggagactgatcttcgagacccagtaccagttccaggcccagctgatgctgatctgcgaccccggctactactacaccggccagagagtgatcagatgccaggccaacggcaagtggagcctgggcgacagcacccccacctgcagaatcatcagctgcggcgagctgcccatcccccccaacggccacagaatcggcaccctgagcgtgtacggcgccaccgccatcttcagctgcaacagcggctacaccctggtgggcagcagagtgagagagtgcatggccaacggcctgtggagcggcagcgaggtgagatgcctggccggccactgcggcacccccgagcccatcgtgaacggccacatcaacggcgagaactacagctacagaggcagcgtggtgtaccagtgcaacgccggcttcagactgatcggcatgagcgtgagaatctgccagcaggaccaccactggagcggcaagacccccttctgcgtgctggtgagctgcggccaccccggcagccccccccacagccagatgagcggcgacagctacaccgtgggcgccgtggtgagatacagctgcatcggcaagagaaccctggtgggcaacagcaccagaatgtgcggcctggacggccactggaccggcagcctgccccactgcagcggcaccagcgtgggcgtgtgcggcgaccccggcatccccgcccacggcatcagactgggcgacagcttcgaccccggcaccgtgatgagattcagctgcgaggccggccacgtgctgagaggcagcagcgagagaacctgccaggccaacggcagctggagcggcagccagcccgagtgcggcgtgatcagctgcggcaaccccggcacccccagcaacgccagagtggtgttcagcgacggcctggtgttcagcagcagcatcgtgtacgagtgcagagagggctactacgccaccggcctgctgagcagacactgcagcgtgaacggcacctggaccggcagcgaccccgagtgcctggtgatcaactgcggcgaccccggcatccccgccaacggcctgagactgggcaacgacttcagatacaacaagaccgtgacctaccagtgcgtgcccggctacatgatggagagccacagagtgagcgtgctgagctgcaccaaggacagaacctggaacggcaccaagcccgtgtgcaaggccctgatgtgcaagcccccccccctgatccccaacggcaaggtggtgggcagcgacttcatgtggggcagcagcgtgacctacgcctgcctggagggctaccagctgagcctgcccgccgtgttcacctgcgagggcaacggcagctggaccggcgagctgccccagtgcttccccgtgttctgcggcgaccccggcgtgcccagcagaggcagaagagaggacagaggcttcagctacagaagcagcgtgagcttcagctgccacccccccctggtgctggtgggcagccccagaagattctgccagagcgacggcacctggagcggcacccagcccagctgcatcgaccccaccctgaccacctgcgccgaccccggcgtgccccagttcggcatccagaacaacagccagggctaccaggtgggcagcaccgtgctgttcagatgccagaagggctacctgctgcagggcagcaccaccagaacctgcctgcccaacctgacctggagcggcaccccccccgactgcgtgccccaccactgcagacagcccgagacccccacccacgccaacgtgggcgccctggacctgcccagcatgggctacaccctgatctacagctgccaggagggcttcagcctgaagggcggcagcgagcacagaacctgcaaggccgacggcagctggaccggcaagccccccatctgcctggaggtgagacccagcggcagacccatcaacaccgccagagagccccccctgacccaggccctgatccccggcgacgtgttcgccaagaacagcctgtggaagggcgcctacgagtaccagggcaagaagcagcccgccatgctgagagtgaccggcttccaggtggccaacagcaaggtgaacgccaccatgatcgaccacagcggcgtggagctgcacctggccggcacctacaagaaggaggacttccacctgctgctgcaggtgtaccagatcaccggccccgtggagatcttcatgaacaagttcaaggacgaccactgggccctggacggccacgtgagcagcgagagcagcggcgccaccttcatctaccagggcagcgtgaagggccagggcttcggccagttcggcttccagagactggacctgagactgctggagagcgaccccgagagcatcggcagacacttcgccagcaacagcagcagcgtggccgccgccatcctggtgcccttcatcgccctgatcatcgccggcttcgtgctgtacctgtacaagcacagaagaagacccaaggtgcccttcaacggctacgccggccacgagaacaccaacgtgagagccaccttcgagaaccccatgtacgacagaaacatccagcccaccgacatcatggccagcgaggccgagttcaccgtgagcaccgtgtgcaccgccgtgtag

SEQ ID NO: 77914 - DNA, 678 bp, Artificial Sequence
  Description of Artificial Sequence: Synthetic coding sequence
atgtgcgacgcccacctgagaggccccagcggcatcatcaccagccccaacttccccatccagtacgacaacaacgcccactgcgtgtggatcatcaccgccctgaaccccagcaaggccggcggcgaccccggcaacatccagtgcaacaaggagggcctgagcgtggagacccagagcctgagactgagaaacagaagctgcctgctgggcaacagcaaggacaacggctgctgcgtgcccaaccccgtgcacggcaccggcctgcaggtgatcaagctggccttcgaggagttcgacctggagagaggctacgacaccctgaccgtgggcgacggcggccaggacggcgaccagaagaccgtgctgtacatcctgaccggcaccagcgtgcccgacctgatcgtgagcaccaaccaccagatgtggctgctgttccagaccgacggcagcggcagcagcctgggcttcaaggccagctacgaggagatcgagcagggcagctgcggcgaccccggcatccccgcctacggcagaagagagggcagcagattccaccacggcgacaccctgaagttcgagtgccagcccgccttcgagctggtgggccagaaggccatcacctgccagaagaacaaccagtggagcgccaagaagcccggctgcgtgtgcaagtag

SEQ ID NO: 77915 - DNA, 1281 bp, Artificial Sequence
  Description of Artificial Sequence: Synthetic coding sequence
atgctgggcagcttcagcggcaccaccgtgcccgccctgctgaacagcaccagcaaccagctgtacctgcacttctacagcgacatcagcgtgagcgccgccggcttccacctggagtacaagaccgtgggcctgagcagctgccccgagcccgccgtgcccagcaacggcgtgaagaccggcgagagatacctggtgaacgacgtggtgagcttccagtgcgagcccggctacgccctgcagggccacgcccacatcagctgcatgcccggcaccgtgagaagatggaactaccccccccccctgtgcatcgcccagtgcggcggcaccgtggaggagatggagggcgtgatcctgagccccggcttccccggcaactaccccagcaacatggactgcagctggaagatcgccctgcccgtgggcttcggcgcccacatccagttcctgaacttcagcaccgagcccaaccacgactacatcgagatcagaaacggcccctacgagaccagcagaatgatgggcagattcagcggcagcgagctgcccagcagcctgctgagcaccagccacgagaccaccgtgtacttccacagcgaccacagccagaacagacccggcttcaagctggagtaccaggcctacgagctgcaggagtgccccgaccccgagcccttcgccaacggcatcgtgagaggcgccggctacaacgtgggccagagcgtgaccttcgagtgcctgcccggctaccagctgaccggccaccccgtgctgacctgccagcacggcaccaacagaaactgggaccaccccctgcccaagtgcgaggtgccctgcggcggcaacatcaccagcagcaacggcaccgtgtacagccccggcttccccagcccctacagcagcagccaggactgcgtgtggctgatcaccgtgcccatcggccacggcgtgagactgaacctgagcctgctgcagaccgagcccagcggcgacttcatcaccatctgggacggcccccagcagaccgcccccagactgggcgtgttcaccagaagcatggccaagaagaccgtgcagagcagcagcaaccaggtgctgctgaagttccacagagacgccgccaccggcggcatcttcgccatcgccttcagcgaccactgcagatacttcaaccagaagagcggcaagctggacttcacccccagcagcaccctgggccagctgtgcaagaccctgcacagaagcctgccccacctgagactgcagttcctgcacctgtag

SEQ ID NO: 77916 - DNA, 3504 bp, Artificial Sequence
  Description of Artificial Sequence: Synthetic coding sequence
atggtgatcgtgatcctgttccccgccgagtgcggcaacagcgtgaccggcacccagggcaccctgctgagccccaacttccccgtgaactacaacaacaaccacgagtgcatctacagcatccagacccagcccggcaagggcatccagctgaaggccagagccttcgagctgagcgagggcgacgtgctgaaggtgtacgacggcaacaacaacagcgccagactgctgggcgtgttcagccacagcgagatgatgggcgtgaccctgaacagcaccagcagcagcctgtggctggacttcatcaccgacgccgagaacaccagcaagggcttcgagctgcacttcagcagcttcgagctgatcaagtgcgaggaccccggcacccccaagttcggctacaaggtgcacgacgagggccacttcgccggcagcagcgtgagcttcagctgcgaccccggctacagcctgagaggcagcgaggagctgctgtgcctgagcggcgagagaagaacctgggacagacccctgcccacctgcgtggccgagtgcggcggcaccgtgagaggcgaggtgagcggccaggtgctgagccccggctaccccgccccctacgagcacaacctgaactgcatctggaccatcgaggccgaggccggctgcaccatcggcctgcacttcctggtgttcgacaccgaggaggtgcacgacgtgctgagaatctgggacggccccgtggagagcggcgtgctgctgaaggagctgagcggccccgccctgcccaaggacctgcacagcaccttcaacagcgtggtgctgcagttcagcaccgacttcttcaccagcaagcagggcttcgccatccagttcagcgtgagcaccgccaccagctgcaacgaccccggcatcccccagaacggcagcagaagcggcgacagctgggaggccggcgacagcaccgtgttccagtgcgaccccggctacgccctgcagggcagcgccgagatcagctgcgtgaagatcgagaacagattcttctggcagcccagcccccccacctgcatcgccccctgcggcggcgacctgaccggccccagcggcgtgatcctgagccccaactaccccgagccctacccccccggcaaggagtgcgactggaaggtgaccgtgagccccgactacgtgatcgccctggtgttcaacatcttcaacctggagcccggctacgacttcctgcacatctacgacggcagagacagcctgagccccctgatcggcagcttctacggcagccagctgcccggcagaatcgagagcagcagcaacagcctgttcctggccttcagaagcgacgccagcgtgagcaacgccggcttcgtgatcgactacaccgagaaccccagagagagctgcttcgaccccggcagcatcaagaacggcaccagagtgggcagcgacctgaagctgggcagcagcgtgacctactactgccacggcggctacgaggtggagggcaccagcaccctgagctgcatcctgggccccgacggcaagcccgtgtggaacaaccccagacccgtgtgcaccgccccctgcggcggccagtacgtgggcagcgacggcgtggtgctgagccccaactacccccagaactacaccagcggccagatctgcctgtacttcgtgaccgtgcccaaggactacgtggtgttcggccagttcgccttcttccacaccgccctgaacgacgtggtggaggtgcacgacggccacagccagcacagcagactgctgagcagcctgagcggcagccacaccggcgagagcctgcccctggccaccagcaaccaggtgctgatcaagttcagcgccaagggcctggcccccgccagaggcttccacttcgtgtaccaggccgtgcccagaaccagcgccacccagtgcagcagcgtgcccgagcccagatacggcaagagactgggcagcgacttcagcgtgggcgccatcgtgagattcgagtgcaacagcggctacgccctgcagggcagccccgagatcgagtgcctgcccgtgcccggcgccctggcccagtggaacgtgagcgcccccacctgcgtggtgccctgcggcggcaacctgaccgagagaagaggcaccatcctgagccccggcttccccgagccctacctgaacagcctgaactgcgtgtggaagatcgtggtgcccgagggcgccggcatccagatccaggtggtgagcttcgtgaccgagcagaactgggacagcctggaggtgttcgacggcgccgacaacaccgtgaccatgctgggcagcttcagcggcaccaccgtgcccgccctgctgaacagcaccagcaaccagctgtacctgcacttctacagcgacatcagcgtgagcgccgccggcttccacctggagtacaagaccgtgggcctgagcagctgccccgagcccgccgtgcccagcaacggcgtgaagaccggcgagagatacctggtgaacgacgtggtgagcttccagtgcgagcccggctacgccctgcagggccacgcccacatcagctgcatgcccggcaccgtgagaagatggaactaccccccccccctgtgcatcgcccagtgcggcggcaccgtggaggagatggagggcgtgatcctgagccccggcttccccggcaactaccccagcaacatggactgcagctggaagatcgccctgcccgtgggcttcggcgcccacatccagttcctgaacttcagcaccgagcccaaccacgactacatcgagatcagaaacggcccctacgagaccagcagaatgatgggcagattcagcggcagcgagctgcccagcagcctgctgagcaccagccacgagaccaccgtgtacttccacagcgaccacagccagaacagacccggcttcaagctggagtaccaggcctacgagctgcaggagtgccccgaccccgagcccttcgccaacggcatcgtgagaggcgccggctacaacgtgggccagagcgtgaccttcgagtgcctgcccggctaccagctgaccggccaccccgtgctgacctgccagcacggcaccaacagaaactgggaccaccccctgcccaagtgcgaggtgccctgcggcggcaacatcaccagcagcaacggcaccgtgtacagccccggcttccccagcccctacagcagcagccaggactgcgtgtggctgatcaccgtgcccatcggccacggcgtgagactgaacctgagcctgctgcagaccgagcccagcggcgacttcatcaccatctgggacggcccccagcagaccgcccccagactgggcgtgttcaccagaagcatggccaagaagaccgtgcagagcagcagcaaccaggtgctgctgaagttccacagagacgccgccaccggcggcatcttcgccatcgccttcagcggccacctggccgccgtgtgcaccctgtag

SEQ ID NO: 77917 - DNA, 10896 bp, Artificial Sequence
  Description of Artificial Sequence: Synthetic coding sequence
atgcccagaagcagaggcagagagctgggcagatgcggctgccccgccggcagagccagaggcgagaccggcatcagcgccctggtgcccggcgccggcagcagatggggcagaccccccccccccacccccccccccctgctgctgctgctgggctgcggcctgctgagcgtgagcgccgccgccggccagaactgcaccttccagctgcacggccccaacggcaccgtggagagccccggcttcccctacggctaccccaactacgccaactgcacctggaccatcaccgccgaggagcagcacagaatccagctggtgttccagagcttcgccctggaggaggacttcgacgtgctgagcgtgttcgacggccccccccagcccgagaacctgagaaccagactgaccggcttccagctgcccgccaccatcgtgagcgccgccaccaccctgagcctgagactgatcagcgactacgccgtgagcgcccagggcttccacgccacctacgaggtgctgcccagccacacctgcggcaaccccggcagactgcccaacggcatccagcagggcagcaccttcaacctgggcgacaaggtgagatacagctgcaacctgggcttcttcctggagggccacgccgtgctgacctgccacgccggcagcgagaacagcgccacctgggacttccccctgcccagctgcagagccgacgacgcctgcggcggcaccctgagaggccagagcggcatcatcagcagcccccacttccccagcgagtaccacaacaacgccgactgcacctggaccatcctggccgagctgggcgacaccatcgccctggtgttcatcgacttccagctggaggacggctacgacttcctggaggtgaccggcaccgagggcagcagcctgtggttcaccggcgccagcctgcccgcccccgtgatcagcagcaagaactggctgagactgcacttcaccagcgacggcaaccacagacagagaggcttcagcgcccagtaccaggtgaagaagcagatcgagctgaagagcagaggcgtgaagctgatgcccagcaaggacaacagccagaagaccagcgtgctgacccaggtgggcgtgagccagggccacaacatgtgccccgaccccggcatccccgagagaggcaagagactgggcagcgacttcagactgggcagcagcgtgcagttcacctgcaacgagggctacgacctgcagggcagcaagagaatcacctgcatgaaggtgagcgacatgttcgccgcctggagcgaccacagacccgtgtgcagagccagaatgtgcgacgcccacctgagaggccccagcggcatcatcaccagccccaacttccccatccagtacgacaacaacgcccactgcgtgtggatcatcaccgccctgaaccccagcaaggtgatcaagctggccttcgaggagttcgacctggagagaggctacgacaccctgaccgtgggcgacggcggccaggacggcgaccagaagaccgtgctgtacatcctgaccggcaccagcgtgcccgacctgatcgtgagcaccaaccaccagatgtggctgctgttccagaccgacggcagcggcagcagcctgggcttcaaggccagctacgaggagatcgagcagggcagctgcggcgaccccggcatccccgcctacggcagaagagagggcagcagattccaccacggcgacaccctgaagttcgagtgccagcccgccttcgagctggtgggccagaaggccatcacctgccagaagaacaaccagtggagcgccaagaagcccggctgcgtgttcagctgcttcttcaacttcaccagccccagcggcgtggtgctgagccccaactaccccgaggactacggcaaccacctgcactgcgtgtggctgatcctggccagacccgagagcagaatccacctggccttcaacgacatcgacgtggagccccagttcgacttcctggtgatcaaggacggcgccaccgccgaggcccccgtgctgggcaccttcagcggcaaccagctgcccagcagcatcaccagcagcggccacgtggccagactggagttccagaccgaccacagcaccggcaagagaggcttcaacatcaccttcaccaccttcagacacaacgagtgccccgaccccggcgtgcccgtgaacggcaagagattcggcgacagcctgcagctgggcagcagcatcagcttcctgtgcgacgagggcttcctgggcacccagggcagcgagaccatcacctgcgtgctgaaggagggcagcgtggtgtggaacagcgccgtgctgagatgcgaggccccctgcggcggccacctgaccagccccagcggcaccatcctgagccccggctggcccggcttctacaaggacgccctgagctgcgcctgggtgatcgaggcccagcccggctaccccatcaagatcaccttcgacagattcaagaccgaggtgaactacgacaccctggaggtgagagacggcagaacctacagcgcccccctgatcggcgtgtaccacggcacccaggtgccccagttcctgatcagcaccagcaactacctgtacctgctgttcagcaccgacaagagccacagcgacatcggcttccagctgagatacgagaccatcaccctgcagagcgaccactgcctggaccccggcatccccgtgaacggccagagacacggcaacgacttctacgtgggcgccctggtgaccttcagctgcgacagcggctacaccctgagcgacggcgagcccctggagtgcgagcccaacttccagtggagcagagccctgcccagctgcgaggccctgtgcggcggcttcatccagggcagcagcggcaccatcctgagccccggcttccccgacttctaccccaacaacctgaactgcacctggatcatcgagaccagccacggcaagggcgtgttcttcaccttccacaccttccacctggagagcggccacgactacctgctgatcaccgagaacggcagcttcacccagcccctgagacagctgaccggcagcagactgcccgcccccatcagcgccggcctgtacggcaacttcaccgcccaggtgagattcatcagcgacttcagcatgagctacgagggcttcaacatcaccttcagcgagtacgacctggagccctgcgaggagcccgaggtgcccgcctacagcatcagaaagggcctgcagttcggcgtgggcgacaccctgaccttcagctgcttccccggctacagactggagggcaccgccagaatcacctgcctgggcggcagaagaagactgtggagcagccccctgcccagatgcgtggccgagtgcggcaacagcgtgaccggcacccagggcaccctgctgagccccaacttccccgtgaactacaacaacaaccacgagtgcatctacagcatccagacccagcccggcaagggcatccagctgaaggccagagccttcgagctgagcgagggcgacgtgctgaaggtgtacgacggcaacaacaacagcgccagactgctgggcgtgttcagccacagcgagatgatgggcgtgaccctgaacagcaccagcagcagcctgtggctggacttcatcaccgacgccgagaacaccagcaagggcttcgagctgcacttcagcagcttcgagctgatcaagtgcgaggaccccggcacccccaagttcggctacaaggtgcacgacgagggccacttcgccggcagcagcgtgagcttcagctgcgaccccggctacagcctgagaggcagcgaggagctgctgtgcctgagcggcgagagaagaacctgggacagacccctgcccacctgcgtggccgagtgcggcggcaccgtgagaggcgaggtgagcggccaggtgctgagccccggctaccccgccccctacgagcacaacctgaactgcatctggaccatcgaggccgaggccggctgcaccatcggcctgcacttcctggtgttcgacaccgaggaggtgcacgacgtgctgagaatctgggacggccccgtggagagcggcgtgctgctgaaggagctgagcggccccgccctgcccaaggacctgcacagcaccttcaacagcgtggtgctgcagttcagcaccgacttcttcaccagcaagcagggcttcgccatccagttcagcgtgagcaccgccaccagctgcaacgaccccggcatcccccagaacggcagcagaagcggcgacagctgggaggccggcgacagcaccgtgttccagtgcgaccccggctacgccctgcagggcagcgccgagatcagctgcgtgaagatcgagaacagattcttctggcagcccagcccccccacctgcatcgccccctgcggcggcgacctgaccggccccagcggcgtgatcctgagccccaactaccccgagccctacccccccggcaaggagtgcgactggaaggtgaccgtgagccccgactacgtgatcgccctggtgttcaacatcttcaacctggagcccggctacgacttcctgcacatctacgacggcagagacagcctgagccccctgatcggcagcttctacggcagccagctgcccggcagaatcgagagcagcagcaacagcctgttcctggccttcagaagcgacgccagcgtgagcaacgccggcttcgtgatcgactacaccgagaaccccagagagagctgcttcgaccccggcagcatcaagaacggcaccagagtgggcagcgacctgaagctgggcagcagcgtgacctactactgccacggcggctacgaggtggagggcaccagcaccctgagctgcatcctgggccccgacggcaagcccgtgtggaacaaccccagacccgtgtgcaccgccccctgcggcggccagtacgtgggcagcgacggcgtggtgctgagccccaactacccccagaactacaccagcggccagatctgcctgtacttcgtgaccgtgcccaaggactacgtggtgttcggccagttcgccttcttccacaccgccctgaacgacgtggtggaggtgcacgacggccacagccagcacagcagactgctgagcagcctgagcggcagccacaccggcgagagcctgcccctggccaccagcaaccaggtgctgatcaagttcagcgccaagggcctggcccccgccagaggcttccacttcgtgtaccaggccgtgcccagaaccagcgccacccagtgcagcagcgtgcccgagcccagatacggcaagagactgggcagcgacttcagcgtgggcgccatcgtgagattcgagtgcaacagcggctacgccctgcagggcagccccgagatcgagtgcctgcccgtgcccggcgccctggcccagtggaacgtgagcgcccccacctgcgtggtgccctgcggcggcaacctgaccgagagaagaggcaccatcctgagccccggcttccccgagccctacctgaacagcctgaactgcgtgtggaagatcgtggtgcccgagggcgccggcatccagatccaggtggtgagcttcgtgaccgagcagaactgggacagcctggaggtgttcgacggcgccgacaacaccgtgaccatgctgggcagcttcagcggcaccaccgtgcccgccctgctgaacagcaccagcaaccagctgtacctgcacttctacagcgacatcagcgtgagcgccgccggcttccacctggagtacaagaccgtgggcctgagcagctgccccgagcccgccgtgcccagcaacggcgtgaagaccggcgagagatacctggtgaacgacgtggtgagcttccagtgcgagcccggctacgccctgcagggccacgcccacatcagctgcatgcccggcaccgtgagaagatggaactaccccccccccctgtgcatcgcccagtgcggcggcaccgtggaggagatggagggcgtgatcctgagccccggcttccccggcaactaccccagcaacatggactgcagctggaagatcgccctgcccgtgggcttcggcgcccacatccagttcctgaacttcagcaccgagcccaaccacgactacatcgagatcagaaacggcccctacgagaccagcagaatgatgggcagattcagcggcagcgagctgcccagcagcctgctgagcaccagccacgagaccaccgtgtacttccacagcgaccacagccagaacagacccggcttcaagctggagtaccaggcctacgagctgcaggagtgccccgaccccgagcccttcgccaacggcatcgtgagaggcgccggctacaacgtgggccagagcgtgaccttcgagtgcctgcccggctaccagctgaccggccaccccgtgctgacctgccagcacggcaccaacagaaactgggaccaccccctgcccaagtgcgaggtgccctgcggcggcaacatcaccagcagcaacggcaccgtgtacagccccggcttccccagcccctacagcagcagccaggactgcgtgtggctgatcaccgtgcccatcggccacggcgtgagactgaacctgagcctgctgcagaccgagcccagcggcgacttcatcaccatctgggacggcccccagcagaccgcccccagactgggcgtgttcaccagaagcatggccaagaagaccgtgcagagcagcagcaaccaggtgctgctgaagttccacagagacgccgccaccggcggcatcttcgccatcgccttcagcgcctaccccctgaccaagtgccccccccccaccatcctgcccaacgccgaggtggtgaccgagaacgaggagttcaacatcggcgacatcgtgagatacagatgcctgcccggcttcaccctggtgggcaacgagatcctgacctgcaagctgggcacctacctgcagttcgagggccccccccccatctgcgaggtgcactgccccaccaacgagctgctgaccgacagcaccggcgtgatcctgagccagagctaccccggcagctacccccagttccagacctgcagctggctggtgagagtggagcccgactacaacatcagcctgaccgtggagtacttcctgagcgagaagcagtacgacgagttcgagatcttcgacggccccagcggccagagccccctgctgaaggccctgagcggcaactacagcgcccccctgatcgtgaccagcagcagcaacagcgtgtacctgagatggagcagcgaccacgcctacaacagaaagggcttcaagatcagatacagcgccccctactgcagcctgcccagagcccccctgcacggcttcatcctgggccagaccagcacccagcccggcggcagcatccacttcggctgcaacgccggctacagactggtgggccacagcatggccatctgcaccagacacccccagggctaccacctgtggagcgaggccatccccctgtgccaggccctgagctgcggcctgcccgaggcccccaagaacggcatggtgttcggcaaggagtacaccgtgggcaccaaggccatgtacagctgcagcgagggctaccacctgcaggccggcgccgaggccaccgccgagtgcctggacaccggcctgtggagcaacagaaacgtgcccccccagtgcgtgcccgtgacctgccccgacgtgagcagcatcagcgtggagcacggcagatggagactgatcttcgagacccagtaccagttccaggcccagctgatgctgatctgcgaccccggctactactacaccggccagagagtgatcagatgccaggccaacggcaagtggagcctgggcgacagcacccccacctgcagaatcatcagctgcggcgagctgcccatcccccccaacggccacagaatcggcaccctgagcgtgtacggcgccaccgccatcttcagctgcaacagcggctacaccctggtgggcagcagagtgagagagtgcatggccaacggcctgtggagcggcagcgaggtgagatgcctggccacccagaccaagctgcacagcatcttctacaagctgctgttcgacgtgctgagcagccccagcctgaccaaggccggccactgcggcacccccgagcccatcgtgaacggccacatcaacggcgagaactacagctacagaggcagcgtggtgtaccagtgcaacgccggcttcagactgatcggcatgagcgtgagaatctgccagcaggaccaccactggagcggcaagacccccttctgcgtgcccatcacctgcggccaccccggcaaccccgtgaacggcctgacccagggcaaccagttcaacctgaacgacgtggtgaagttcgtgtgcaaccccggctacatggccgagggcgccgccagaagccagtgcctggccagcggccagtggagcgacatgctgcccacctgcagaatcatcaactgcaccgaccccggccaccaggagaacagcgtgagacaggtgcacgccagcggcccccacagattcagcttcggcaccaccgtgagctacagatgcaaccacggcttctacctgctgggcacccccgtgctgagctgccagggcgacggcacctgggacagacccagaccccagtgcctgctggtgagctgcggccaccccggcagccccccccacagccagatgagcggcgacagctacaccgtgggcgccgtggtgagatacagctgcatcggcaagagaaccctggtgggcaacagcaccagaatgtgcggcctggacggccactggaccggcagcctgccccactgcagcggcaccagcgtgggcgtgtgcggcgaccccggcatccccgcccacggcatcagactgggcgacagcttcgaccccggcaccgtgatgagattcagctgcgaggccggccacgtgctgagaggcagcagcgagagaacctgccaggccaacggcagctggagcggcagccagcccgagtgcggcgtgatcagctgcggcaaccccggcacccccagcaacgccagagtggtgttcagcgacggcctggtgttcagcagcagcatcgtgtacgagtgcagagagggctactacgccaccggcctgctgagcagacactgcagcgtgaacggcacctggaccggcagcgaccccgagtgcctggtgatcaactgcggcgaccccggcatccccgccaacggcctgagactgggcaacgacttcagatacaacaagaccgtgacctaccagtgcgtgcccggctacatgatggagagccacagagtgagcgtgctgagctgcaccaaggacagaacctggaacggcaccaagcccgtgtgcaaggccctgatgtgcaagcccccccccctgatccccaacggcaaggtggtgggcagcgacttcatgtggggcagcagcgtgacctacgcctgcctggagggctaccagctgagcctgcccgccgtgttcacctgcgagggcaacggcagctggaccggcgagctgccccagtgcttccccgtgttctgcggcgaccccggcgtgcccagcagaggcagaagagaggacagaggcttcagctacagaagcagcgtgagcttcagctgccacccccccctggtgctggtgggcagccccagaagattctgccagagcgacggcacctggagcggcacccagcccagctgcatcgaccccaccctgaccacctgcgccgaccccggcgtgccccagttcggcatccagaacaacagccagggctaccaggtgggcagcaccgtgctgttcagatgccagaagggctacctgctgcagggcagcaccaccagaacctgcctgcccaacctgacctggagcggcaccccccccgactgcgtgccccaccactgcagacagcccgagacccccacccacgccaacgtgggcgccctggacctgcccagcatgggctacaccctgatctacagctgccaggagggcttcagcctgaagggcggcagcgagcacagaacctgcaaggccgacggcagctggaccggcaagccccccatctgcctggaggtgagacccagcggcagacccatcaacaccgccagagagccccccctgacccaggccctgatccccggcgacgtgttcgccaagaacagcctgtggaagggcgcctacgagtaccagggcaagaagcagcccgccatgctgagagtgaccggcttccaggtggccaacagcaaggtgaacgccaccatgatcgaccacagcggcgtggagctgcacctggccggcacctacaagaaggaggacttccacctgctgctgcaggtgtaccagatcaccggccccgtggagatcttcatgaacaagttcaaggacgaccactgggccctggacggccacgtgagcagcgagagcagcggcgccaccttcatctaccagggcagcgtgaagggccagggcttcggccagttcggcttccagagactggacctgagactgctggagagcgaccccgagagcatcggcagacacttcgccagcaacagcagcagcgtggccgccgccatcctggtgcccttcatcgccctgatcatcgccggcttcgtgctgtacctgtacaagcacagaagaagacccaaggtgcccttcaacggctacgccggccacgagaacaccaacgtgagagccaccttcgagaaccccatgtacgacagaaacatccagcccaccgacatcatggccagcgaggccgagttcaccgtgagcaccgtgtgcaccgccgtgtag

SEQ ID NO: 77918 - DNA, 1281 bp, Artificial Sequence; identical to SEQ ID NO: 77915
  Description of Artificial Sequence: Synthetic coding sequence

SEQ ID NO: 77919 - DNA, 11124 bp, Artificial Sequence
  Description of Artificial Sequence: Synthetic coding sequence
atgaagggcatcagaaagggcgagagcagagccaaggagagcaagccctgggagcccggcaagagaagatgcgccaagtgcggcagactggacttcatcctgatgaagaagatgggcatcaagagcggcttcaccttctggaacctggtgttcctgctgaccgtgagctgcgtgaagggcttcatctacacctgcggcggcaccctgaagggcctgaacggcaccatcgagagccccggcttcccctacggctaccccaacggcgccaactgcacctgggtgatcatcgccgaggagagaaacagaatccagatcgtgttccagagcttcgccctggaggaggagtacgactacctgagcctgtacgacggccacccccaccccaccaacttcagaaccagactgaccggcttccacctgcccccccccgtgaccagcaccaagagcgtgttcagcctgagactgaccagcgacttcgccgtgagcgcccacggcttcaaggtgtactacgaggagctgcagagcagcagctgcggcaaccccggcgtgccccccaagggcgtgctgtacggcaccagattcgacgtgggcgacaagatcagatacagctgcgtgaccggctacatcctggacggccacccccagctgacctgcatcgccaacagcgtgaacaccgccagctgggacttccccgtgcccatctgcagagccgaggacgcctgcggcggcaccatgagaggcagcagcggcatcatcagcagccccagcttccccaacgagtaccacaacaacgccgactgcacctggaccatcgtggccgagcccggcgacaccatcagcctgatcttcaccgacttccagatggaggagaagtacgactacctggagatcgagggcagcgagccccccaccatctggctgagcggcatgaacatccccccccccatcatcagcaacaagaactggctgagactgcacttcgtgaccgacagcaaccacagatacagaggcttcagcgccccctaccagggcagcagcaccctgacccacaccaccagcaccggcgagctggaggagcacaacagaaccaccaccggcgccatcgccgtggccagcacccccgccgacgtgaccgtgagcagcgtgaccgccgtgaccatccacagactgagcgaggagcagagagtgcaggtgaccagcctgagaaacagcggcctggaccccaacaccagcaaggacggcctgagcccccaccccgccgacacccagagcaccagaagaagacccagacacgccgagcagatcgagagaaccaaggagctggccgtggtgacccacagagtgaagaaggccatcgacttcaagagcagaggcttcaagctgttccccggcaaggacaacagcaacaagttcagcatcctgaacgagggcggcatcaagaccgccagcaacctgtgccccgaccccggcgagcccgagaacggcaagagaatcggcagcgacttcagcctgggcagcaccgtgcagttcagctgcgacgaggactacgtgctgcagggcgccaagagcatcacctgccagagaatcgccgaggtgttcgccgcctggagcgaccacagacccgtgtgcaaggtgaagacctgcggcagcaacctgcagggccccagcggcaccttcaccagccccaacttccccttccagtacgacagcaacgcccagtgcgtgtgggtgatcaccgccgtgaacaccaacaaggtgatccagatcaacttcgaggagttcgacctggagatcggctacgacaccctgaccatcggcgacggcggcgaggtgggcgaccccagaaccgtgctgcaggtgctgaccggcagcttcgtgcccgacctgatcgtgagcatgagcagccagatgtggctgcacctgcagaccgacgagagcgtgggcagcgtgggcttcaaggtgaactacaaggagatcgagaaggagagctgcggcgaccccggcacccccctgtacggcatcagagagggcgacggcttcagcaacagagacgtgctgagattcgagtgccagttcggcttcgagctgatcggcgagaagagcatcgtgtgccaggagaacaaccagtggagcgccaacatccccatctgcatcttcccctgcctgagcaacttcaccgcccccatgggcaccgtgctgagccccgactaccccgagggctacggcaacaacctgaactgcatctggaccatcatcagcgaccccggcagcagaatccacctgagcttcaacgacttcgacctggagagccagttcgacttcctggccgtgaaggacggcgacagccccgagagccccatcctgggcaccttcaccggcgccgaggtgcccagccacctgaccagcaacagccacatcctgagactggagttccaggccgaccacagcatgagcggcagaggcttcaacatcacctacaacaccttcggccacaacgagtgccccgaccccggcatccccatcaacgccagaagattcggcgacaacttccagctgggcagcagcatcagcgtgatctgcgaggagggcttcatcaagacccagggcaccgagaccatcacctgcatcctgatggacggcaaggtgatgtggagcggcctgatccccaagtgcggcgccccctgcggcggccacttcagcgcccccagcggcgtgatcctgagccccggctggcccggctactacaaggacagcctgaactgcgagtgggtgatcgaggccgagcccggccacagcatcaagatcaccttcgagagattccagaccgagctgaactacgacgtgctggaggtgcacgacggccccaacctgctgagccccctgctgggcagctacaacggcacccaggtgccccagttcctgttcagcagcagcaacttcatctacctgctgttcaccaccgacaacagcagaagcaacaacggcttcaagatccactacgagagcgtgaccgtgaacacctacagctgcctggaccccggcatccccgtgcacggcagaagatacggccacgacttcagcatcggcagcaccgtgagcttcagctgcgacagcggctacagactgagccacgaggagcccctgctgtgcgagaagaaccactggtggagccaccccctgcccacctgcgacgccctgtgcggcggcgacgtgagaggccccagcggcaccatcctgagccccggctaccccgagttctaccccaacagcctgaactgcacctggaccgtggacgtgacccacggcaagggcgtgcagttcaacttccacaccttccacctggaggaccaccacgactacctgctgatcaccgagaacggcagcttcacccagcccctggccagactgaccggcagcgacctgccccccaccatcaacgccggcctgtacggcaacttcagagcccagctgagattcatcagcgacttcagcatcagctacgagggcttcaacatcaccttcagcgagtacaacctggagccctgcgaggaccccggcatcccccagtacggcagcagaatcggcttcaacttcggcatcggcgacaccctgaccttcagctgcagcagcggctacagactggagggcaccagcgagatcatctgcctgggcggcggcagaagagtgtggagcgcccccctgcccagatgcgtggccgagtgcggcgccagcgccaccaacaacgagggcatcctgctgagccccaactaccccctgaactacgagaacaaccacgagtgcatctacagcatccaggtgcaggccggcaagggcatcaacatcagcgccagaaccttccacctggcccagggcgacgtgctgaagatctacgacggcaaggacaagaccacccacctgctgggcgccttcaccggcgccagcatgagaggcctgaccctgagcagcaccagcaaccagctgtggctggagttcaacagcgacaccgagggcaccgacgagggcttccagctggtgtacaccagcttcgagctgagccactgcgaggaccccggcatcccccagttcggctacaagatcagcgaccagggccacttcgccggcagcaccatcatctacggctgcaaccccggctacaccctgcacggcagcagcctgctgaagtgcatgaccggcgagagaagagcctgggactaccccctgcccagctgcatcgccgagtgcggcggcagattcaagggcgagagcagcggcagaatcctgagccccggctaccccttcccctacgacaacaacctgagatgcatgtggatgatcgaggtggaccccggcaacatcgtgagcctgcagttcctggccttcgacaccgaggccagccacgacatcctgagagtgtgggacggcccccccgagaacgacatgctgctgaaggagatcagcggcagcctgatccccgagggcatccacagcaccctgaacatcgtgaccatccagttcgacaccgacttctacatcagcaagagcggcttcgccatccagttcagcagcagcgtggccaccgcctgcagagaccccggcgtgcccatgaacggcaccagaaacggcgacggcagagagcccggcgacaccgtggtgttccagtgcgaccccggctacgagctgcagggcgaggagagaatcacctgcatccaggtggagaacagatacttctggcagcccagcccccccgtgtgcatcgccccctgcggcggcaacctgaccggcagcagcggcttcatcctgagccccaacttcccccacccctacccccacagcagagactgcgactggaccatcaccgtgaacgccgactacgtgatcagcctggccttcatcagcttcagcatcgagcccaactacgacttcctgtacatctacgacggccccgacagcaacagccccctgatcggcagcttccaggacagcaagctgcccgagagaatcgagagcagcagcaacaccatgcacctggccttcagaagcgacggcagcgtgagctacaccggcttccacctggagtacaaggccaagctgagagagagctgcttcgaccccggcaacatcatgaacggcaccagactgggcatggactacaagctgggcagcaccgtgacctactactgcgacgccggctacgtgctgcagggctacagcaccctgacctgcatcatgggcgacgacggcagacccggctggaacagagccctgcccagctgccacgccccctgcggcagcagaagcaccggcagcgagggcaccgtgctgagccccaactaccccaagaactacagcgtgggccacaactgcgtgtacagcatcgccgtgcccaaggagttcgtggtgttcggccagttcgtgttcttccagaccagcctgcacgacgtggtggaggtgtacgacggccccacccagcagagcagcctgctgagcagcctgagcggcagccacagcggcgagagcctgcccctgagcagcggcaaccagatcaccatcagattcaccagcgtgggccccatcaccgccaagggcttccacttcgtgtaccaggccgtgcccagaaccagcagcacccagtgcagcagcgtgcccgagcccagattcggcagaagaatcggcaacgagttcgccgtgggcagcagcgtgctgttcgactgcaaccccggctacatcctgcacggcagcatcgccatcagatgcgagaccgtgcccaacagcctggcccagtggaacgacagcctgcccacctgcatcgtgccctgcggcggcatcctgaccaagagaaagggcaccatcctgagccccggctaccccgagccctacgacaacaacctgaactgcgtgtggaagatcaccgtgcccgagggcgccggcatccaggtgcaggtggtgagcttcgccaccgagcacaactgggacagcctggacttctacgacggcggcgacaacaacgcccccagactgggcagctacagcggcaccaccatcccccacctgctgaacagcaccagcaacaacctgtacctgaacttccagagcgacatcagcgtgagcgccgccggcttccacctggagtacaccgccatcggcctggacagctgccccgagccccagacccccagcagcggcatcaagatcggcgacagatacatggtgggcgacgtggtgagcttccagtgcgaccagggctacagcctgcagggccacagccacatcacctgcatgcccggccccgtgagaagatggaactaccccatccccatctgcctggcccagtgcggcggcgccatgagcgacttcagcggcgtgatcctgagccccggcttccccggcaactaccccagcagcctggactgcacctggaccatcaacctgcccatcggcttcggcgtgcacctgcagttcgtgaacttcagcaccgagaccatccacgactacctggaggtgagaagcggcagcagcgagaccagcaccgtgatcggcagactgagcggcccccagatccccagcagcctgttcagcaccacccacgagaccagcctgtacttccacagcgactacagccagaacaagcagggcttccacatcgtgtaccaggcctaccagctgcagagctgccccgaccccagacccttcagaaacggcttcgtgatcggcaacgacttcaccgtgggccagaccatcagcttcgagtgcttccccggctacaccctgatcggcaacagcgccctgacctgcctgcacggcgtgagcagaaactggaaccaccccctgcccagatgcgaggccctgtgcggcggcaacatcaccgccatgaacggcaccatctacagccccggctaccccgacgagtaccccaacttccaggactgcttctggctggtgagagtgccccccggcaacggcatctacatcaacttcaccgtgctgcagaccgagcccatctacgacttcatcaccgtgtgggacggccccgaccagaacagcccccagatcggccagttcagcggcaacaccgccctggagagcgtgtacagcaccagcaaccagatcctgatcaagttccacagcgacttcaccaccagcggcttcttcgtgctgagctaccacgcctaccagctgagagtgtgccagccccccccccccgtgcccaacgccgagatcctgaccgaggacgacgagttcgagatcggcgacatcatcagataccagtgcctgcccggcttcaccctggtgggcaacgccatcctgacctgcagactgggcgagagactgcagatggacggcgccccccccgtgtgccaggtgctgtgccccgccaacgagctgagactggacagcaccggcgtgatcctgagccccggctaccccgacagctaccccaacctgcagatgtgcgcctggagcatcagcgtggagaagggctacaacatcaccatgttcgtggagttcttccagaccgagaaggagttcgacgtgctgcaggtgtacgacggccccaacatccagagccccgtgctgatcagcctgagcggcgactacagcagcgccttcaacatcaccagcaacggccacgaggtgttcctgcagtggagcgccgaccacggcaacaacaagaagggcttcagaatcagatacatcgccttctactgcagcacccccgagagccccccccacggctacatcatcagccagaccggcggccagctgaacagcgtggtgagatgggcctgcgacagaggcttcagactggtgggcaagagcagcgccgtgtgcagaaagagcagctacggctaccacgcctgggacgcccccgtgcccgcctgccaggccatcagctgcggcatccccaaggcccccaccaacggcggcatcctgaccaccgactacctggtgggcaccagagtgacctacttctgcaacgacggctacagactgagcagcaaggagctgaccaccgccgtgtgccagagcgacggcacctggagcaaccacaacaagacccccagatgcgtggtggtgacctgccccagcatcaacagcttcatcctggagcacggcagatggagaatcgtgaacggcagccactacgagtacaagaccaaggtggtgttcagctgcgaccccggctaccacggcctgggccccgccagcatcgagtgcctgcccaacggcacctggagctggagaaacgagagaccctactgccagatcatcagctgcggcgagctgcccaccccccccaacggcaacaagatcggcacccagaccagctacggcagcaccgccatcttcacctgcgacctgggcttcatgctggtgggcagcgccgtgagagagtgcctgagcagcggcctgtggagcgagagcgagaccagatgcctggccggccactgcggcatccccgagctgatcgtgaacggccaggtgatcggcgagaactacggctacagagacaccgtggtgtaccagtgcaaccccggcttcagactgatcggcagcagcgtgagaatctgccagcaggaccacaactggagcggccagctgcccagctgcgtgcccgtgagctgcggccaccccggcagccccatctacggcagaaccagcggcaacggcttcaacttcaacgacgtggtgaccttcagctgcaacatcggctacctgatgcagggccccaccaaggcccagtgccaggccaacagacagtggagccaccccccccccatgtgcaaggtggtgaactgcagcgaccccggcatccccgccaacagcaagagagagagcaagatcgagcacggcaacttcacctacggcaccgtggtgttctacgactgcaaccccggctacttcctgttcggcagcagcgtgctgatctgccagcccaacggccagtgggacaagcccctgcccgagtgcatcatgatcgactgcggccaccccggcgtgccccccaacgccgtgctgagcggcgagaagtacaccttcggcagcaccgtgcactacagctgcaccggcaagagaagcctgctgggccagagcagcagaacctgccagctgaacggccactggagcggcagccagccccactgcagcggcgacgccaccggcacctgcggcgaccccggcacccccggccacggcagcagacaggagagcaacttcagaaccaagagcaccgtgagatacgcctgcgacaccggctacatcctgcacggcagcgaggagagaacctgcctggccaacggcagctggaccggcagacagcccgagtgcaaggccgtgcagtgcggcaaccccggcaccaccgccaacggcaaggtgttcagaatcgacggcaccaccttcagcagcagcgtgatctacagctgcatggagggctacatcctgagcggccccagcgtgagacagtgcaccgccaacggcacctggagcggcaccctgcccaactgcaccatcatcagctgcggcgaccccggcatccccgccaacggcctgagatacggcgacgactacgtggtgggccagaacgtgagctacatgtgccagcccggctacaccatggagctgaacggcagcagaatcagaacctgcaccatcaacggcacctggagcggcgtgatgcccacctgcagagccgtgacctgccccacccccccccagatcagcaacggcagactggagggcaccaacttcgactggggcttcagcatcagctacatctgcagccccggctacgagctgagcttccccgccgtgctgacctgcgtgggcaacggcacctggagcggcgaggtgccccagtgcctgcccaagttctgcggcgaccccggcatccccgcccagggcaagagagagggcaagagcttcatctaccagagcgaggtgagcttcagctgcaacttccccttcatcctggtgggcagcagcaccagaatctgccaggccgacggcacctggagcggcagcagcccccactgcatcgagcccacccagaccagctgcgagaaccccggcgtgcccagacacggcagccagaacaacaccttcggcttccaggtgggcagcgtggtgcagttccactgcaagaagggccacctgctgcagggcagcaccaccagaacctgcctgcccgacctgacctggagcggcatccagcccgagtgcatcccccacagctgcaagcagcccgagacccccgcccacgccaacgtggtgggcatggacctgcccagccacggctacaccctgatctacacctgccagcccggcttcttcctggccggcggcaccgagcacagagtgtgcagaagcgacaacacctggaccggcaaggtgcccatctgcgaggccggcagcaagatcctggtgaaggaccccagacccgccctgggcacccccagccccaagctgagcgtgcccgacgacgtgttcgcccagaactacatctggaagggcagctacaacttcaagggcagaaagcagcccatgaccctgaccgtgaccagcttcaacgccagcaccggcagagtgaacgccaccctgagcaacagcaacatggagctgctgctgagcggcgtgtacaagagccaggaggccagactgatgctgagaatctacctgatcaaggtgcccgcccacgccagcgtgaagaagatgaaggaggagaactgggccatggacggcttcgtgagcgccgagcccgacggcgccacctacgtgttccagggcttcatccagggcaaggactacggccagttcggcctgcagagactgggcctgaacatgagcgagggcagcaacagcagcaaccagccccacggcaccaacagcagcagcgtggccatcgccatcctggtgcccttcttcgccctgatcttcgccggcttcggcttctacctgtacaagcagagaaccgcccccaagacccagtacaccggctgcagcgtgcacgagaacaacaacggccaggccgccttcgagaaccccatgtacgacaccaacgccaagagcgtggagggcaaggccgtgagattcgaccccaacctgaacaccgtgtgcaccatggtgtag

SEQ ID NO: 77920 - DNA, 11004 bp, Artificial Sequence
  Description of Artificial Sequence: Synthetic coding sequence
atgtggagctggttcctgtgctggaagcccgtgcagctggacagacagaccgccagcggcttcatctacacctgcggcggcaccctgaagggcctgaacggcaccatcgagagccccggcttcccctacggctaccccaacggcgccaactgcacctgggtgatcatcgccgaggagagaaacagaatccagatcgtgttccagagcttcgccctggaggaggagtacgactacctgagcctgtacgacggccacccccaccccaccaacttcagaaccagactgaccggcttccacctgcccccccccgtgaccagcaccaagagcgtgttcagcctgagactgaccagcgacttcgccgtgagcgcccacggcttcaaggtgtactacgaggagctgcagagcagcagctgcggcaaccccggcgtgccccccaagggcgtgctgtacggcaccagattcgacgtgggcgacaagatcagatacagctgcgtgaccggctacatcctggacggccacccccagctgacctgcatcgccaacagcgtgaacaccgccagctgggacttccccgtgcccatctgcagagccgaggacgcctgcggcggcaccatgagaggcagcagcggcatcatcagcagccccagcttccccaacgagtaccacaacaacgccgactgcacctggaccatcgtggccgagcccggcgacaccatcagcctgatcttcaccgacttccagatggaggagaagtacgactacctggagatcgagggcagcgagccccccaccatctggctgagcggcatgaacatccccccccccatcatcagcaacaagaactggctgagactgcacttcgtgaccgacagcaaccacagatacagaggcttcagcgccccctaccagggcagcagcaccctgacccacaccaccagcaccggcgagctggaggagcacaacagaaccaccaccggcgccatcgccgtggccagcacccccgccgacgtgaccgtgagcagcgtgaccgccgtgaccatccacagactgagcgaggagcagagagtgcaggtgaccagcctgagaaacagcggcctggaccccaacaccagcaaggacggcctgagcccccaccccgccgacacccagagcaccagaagaagacccagacacgccgagcagatcgagagaaccaaggagctggccgtggtgacccacagagtgaagaaggccatcgacttcaagagcagaggcttcaagctgttccccggcaaggacaacagcaacaagttcagcatcctgaacgagggcggcatcaagaccgccagcaacctgtgccccgaccccggcgagcccgagaacggcaagagaatcggcagcgacttcagcctgggcagcaccgtgcagttcagctgcgacgaggactacgtgctgcagggcgccaagagcatcacctgccagagaatcgccgaggtgttcgccgcctggagcgaccacagacccgtgtgcaaggtgaagacctgcggcagcaacctgcagggccccagcggcaccttcaccagccccaacttccccttccagtacgacagcaacgcccagtgcgtgtgggtgatcaccgccgtgaacaccaacaaggtgatccagatcaacttcgaggagttcgacctggagatcggctacgacaccctgaccatcggcgacggcggcgaggtgggcgaccccagaaccgtgctgcaggtgctgaccggcagcttcgtgcccgacctgatcgtgagcatgagcagccagatgtggctgcacctgcagaccgacgagagcgtgggcagcgtgggcttcaaggtgaactacaaggagatcgagaaggagagctgcggcgaccccggcacccccctgtacggcatcagagagggcgacggcttcagcaacagagacgtgctgagattcgagtgccagttcggcttcgagctgatcggcgagaagagcatcgtgtgccaggagaacaaccagtggagcgccaacatccccatctgcatcttcccctgcctgagcaacttcaccgcccccatgggcaccgtgctgagccccgactaccccgagggctacggcaacaacctgaactgcatctggaccatcatcagcgaccccggcagcagaatccacctgagcttcaacgacttcgacctggagagccagttcgacttcctggccgtgaaggacggcgacagccccgagagccccatcctgggcaccttcaccggcgccgaggtgcccagccacctgaccagcaacagccacatcctgagactggagttccaggccgaccacagcatgagcggcagaggcttcaacatcacctacaacaccttcggccacaacgagtgccccgaccccggcatccccatcaacgccagaagattcggcgacaacttccagctgggcagcagcatcagcgtgatctgcgaggagggcttcatcaagacccagggcaccgagaccatcacctgcatcctgatggacggcaaggtgatgtggagcggcctgatccccaagtgcggcgccccctgcggcggccacttcagcgcccccagcggcgtgatcctgagccccggctggcccggctactacaaggacagcctgaactgcgagtgggtgatcgaggccgagcccggccacagcatcaagatcaccttcgagagattccagaccgagctgaactacgacgtgctggaggtgcacgacggccccaacctgctgagccccctgctgggcagctacaacggcacccaggtgccccagttcctgttcagcagcagcaacttcatctacctgctgttcaccaccgacaacagcagaagcaacaacggcttcaagatccactacgagagcgtgaccgtgaacacctacagctgcctggaccccggcatccccgtgcacggcagaagatacggccacgacttcagcatcggcagcaccgtgagcttcagctgcgacagcggctacagactgagccacgaggagcccctgctgtgcgagaagaaccactggtggagccaccccctgcccacctgcgacgccctgtgcggcggcgacgtgagaggccccagcggcaccatcctgagccccggctaccccgagttctaccccaacagcctgaactgcacctggaccgtggacgtgacccacggcaagggcgtgcagttcaacttccacaccttccacctggaggaccaccacgactacctgctgatcaccgagaacggcagcttcacccagcccctggccagactgaccggcagcgacctgccccccaccatcaacgccggcctgtacggcaacttcagagcccagctgagattcatcagcgacttcagcatcagctacgagggcttcaacatcaccttcagcgagtacaacctggagccctgcgaggaccccggcatcccccagtacggcagcagaatcggcttcaacttcggcatcggcgacaccctgaccttcagctgcagcagcggctacagactggagggcaccagcgagatcatctgcctgggcggcggcagaagagtgtggagcgcccccctgcccagatgcgtggccgagtgcggcgccagcgccaccaacaacgagggcatcctgctgagccccaactaccccctgaactacgagaacaaccacgagtgcatctacagcatccaggtgcaggccggcaagggcatcaacatcagcgccagaaccttccacctggcccagggcgacgtgctgaagatctacgacggcaaggacaagaccacccacctgctgggcgccttcaccggcgccagcatgagaggcctgaccctgagcagcaccagcaaccagctgtggctggagttcaacagcgacaccgagggcaccgacgagggcttccagctggtgtacaccagcttcgagctgagccactgcgaggaccccggcatcccccagttcggctacaagatcagcgaccagggccacttcgccggcagcaccatcatctacggctgcaaccccggctacaccctgcacggcagcagcctgctgaagtgcatgaccggcgagagaagagcctgggactaccccctgcccagctgcatcgccgagtgcggcggcagattcaagggcgagagcagcggcagaatcctgagccccggctaccccttcccctacgacaacaacctgagatgcatgtggatgatcgaggtggaccccggcaacatcgtgagcctgcagttcctggccttcgacaccgaggccagccacgacatcctgagagtgtgggacggcccccccgagaacgacatgctgctgaaggagatcagcggcagcctgatccccgagggcatccacagcaccctgaacatcgtgaccatccagttcgacaccgacttctacatcagcaagagcggcttcgccatccagttcagcagcagcgtggccaccgcctgcagagaccccggcgtgcccatgaacggcaccagaaacggcgacggcagagagcccggcgacaccgtggtgttccagtgcgaccccggctacgagctgcagggcgaggagagaatcacctgcatccaggtggagaacagatacttctggcagcccagcccccccgtgtgcatcgccccctgcggcggcaacctgaccggcagcagcggcttcatcctgagccccaacttcccccacccctacccccacagcagagactgcgactggaccatcaccgtgaacgccgactacgtgatcagcctggccttcatcagcttcagcatcgagcccaactacgacttcctgtacatctacgacggccccgacagcaacagccccctgatcggcagcttccaggacagcaagctgcccgagagaatcgagagcagcagcaacaccatgcacctggccttcagaagcgacggcagcgtgagctacaccggcttccacctggagtacaaggccaagctgagagagagctgcttcgaccccggcaacatcatgaacggcaccagactgggcatggactacaagctgggcagcaccgtgacctactactgcgacgccggctacgtgctgcagggctacagcaccctgacctgcatcatgggcgacgacggcagacccggctggaacagagccctgcccagctgccacgccccctgcggcagcagaagcaccggcagcgagggcaccgtgctgagccccaactaccccaagaactacagcgtgggccacaactgcgtgtacagcatcgccgtgcccaaggagttcgtggtgttcggccagttcgtgttcttccagaccagcctgcacgacgtggtggaggtgtacgacggccccacccagcagagcagcctgctgagcagcctgagcggcagccacagcggcgagagcctgcccctgagcagcggcaaccagatcaccatcagattcaccagcgtgggccccatcaccgccaagggcttccacttcgtgtaccaggccgtgcccagaaccagcagcacccagtgcagcagcgtgcccgagcccagattcggcagaagaatcggcaacgagttcgccgtgggcagcagcgtgctgttcgactgcaaccccggctacatcctgcacggcagcatcgccatcagatgcgagaccgtgcccaacagcctggcccagtggaacgacagcctgcccacctgcatcgtgccctgcggcggcatcctgaccaagagaaagggcaccatcctgagccccggctaccccgagccctacgacaacaacctgaactgcgtgtggaagatcaccgtgcccgagggcgccggcatccaggtgcaggtggtgagcttcgccaccgagcacaactgggacagcctggacttctacgacggcggcgacaacaacgcccccagactgggcagctacagcggcaccaccatcccccacctgctgaacagcaccagcaacaacctgtacctgaacttccagagcgacatcagcgtgagcgccgccggcttccacctggagtacaccgccatcggcctggacagctgccccgagccccagacccccagcagcggcatcaagatcggcgacagatacatggtgggcgacgtggtgagcttccagtgcgaccagggctacagcctgcagggccacagccacatcacctgcatgcccggccccgtgagaagatggaactaccccatccccatctgcctggcccagtgcggcggcgccatgagcgacttcagcggcgtgatcctgagccccggcttccccggcaactaccccagcagcctggactgcacctggaccatcaacctgcccatcggcttcggcgtgcacctgcagttcgtgaacttcagcaccgagaccatccacgactacctggaggtgagaagcggcagcagcgagaccagcaccgtgatcggcagactgagcggcccccagatccccagcagcctgttcagcaccacccacgagaccagcctgtacttccacagcgactacagccagaacaagcagggcttccacatcgtgtaccaggcctaccagctgcagagctgccccgaccccagacccttcagaaacggcttcgtgatcggcaacgacttcaccgtgggccagaccatcagcttcgagtgcttccccggctacaccctgatcggcaacagcgccctgacctgcctgcacggcgtgagcagaaactggaaccaccccctgcccagatgcgaggccctgtgcggcggcaacatcaccgccatgaacggcaccatctacagccccggctaccccgacgagtaccccaacttccaggactgcttctggctggtgagagtgccccccggcaacggcatctacatcaacttcaccgtgctgcagaccgagcccatctacgacttcatcaccgtgtgggacggccccgaccagaacagcccccagatcggccagttcagcggcaacaccgccctggagagcgtgtacagcaccagcaaccagatcctgatcaagttccacagcgacttcaccaccagcggcttcttcgtgctgagctaccacgcctaccagctgagagtgtgccagccccccccccccgtgcccaacgccgagatcctgaccgaggacgacgagttcgagatcggcgacatcatcagataccagtgcctgcccggcttcaccctggtgggcaacgccatcctgacctgcagactgggcgagagactgcagatggacggcgccccccccgtgtgccaggtgctgtgccccgccaacgagctgagactggacagcaccggcgtgatcctgagccccggctaccccgacagctaccccaacctgcagatgtgcgcctggagcatcagcgtggagaagggctacaacatcaccatgttcgtggagttcttccagaccgagaaggagttcgacgtgctgcaggtgtacgacggccccaacatccagagccccgtgctgatcagcctgagcggcgactacagcagcgccttcaacatcaccagcaacggccacgaggtgttcctgcagtggagcgccgaccacggcaacaacaagaagggcttcagaatcagatacatcgccttctactgcagcacccccgagagccccccccacggctacatcatcagccagaccggcggccagctgaacagcgtggtgagatgggcctgcgacagaggcttcagactggtgggcaagagcagcgccgtgtgcagaaagagcagctacggctaccacgcctgggacgcccccgtgcccgcctgccaggccatcagctgcggcatccccaaggcccccaccaacggcggcatcctgaccaccgactacctggtgggcaccagagtgacctacttctgcaacgacggctacagactgagcagcaaggagctgaccaccgccgtgtgccagagcgacggcacctggagcaaccacaacaagacccccagatgcgtggtggtgacctgccccagcatcaacagcttcatcctggagcacggcagatggagaatcgtgaacggcagccactacgagtacaagaccaaggtggtgttcagctgcgaccccggctaccacggcctgggccccgccagcatcgagtgcctgcccaacggcacctggagctggagaaacgagagaccctactgccagatcatcagctgcggcgagctgcccaccccccccaacggcaacaagatcggcacccagaccagctacggcagcaccgccatcttcacctgcgacctgggcttcatgctggtgggcagcgccgtgagagagtgcctgagcagcggcctgtggagcgagagcgagaccagatgcctggccggccactgcggcatccccgagctgatcgtgaacggccaggtgatcggcgagaactacggctacagagacaccgtggtgtaccagtgcaaccccggcttcagactgatcggcagcagcgtgagaatctgccagcaggaccacaactggagcggccagctgcccagctgcgtgcccgtgagctgcggccaccccggcagccccatctacggcagaaccagcggcaacggcttcaacttcaacgacgtggtgaccttcagctgcaacatcggctacctgatgcagggccccaccaaggcccagtgccaggccaacagacagtggagccaccccccccccatgtgcaaggtggtgaactgcagcgaccccggcatccccgccaacagcaagagagagagcaagatcgagcacggcaacttcacctacggcaccgtggtgttctacgactgcaaccccggctacttcctgttcggcagcagcgtgctgatctgccagcccaacggccagtgggacaagcccctgcccgagtgcatcatgatcgactgcggccaccccggcgtgccccccaacgccgtgctgagcggcgagaagtacaccttcggcagcaccgtgcactacagctgcaccggcaagagaagcctgctgggccagagcagcagaacctgccagctgaacggccactggagcggcagccagccccactgcagcggcgacgccaccggcacctgcggcgaccccggcacccccggccacggcagcagacaggagagcaacttcagaaccaagagcaccgtgagatacgcctgcgacaccggctacatcctgcacggcagcgaggagagaacctgcctggccaacggcagctggaccggcagacagcccgagtgcaaggccgtgcagtgcggcaaccccggcaccaccgccaacggcaaggtgttcagaatcgacggcaccaccttcagcagcagcgtgatctacagctgcatggagggctacatcctgagcggccccagcgtgagacagtgcaccgccaacggcacctggagcggcaccctgcccaactgcaccatcatcagctgcggcgaccccggcatccccgccaacggcctgagatacggcgacgactacgtggtgggccagaacgtgagctacatgtgccagcccggctacaccatggagctgaacggcagcagaatcagaacctgcaccatcaacggcacctggagcggcgtgatgcccacctgcagagccgtgacctgccccacccccccccagatcagcaacggcagactggagggcaccaacttcgactggggcttcagcatcagctacatctgcagccccggctacgagctgagcttccccgccgtgctgacctgcgtgggcaacggcacctggagcggcgaggtgccccagtgcctgcccaagttctgcggcgaccccggcatccccgcccagggcaagagagagggcaagagcttcatctaccagagcgaggtgagcttcagctgcaacttccccttcatcctggtgggcagcagcaccagaatctgccaggccgacggcacctggagcggcagcagcccccactgcatcgagcccacccagaccagctgcgagaaccccggcgtgcccagacacggcagccagaacaacaccttcggcttccaggtgggcagcgtggtgcagttccactgcaagaagggccacctgctgcagggcagcaccaccagaacctgcctgcccgacctgacctggagcggcatccagcccgagtgcatcccccacagctgcaagcagcccgagacccccgcccacgccaacgtggtgggcatggacctgcccagccacggctacaccctgatctacacctgccagcccggcttcttcctggccggcggcaccgagcacagagtgtgcagaagcgacaacacctggaccggcaaggtgcccatctgcgaggccggcagcaagatcctggtgaaggaccccagacccgccctgggcacccccagccccaagctgagcgtgcccgacgacgtgttcgcccagaactacatctggaagggcagctacaacttcaagggcagaaagcagcccatgaccctgaccgtgaccagcttcaacgccagcaccggcagagtgaacgccaccctgagcaacagcaacatggagctgctgctgagcggcgtgtacaagagccaggaggccagactgatgctgagaatctacctgatcaaggtgcccgcccacgccagcgtgaagaagatgaaggaggagaactgggccatggacggcttcgtgagcgccgagcccgacggcgccacctacgtgttccagggcttcatccagggcaaggactacggccagttcggcctgcagagactgggcctgaacatgagcgagggcagcaacagcagcaaccagccccacggcaccaacagcagcagcgtggccatcgccatcctggtgcccttcttcgccctgatcttcgccggcttcggcttctacctgtacaagcagagaaccgcccccaagacccagtacaccggctgcagcgtgcacgagaacaacaacggccaggccgccttcgagaaccccatgtacgacaccaacgccaagagcgtggagggcaaggccgtgagattcgaccccaacctgaacaccgtgtgcaccatggtgtag

SEQ ID NO: 77921 - DNA, 10914 bp, Artificial Sequence
  Description of Artificial Sequence: Synthetic coding sequence
atgaagggcatcagaaagggcgagagcagagccaaggagagcaagccctgggagcccggcaagagaagatgcgccaagtgcggcagactggacttcatcctgatgaagaagatgggcatcaagagcggcttcaccttctggaacctggtgttcctgctgaccgtgagctgcgtgaagggcttcatctacacctgcggcggcaccctgaagggcctgaacggcaccatcgagagccccggcttcccctacggctaccccaacggcgccaactgcacctgggtgatcatcgccgaggagagaaacagaatccagatcgtgttccagagcttcgccctggaggaggagtacgactacctgagcctgtacgacggccacccccaccccaccaacttcagaaccagactgaccggcttccacctgcccccccccgtgaccagcaccaagagcgtgttcagcctgagactgaccagcgacttcgccgtgagcgcccacggcttcaaggtgtactacgaggagctgcagagcagcagctgcggcaaccccggcgtgccccccaagggcgtgctgtacggcaccagattcgacgtgggcgacaagatcagatacagctgcgtgaccggctacatcctggacggccacccccagctgacctgcatcgccaacagcgtgaacaccgccagctgggacttccccgtgcccatctgcagagccgaggacgcctgcggcggcaccatgagaggcagcagcggcatcatcagcagccccagcttccccaacgagtaccacaacaacgccgactgcacctggaccatcgtggccgagcccggcgacaccatcagcctgatcttcaccgacttccagatggaggagaagtacgactacctggagatcgagggcagcgagccccccaccatctggctgagcggcatgaacatccccccccccatcatcagcaacaagaactggctgagactgcacttcgtgaccgacagcaaccacagatacagaggcttcagcgccccctaccagggcagcagcaccctgacccacaccaccagcaccggcgagctggaggagcacaacagaaccaccaccggcgccatcgccgtggccagcacccccgccgacgtgaccgtgagcagcgtgaccgccgtgaccatccacagactgagcgaggagcagagagtgcaggtgaccagcctgagaaacagcggcctggaccccaacaccagcaaggacggcctgagcccccaccccgccgacacccagagcaccagaagaagacccagacacgccgagcagatcgagagaaccaaggagctggccgtggtgacccacagagtgaagaaggccatcgacttcaagagcagaggcttcaagctgttccccggcaaggacaacagcaacaagttcagcatcctgaacgagggcggcatcaagaccgccagcaacctgtgccccgaccccggcgagcccgagaacggcaagagaatcggcagcgacttcagcctgggcagcaccgtgcagttcagctgcgacgaggactacgtgctgcagggcgccaagagcatcacctgccagagaatcgccgaggtgttcgccgcctggagcgaccacagacccgtgtgcaaggtgaagacctgcggcagcaacctgcagggccccagcggcaccttcaccagccccaacttccccttccagtacgacagcaacgcccagtgcgtgtgggtgatcaccgccgtgaacaccaacaaggtgatccagatcaacttcgaggagttcgacctggagatcggctacgacaccctgaccatcggcgacggcggcgaggtgggcgaccccagaaccgtgctgcaggtgctgaccggcagcttcgtgcccgacctgatcgtgagcatgagcagccagatgtggctgcacctgcagaccgacgagagcgtgggcagcgtgggcttcaaggtgaactacaaggagatcgagaaggagagctgcggcgaccccggcacccccctgtacggcatcagagagggcgacggcttcagcaacagagacgtgctgagattcgagtgccagttcggcttcgagctgatcggcgagaagagcatcgtgtgccaggagaacaaccagtggagcgccaacatccccatctgcatcttcccctgcctgagcaacttcaccgcccccatgggcaccgtgctgagccccgactaccccgagggctacggcaacaacctgaactgcatctggaccatcatcagcgaccccggcagcagaatccacctgagcttcaacgacttcgacctggagagccagttcgacttcctggccgtgaaggacggcgacagccccgagagccccatcctgggcaccttcaccggcgccgaggtgcccagccacctgaccagcaacagccacatcctgagactggagttccaggccgaccacagcatgagcggcagaggcttcaacatcacctacaacaccttcggccacaacgagtgccccgaccccggcatccccatcaacgccagaagattcggcgacaacttccagctgggcagcagcatcagcgtgatctgcgaggagggcttcatcaagacccagggcaccgagaccatcacctgcatcctgatggacggcaaggtgatgtggagcggcctgatccccaagtgcggcgccccctgcggcggccacttcagcgcccccagcggcgtgatcctgagccccggctggcccggctactacaaggacagcctgaactgcgagtgggtgatcgaggccgagcccggccacagcatcaagatcaccttcgagagattccagaccgagctgaactacgacgtgctggaggtgcacgacggccccaacctgctgagccccctgctgggcagctacaacggcacccaggtgccccagttcctgttcagcagcagcaacttcatctacctgctgttcaccaccgacaacagcagaagcaacaacggcttcaagatccactacgagagcgtgaccgtgaacacctacagctgcctggaccccggcatccccgtgcacggcagaagatacggccacgacttcagcatcggcagcaccgtgagcttcagctgcgacagcggctacagactgagccacgaggagcccctgctgtgcgagaagaaccactggtggagccaccccctgcccacctgcgacgccctgtgcggcggcgacgtgagaggccccagcggcaccatcctgagccccggctaccccgagttctaccccaacagcctgaactgcacctggaccgtggacgtgacccacggcaagggcgtgcagttcaacttccacaccttccacctggaggaccaccacgactacctgctgatcaccgagaacggcagcttcacccagcccctggccagactgaccggcagcgacctgccccccaccatcaacgccggcctgtacggcaacttcagagcccagctgagattcatcagcgacttcagcatcagctacgagggcttcaacatcaccttcagcgagtacaacctggagccctgcgaggaccccggcatcccccagtacggcagcagaatcggcttcaacttcggcatcggcgacaccctgaccttcagctgcagcagcggctacagactggagggcaccagcgagatcatctgcctgggcggcggcagaagagtgtggagcgcccccctgcccagatgcgtggccgagtgcggcgccagcgccaccaacaacgagggcatcctgctgagccccaactaccccctgaactacgagaacaaccacgagtgcatctacagcatccaggtgcaggccggcaagggcatcaacatcagcgccagaaccttccacctggcccagggcgacgtgctgaagatctacgacggcaaggacaagaccacccacctgctgggcgccttcaccggcgccagcatgagaggcctgaccctgagcagcaccagcaaccagctgtggctggagttcaacagcgacaccgagggcaccgacgagggcttccagctggtgtacaccagcttcgagctgagccactgcgaggaccccggcatcccccagttcggctacaagatcagcgaccagggccacttcgccggcagcaccatcatctacggctgcaaccccggctacaccctgcacggcagcagcctgctgaagtgcatgaccggcgagagaagagcctgggactaccccctgcccagctgcatcgccgagtgcggcggcagattcaagggcgagagcagcggcagaatcctgagccccggctaccccttcccctacgacaacaacctgagatgcatgtggatgatcgaggtggaccccggcaacatcgtgagcctgcagttcctggccttcgacaccgaggccagccacgacatcctgagagtgtgggacggcccccccgagaacgacatgctgctgaaggagatcagcggcagcctgatccccgagggcatccacagcaccctgaacatcgtgaccatccagttcgacaccgacttctacatcagcaagagcggcttcgccatccagttcagcagcagcgtggccaccgcctgcagagaccccggcgtgcccatgaacggcaccagaaacggcgacggcagagagcccggcgacaccgtggtgttccagtgcgaccccggctacgagctgcagggcgaggagagaatcacctgcatccaggtggagaacagatacttctggcagcccagcccccccgtgtgcatcgccccctgcggcggcaacctgaccggcagcagcggcttcatcctgagccccaacttcccccacccctacccccacagcagagactgcgactggaccatcaccgtgaacgccgactacgtgatcagcctggccttcatcagcttcagcatcgagcccaactacgacttcctgtacatctacgacggccccgacagcaacagccccctgatcggcagcttccaggacagcaagctgcccgagagaatcgagagcagcagcaacaccatgcacctggccttcagaagcgacggcagcgtgagctacaccggcttccacctggagtacaaggccaagctgagagagagctgcttcgaccccggcaacatcatgaacggcaccagactgggcatggactacaagctgggcagcaccgtgacctactactgcgacgccggctacgtgctgcagggctacagcaccctgacctgcatcatgggcgacgacggcagacccggctggaacagagccctgcccagctgccacgccccctgcggcagcagaagcaccggcagcgagggcaccgtgctgagccccaactaccccaagaactacagcgtgggccacaactgcgtgtacagcatcgccgtgcccaaggagttcgccgtgcccagaaccagcagcacccagtgcagcagcgtgcccgagcccagattcggcagaagaatcggcaacgagttcgccgtgggcagcagcgtgctgttcgactgcaaccccggctacatcctgcacggcagcatcgccatcagatgcgagaccgtgcccaacagcctggcccagtggaacgacagcctgcccacctgcatcgtgccctgcggcggcatcctgaccaagagaaagggcaccatcctgagccccggctaccccgagccctacgacaacaacctgaactgcgtgtggaagatcaccgtgcccgagggcgccggcatccaggtgcaggtggtgagcttcgccaccgagcacaactgggacagcctggacttctacgacggcggcgacaacaacgcccccagactgggcagctacagcggcaccaccatcccccacctgctgaacagcaccagcaacaacctgtacctgaacttccagagcgacatcagcgtgagcgccgccggcttccacctggagtacaccgccatcggcctggacagctgccccgagccccagacccccagcagcggcatcaagatcggcgacagatacatggtgggcgacgtggtgagcttccagtgcgaccagggctacagcctgcagggccacagccacatcacctgcatgcccggccccgtgagaagatggaactaccccatccccatctgcctggcccagtgcggcggcgccatgagcgacttcagcggcgtgatcctgagccccggcttccccggcaactaccccagcagcctggactgcacctggaccatcaacctgcccatcggcttcggcgtgcacctgcagttcgtgaacttcagcaccgagaccatccacgactacctggaggtgagaagcggcagcagcgagaccagcaccgtgatcggcagactgagcggcccccagatccccagcagcctgttcagcaccacccacgagaccagcctgtacttccacagcgactacagccagaacaagcagggcttccacatcgtgtaccaggcctaccagctgcagagctgccccgaccccagacccttcagaaacggcttcgtgatcggcaacgacttcaccgtgggccagaccatcagcttcgagtgcttccccggctacaccctgatcggcaacagcgccctgacctgcctgcacggcgtgagcagaaactggaaccaccccctgcccagatgcgaggccctgtgcggcggcaacatcaccgccatgaacggcaccatctacagccccggctaccccgacgagtaccccaacttccaggactgcttctggctggtgagagtgccccccggcaacggcatctacatcaacttcaccgtgctgcagaccgagcccatctacgacttcatcaccgtgtgggacggccccgaccagaacagcccccagatcggccagttcagcggcaacaccgccctggagagcgtgtacagcaccagcaaccagatcctgatcaagttccacagcgacttcaccaccagcggcttcttcgtgctgagctaccacgcctaccagctgagagtgtgccagccccccccccccgtgcccaacgccgagatcctgaccgaggacgacgagttcgagatcggcgacatcatcagataccagtgcctgcccggcttcaccctggtgggcaacgccatcctgacctgcagactgggcgagagactgcagatggacggcgccccccccgtgtgccaggtgctgtgccccgccaacgagctgagactggacagcaccggcgtgatcctgagccccggctaccccgacagctaccccaacctgcagatgtgcgcctggagcatcagcgtggagaagggctacaacatcaccatgttcgtggagttcttccagaccgagaaggagttcgacgtgctgcaggtgtacgacggccccaacatccagagccccgtgctgatcagcctgagcggcgactacagcagcgccttcaacatcaccagcaacggccacgaggtgttcctgcagtggagcgccgaccacggcaacaacaagaagggcttcagaatcagatacatcgccttctactgcagcacccccgagagccccccccacggctacatcatcagccagaccggcggccagctgaacagcgtggtgagatgggcctgcgacagaggcttcagactggtgggcaagagcagcgccgtgtgcagaaagagcagctacggctaccacgcctgggacgcccccgtgcccgcctgccaggccatcagctgcggcatccccaaggcccccaccaacggcggcatcctgaccaccgactacctggtgggcaccagagtgacctacttctgcaacgacggctacagactgagcagcaaggagctgaccaccgccgtgtgccagagcgacggcacctggagcaaccacaacaagacccccagatgcgtggtggtgacctgccccagcatcaacagcttcatcctggagcacggcagatggagaatcgtgaacggcagccactacgagtacaagaccaaggtggtgttcagctgcgaccccggctaccacggcctgggccccgccagcatcgagtgcctgcccaacggcacctggagctggagaaacgagagaccctactgccagatcatcagctgcggcgagctgcccaccccccccaacggcaacaagatcggcacccagaccagctacggcagcaccgccatcttcacctgcgacctgggcttcatgctggtgggcagcgccgtgagagagtgcctgagcagcggcctgtggagcgagagcgagaccagatgcctggccggccactgcggcatccccgagctgatcgtgaacggccaggtgatcggcgagaactacggctacagagacaccgtggtgtaccagtgcaaccccggcttcagactgatcggcagcagcgtgagaatctgccagcaggaccacaactggagcggccagctgcccagctgcgtgcccgtgagctgcggccaccccggcagccccatctacggcagaaccagcggcaacggcttcaacttcaacgacgtggtgaccttcagctgcaacatcggctacctgatgcagggccccaccaaggcccagtgccaggccaacagacagtggagccaccccccccccatgtgcaaggtggtgaactgcagcgaccccggcatccccgccaacagcaagagagagagcaagatcgagcacggcaacttcacctacggcaccgtggtgttctacgactgcaaccccggctacttcctgttcggcagcagcgtgctgatctgccagcccaacggccagtgggacaagcccctgcccgagtgcatcatgatcgactgcggccaccccggcgtgccccccaacgccgtgctgagcggcgagaagtacaccttcggcagcaccgtgcactacagctgcaccggcaagagaagcctgctgggccagagcagcagaacctgccagctgaacggccactggagcggcagccagccccactgcagcggcgacgccaccggcacctgcggcgaccccggcacccccggccacggcagcagacaggagagcaacttcagaaccaagagcaccgtgagatacgcctgcgacaccggctacatcctgcacggcagcgaggagagaacctgcctggccaacggcagctggaccggcagacagcccgagtgcaaggccgtgcagtgcggcaaccccggcaccaccgccaacggcaaggtgttcagaatcgacggcaccaccttcagcagcagcgtgatctacagctgcatggagggctacatcctgagcggccccagcgtgagacagtgcaccgccaacggcacctggagcggcaccctgcccaactgcaccatcatcagctgcggcgaccccggcatccccgccaacggcctgagatacggcgacgactacgtggtgggccagaacgtgagctacatgtgccagcccggctacaccatggagctgaacggcagcagaatcagaacctgcaccatcaacggcacctggagcggcgtgatgcccacctgcagagccgtgacctgccccacccccccccagatcagcaacggcagactggagggcaccaacttcgactggggcttcagcatcagctacatctgcagccccggctacgagctgagcttccccgccgtgctgacctgcgtgggcaacggcacctggagcggcgaggtgccccagtgcctgcccaagttctgcggcgaccccggcatccccgcccagggcaagagagagggcaagagcttcatctaccagagcgaggtgagcttcagctgcaacttccccttcatcctggtgggcagcagcaccagaatctgccaggccgacggcacctggagcggcagcagcccccactgcatcgagcccacccagaccagctgcgagaaccccggcgtgcccagacacggcagccagaacaacaccttcggcttccaggtgggcagcgtggtgcagttccactgcaagaagggccacctgctgcagggcagcaccaccagaacctgcctgcccgacctgacctggagcggcatccagcccgagtgcatcccccacagctgcaagcagcccgagacccccgcccacgccaacgtggtgggcatggacctgcccagccacggctacaccctgatctacacctgccagcccggcttcttcctggccggcggcaccgagcacagagtgtgcagaagcgacaacacctggaccggcaaggtgcccatctgcgaggccggcagcaagatcctggtgaaggaccccagacccgccctgggcacccccagccccaagctgagcgtgcccgacgacgtgttcgcccagaactacatctggaagggcagctacaacttcaagggcagaaagcagcccatgaccctgaccgtgaccagcttcaacgccagcaccggcagagtgaacgccaccctgagcaacagcaacatggagctgctgctgagcggcgtgtacaagagccaggaggccagactgatgctgagaatctacctgatcaaggtgcccgcccacgccagcgtgaagaagatgaaggaggagaactgggccatggacggcttcgtgagcgccgagcccgacggcgccacctacgtgttccagggcttcatccagggcaaggactacggccagttcggcctgcagagactgggcctgaacatgagcgagggcagcaacagcagcaaccagccccacggcaccaacagcagcagcgtggccatcgccatcctggtgcccttcttcgccctgatcttcgccggcttcggcttctacctgtacaagcagagaaccgcccccaagacccagtacaccggctgcagcgtgcacgagaacaacaacggccaggccgccttcgagaaccccatgtacgacaccaacgccaagagcgtggagggcaaggccgtgagattcgaccccaacctgaacaccgtgtgcaccatggtgtag

SEQ ID NO: 77922 - DNA, 10617 bp, Artificial Sequence
  Description of Artificial Sequence: Synthetic coding sequence
atgaagggcatcagaaagggcgagagcagagccaaggagagcaagccctgggagcccggcaagagaagatgcgccaagtgcggcagactggacttcatcctgatgaagaagatgggcatcaagagcggcttcaccttctggaacctggtgttcctgctgaccgtgagctgcgtgaagggcttcatctacacctgcggcggcaccctgaagggcctgaacggcaccatcgagagccccggcttcccctacggctaccccaacggcgccaactgcacctgggtgatcatcgccgaggagagaaacagaatccagatcgtgttccagagcttcgccctggaggaggagtacgactacctgagcctgtacgacggccacccccaccccaccaacttcagaaccagactgaccggcttccacctgcccccccccgtgaccagcaccaagagcgtgttcagcctgagactgaccagcgacttcgccgtgagcgcccacggcttcaaggtgtactacgaggagctgcagagcagcagctgcggcaaccccggcgtgccccccaagggcgtgctgtacggcaccagattcgacgtgggcgacaagatcagatacagctgcgtgaccggctacatcctggacggccacccccagctgacctgcatcgccaacagcgtgaacaccgccagctgggacttccccgtgcccatctgcagagccgaggacgcctgcggcggcaccatgagaggcagcagcggcatcatcagcagccccagcttccccaacgagtaccacaacaacgccgactgcacctggaccatcgtggccgagcccggcgacaccatcagcctgatcttcaccgacttccagatggaggagaagtacgactacctggagatcgagggcagcgagccccccaccatctggctgagcggcatgaacatccccccccccatcatcagcaacaagaactggctgagactgcacttcgtgaccgacagcaaccacagatacagaggcttcagcgccccctaccaggtgaagaaggccatcgacttcaagagcagaggcttcaagctgttccccggcaaggacaacagcaacaagttcagcatcctgaacgagggcggcatcaagaccgccagcaacctgtgccccgaccccggcgagcccgagaacggcaagagaatcggcagcgacttcagcctgggcagcaccgtgcagttcagctgcgacgaggactacgtgctgcagggcgccaagagcatcacctgccagagaatcgccgaggtgttcgccgcctggagcgaccacagacccgtgtgcaaggtgaagacctgcggcagcaacctgcagggccccagcggcaccttcaccagccccaacttccccttccagtacgacagcaacgcccagtgcgtgtgggtgatcaccgccgtgaacaccaacaaggtgatccagatcaacttcgaggagttcgacctggagatcggctacgacaccctgaccatcggcgacggcggcgaggtgggcgaccccagaaccgtgctgcaggtgctgaccggcagcttcgtgcccgacctgatcgtgagcatgagcagccagatgtggctgcacctgcagaccgacgagagcgtgggcagcgtgggcttcaaggtgaactacaaggagatcgagaaggagagctgcggcgaccccggcacccccctgtacggcatcagagagggcgacggcttcagcaacagagacgtgctgagattcgagtgccagttcggcttcgagctgatcggcgagaagagcatcgtgtgccaggagaacaaccagtggagcgccaacatccccatctgcatcttcccctgcctgagcaacttcaccgcccccatgggcaccgtgctgagccccgactaccccgagggctacggcaacaacctgaactgcatctggaccatcatcagcgaccccggcagcagaatccacctgagcttcaacgacttcgacctggagagccagttcgacttcctggccgtgaaggacggcgacagccccgagagccccatcctgggcaccttcaccggcgccgaggtgcccagccacctgaccagcaacagccacatcctgagactggagttccaggccgaccacagcatgagcggcagaggcttcaacatcacctacaacaccttcggccacaacgagtgccccgaccccggcatccccatcaacgccagaagattcggcgacaacttccagctgggcagcagcatcagcgtgatctgcgaggagggcttcatcaagacccagggcaccgagaccatcacctgcatcctgatggacggcaaggtgatgtggagcggcctgatccccaagtgcggcgccccctgcggcggccacttcagcgcccccagcggcgtgatcctgagccccggctggcccggctactacaaggacagcctgaactgcgagtgggtgatcgaggccgagcccggccacagcatcaagatcaccttcgagagattccagaccgagctgaactacgacgtgctggaggtgcacgacggccccaacctgctgagccccctgctgggcagctacaacggcacccaggtgccccagttcctgttcagcagcagcaacttcatctacctgctgttcaccaccgacaacagcagaagcaacaacggcttcaagatccactacgagagcgtgaccgtgaacacctacagctgcctggaccccggcatccccgtgcacggcagaagatacggccacgacttcagcatcggcagcaccgtgagcttcagctgcgacagcggctacagactgagccacgaggagcccctgctgtgcgagaagaaccactggtggagccaccccctgcccacctgcgacgccctgtgcggcggcgacgtgagaggccccagcggcaccatcctgagccccggctaccccgagttctaccccaacagcctgaactgcacctggaccgtggacgtgacccacggcaagggcgtgcagttcaacttccacaccttccacctggaggaccaccacgactacctgctgatcaccgagaacggcagcttcacccagcccctggccagactgaccggcagcgacctgccccccaccatcaacgccggcctgtacggcaacttcagagcccagctgagattcatcagcgacttcagcatcagctacgagggcttcaacatcaccttcagcgagtacaacctggagccctgcgaggaccccggcatcccccagtacggcagcagaatcggcttcaacttcggcatcggcgacaccctgaccttcagctgcagcagcggctacagactggagggcaccagcgagatcatctgcctgggcggcggcagaagagtgtggagcgcccccctgcccagatgcgtggccgagtgcggcgccagcgccaccaacaacgagggcatcctgctgagccccaactaccccctgaactacgagaacaaccacgagtgcatctacagcatccaggtgcaggccggcaagggcatcaacatcagcgccagaaccttccacctggcccagggcgacgtgctgaagatctacgacggcaaggacaagaccacccacctgctgggcgccttcaccggcgccagcatgagaggcctgaccctgagcagcaccagcaaccagctgtggctggagttcaacagcgacaccgagggcaccgacgagggcttccagctggtgtacaccagcttcgagctgagccactgcgaggaccccggcatcccccagttcggctacaagatcagcgaccagggccacttcgccggcagcaccatcatctacggctgcaaccccggctacaccctgcacggcagcagcctgctgaagtgcatgaccggcgagagaagagcctgggactaccccctgcccagctgcatcgccgagtgcggcggcagattcaagggcgagagcagcggcagaatcctgagccccggctaccccttcccctacgacaacaacctgagatgcatgtggatgatcgaggtggaccccggcaacatcgtgagcctgcagttcctggccttcgacaccgaggccagccacgacatcctgagagtgtgggacggcccccccgagaacgacatgctgctgaaggagatcagcggcagcctgatccccgagggcatccacagcaccctgaacatcgtgaccatccagttcgacaccgacttctacatcagcaagagcggcttcgccatccagttcagcagcagcgtggccaccgcctgcagagaccccggcgtgcccatgaacggcaccagaaacggcgacggcagagagcccggcgacaccgtggtgttccagtgcgaccccggctacgagctgcagggcgaggagagaatcacctgcatccaggtggagaacagatacttctggcagcccagcccccccgtgtgcatcgccccctgcggcggcaacctgaccggcagcagcggcttcatcctgagccccaacttcccccacccctacccccacagcagagactgcgactggaccatcaccgtgaacgccgactacgtgatcagcctggccttcatcagcttcagcatcgagcccaactacgacttcctgtacatctacgacggccccgacagcaacagccccctgatcggcagcttccaggacagcaagctgcccgagagaatcgagagcagcagcaacaccatgcacctggccttcagaagcgacggcagcgtgagctacaccggcttccacctggagtacaaggccaagctgagagagagctgcttcgaccccggcaacatcatgaacggcaccagactgggcatggactacaagctgggcagcaccgtgacctactactgcgacgccggctacgtgctgcagggctacagcaccctgacctgcatcatgggcgacgacggcagacccggctggaacagagccctgcccagctgccacgccccctgcggcagcagaagcaccggcagcgagggcaccgtgctgagccccaactaccccaagaactacagcgtgggccacaactgcgtgtacagcatcgccgtgcccaaggagttcgtggtgttcggccagttcgtgttcttccagaccagcctgcacgacgtggtggaggtgtacgacggccccacccagcagagcagcctgctgagcagcctgagcggcagccacagcggcgagagcctgcccctgagcagcggcaaccagatcaccatcagattcaccagcgtgggccccatcaccgccaagggcttccacttcgtgtaccaggccgtgcccagaaccagcagcacccagtgcagcagcgtgcccgagcccagattcggcagaagaatcggcaacgagttcgccgtgggcagcagcgtgctgttcgactgcaaccccggctacatcctgcacggcagcatcgccatcagatgcgagaccgtgcccaacagcctggcccagtggaacgacagcctgcccacctgcatcgtgccctgcggcggcatcctgaccaagagaaagggcaccatcctgagccccggctaccccgagccctacgacaacaacctgaactgcgtgtggaagatcaccgtgcccgagggcgccggcatccaggtgcaggtggtgagcttcgccaccgagcacaactgggacagcctggacttctacgacggcggcgacaacaacgcccccagactgggcagctacagcggcaccaccatcccccacctgctgaacagcaccagcaacaacctgtacctgaacttccagagcgacatcagcgtgagcgccgccggcttccacctggagtacaccgccatcggcctggacagctgccccgagccccagacccccagcagcggcatcaagatcggcgacagatacatggtgggcgacgtggtgagcttccagtgcgaccagggctacagcctgcagggccacagccacatcacctgcatgcccggccccgtgagaagatggaactaccccatccccatctgcctggcccagtgcggcggcgccatgagcgacttcagcggcgtgatcctgagccccggcttccccggcaactaccccagcagcctggactgcacctggaccatcaacctgcccatcggcttcggcgtgcacctgcagttcgtgaacttcagcaccgagaccatccacgactacctggaggtgagaagcggcagcagcgagaccagcaccgtgatcggcagactgagcggcccccagatccccagcagcctgttcagcaccacccacgagaccagcctgtacttccacagcgactacagccagaacaagcagggcttccacatcgtgtaccaggcctaccagctgcagagctgccccgaccccagacccttcagaaacggcttcgtgatcggcaacgacttcaccgtgggccagaccatcagcttcgagtgcttccccggctacaccctgatcggcaacagcgccctgacctgcctgcacggcgtgagcagaaactggaaccaccccctgcccagatgcgaggccctgtgcggcggcaacatcaccgccatgaacggcaccatctacagccccggctaccccgacgagtaccccaacttccaggactgcttctggctggtgagagtgccccccggcaacggcatctacatcaacttcaccgtgctgcagaccgagcccatctacgacttcatcaccgtgtgggacggccccgaccagaacagcccccagatcggccagttcagcggcaacaccgccctggagagcgtgtacagcaccagcaaccagatcctgatcaagttccacagcgacttcaccaccagcggcttcttcgtgctgagctaccacgcctaccagctgagagtgtgccagccccccccccccgtgcccaacgccgagatcctgaccgaggacgacgagttcgagatcggcgacatcatcagataccagtgcctgcccggcttcaccctggtgggcaacgccatcctgacctgcagactgggcgagagactgcagatggacggcgccccccccgtgtgccaggtgctgtgccccgccaacgagctgagactggacagcaccggcgtgatcctgagccccggctaccccgacagctaccccaacctgcagatgtgcgcctggagcatcagcgtggagaagggctacaacatcaccatgttcgtggagttcttccagaccgagaaggagttcgacgtgctgcaggtgtacgacggccccaacatccagagccccgtgctgatcagcctgagcggcgactacagcagcgccttcaacatcaccagcaacggccacgaggtgttcctgcagtggagcgccgaccacggcaacaacaagaagggcttcagaatcagatacatcgccttctactgcagcacccccgagagccccccccacggctacatcatcagccagaccggcggccagctgaacagcgtggtgagatgggcctgcgacagaggcttcagactggtgggcaagagcagcgccgtgtgcagaaagagcagctacggctaccacgcctgggacgcccccgtgcccgcctgccaggccatcagctgcggcatccccaaggcccccaccaacggcggcatcctgaccaccgactacctggtgggcaccagagtgacctacttctgcaacgacggctacagactgagcagcaaggagctgaccaccgccgtgtgccagagcgacggcacctggagcaaccacaacaagacccccagatgcgtggtgatcagctgcggcgagctgcccaccccccccaacggcaacaagatcggcacccagaccagctacggcagcaccgccatcttcacctgcgacctgggcttcatgctggtgggcagcgccgtgagagagtgcctgagcagcggcctgtggagcgagagcgagaccagatgcctggccggccactgcggcatccccgagctgatcgtgaacggccaggtgatcggcgagaactacggctacagagacaccgtggtgtaccagtgcaaccccggcttcagactgatcggcagcagcgtgagaatctgccagcaggaccacaactggagcggccagctgcccagctgcgtgcccgtgagctgcggccaccccggcagccccatctacggcagaaccagcggcaacggcttcaacttcaacgacgtggtgaccttcagctgcaacatcggctacctgatgcagggccccaccaaggcccagtgccaggccaacagacagtggagccaccccccccccatgtgcaaggtggtgaactgcagcgaccccggcatccccgccaacagcaagagagagagcaagatcgagcacggcaacttcacctacggcaccgtggtgttctacgactgcaaccccggctacttcctgttcggcagcagcgtgctgatctgccagcccaacggccagtgggacaagcccctgcccgagtgcatcatgatcgactgcggccaccccggcgtgccccccaacgccgtgctgagcggcgagaagtacaccttcggcagcaccgtgcactacagctgcaccggcaagagaagcctgctgggccagagcagcagaacctgccagctgaacggccactggagcggcagccagccccactgcagcggcgacgccaccggcacctgcggcgaccccggcacccccggccacggcagcagacaggagagcaacttcagaaccaagagcaccgtgagatacgcctgcgacaccggctacatcctgcacggcagcgaggagagaacctgcctggccaacggcagctggaccggcagacagcccgagtgcaaggccgtgcagtgcggcaaccccggcaccaccgccaacggcaaggtgttcagaatcgacggcaccaccttcagcagcagcgtgatctacagctgcatggagggctacatcctgagcggccccagcgtgagacagtgcaccgccaacggcacctggagcggcaccctgcccaactgcaccatcatcagctgcggcgaccccggcatccccgccaacggcctgagatacggcgacgactacgtggtgggccagaacgtgagctacatgtgccagcccggctacaccatggagctgaacggcagcagaatcagaacctgcaccatcaacggcacctggagcggcgtgatgcccacctgcagagccgtgacctgccccacccccccccagatcagcaacggcagactggagggcaccaacttcgactggggcttcagcatcagctacatctgcagccccggctacgagctgagcttccccgccgtgctgacctgcgtgggcaacggcacctggagcggcgaggtgccccagtgcctgcccaagttctgcggcgaccccggcatccccgcccagggcaagagagagggcaagagcttcatctaccagagcgaggtgagcttcagctgcaacttccccttcatcctggtgggcagcagcaccagaatctgccaggccgacggcacctggagcggcagcagcccccactgcatcgagcccacccagaccagctgcgagaaccccggcgtgcccagacacggcagccagaacaacaccttcggcttccaggtgggcagcgtggtgcagttccactgcaagaagggccacctgctgcagggcagcaccaccagaacctgcctgcccgacctgacctggagcggcatccagcccgagtgcatcccccacagctgcaagcagcccgagacccccgcccacgccaacgtggtgggcatggacctgcccagccacggctacaccctgatctacacctgccagcccggcttcttcctggccggcggcaccgagcacagagtgtgcagaagcgacaacacctggaccggcaaggtgcccatctgcgaggccggcagcaagatcctggtgaaggaccccagacccgccctgggcacccccagccccaagctgagcgtgcccgacgacgtgttcgcccagaactacatctggaagggcagctacaacttcaagggcagaaagcagcccatgaccctgaccgtgaccagcttcaacgccagcaccggcagagtgaacgccaccctgagcaacagcaacatggagctgctgctgagcggcgtgtacaagagccaggaggccagactgatgctgagaatctacctgatcaaggtgcccgcccacgccagcgtgaagaagatgaaggaggagaactgggccatggacggcttcgtgagcgccgagcccgacggcgccacctacgtgttccagggcttcatccagggcaaggactacggccagttcggcctgcagagactgggcctgaacatgagcgagggcagcaacagcagcaaccagccccacggcaccaacagcagcagcgtggccatcgccatcctggtgcccttcttcgccctgatcttcgccggcttcggcttctacctgtacaagcagagaaccgcccccaagacccagtacaccggctgcagcgtgcacgagaacaacaacggccaggccgccttcgagaaccccatgtacgacaccaacgccaagagcgtggagggcaaggccgtgagattcgaccccaacctgaacaccgtgtgcaccatggtgtag

SEQ ID NO: 77923 - DNA, 2511 bp, Artificial Sequence
  Description of Artificial Sequence: Synthetic coding sequence
atggccggcctgaactgcggcgtgagcatcgccctgctgggcgtgctgctgctgggcgccgccagactgcccagaggcgccgaggccttcgagatcgccctgcccagagagagcaacatcaccgtgctgatcaagctgggcacccccaccctgctggccaagccctgctacatcgtgatcagcaagagacacatcaccatgctgagcatcaagagcggcgagagaatcgtgttcaccttcagctgccagagccccgagaaccacttcgtgatcgagatccagaagaacatcgactgcatgagcggcccctgccccttcggcgaggtgcagctgcagcccagcaccagcctgctgcccaccctgaacagaaccttcatctgggacgtgaaggcccacaagagcatcggcctggagctgcagttcagcatccccagactgagacagatcggccccggcgagagctgccccgacggcgtgacccacagcatcagcggcagaatcgacgccaccgtggtgagaatcggcaccttctgcagcaacggcaccgtgagcagaatcaagatgcaggagggcgtgaagatggccctgcacctgccctggttccaccccagaaacgtgagcggcttcagcatcgccaacagaagcagcatcaagagactgtgcatcatcgagagcgtgttcgagggcgagggcagcgccaccctgatgagcgccaactaccccgagggcttccccgaggacgagctgatgacctggcagttcgtggtgcccgcccacctgagagccagcgtgagcttcctgaacttcaacctgagcaactgcgagagaaaggaggagagagtggagtactacatccccggcagcaccaccaaccccgaggtgttcaagctggaggacaagcagcccggcaacatggccggcaacttcaacctgagcctgcagggctgcgaccaggacgcccagagccccggcatcctgagactgcagttccaggtgctggtgcagcacccccagaacgagagcaacaagatctacgtggtggacctgagcaacgagagagccatgagcctgaccatcgagcccagacccgtgaagcagagcagaaagttcgtgcccggctgcttcgtgtgcctggagagcagaacctgcagcagcaacctgaccctgaccagcggcagcaagcacaagatcagcttcctgtgcgacgacctgaccagactgtggatgaacgtggagaagaccatcagctgcaccgaccacagatactgccagagaaagagctacagcctgcaggtgcccagcgacatcctgcacctgcccgtggagctgcacgacttcagctggaagctgctggtgcccaaggacagactgagcctggtgctggtgcccgcccagaagctgcagcagcacacccacgagaagccctgcaacaccagcttcagctacctggtggccagcgccatccccagccaggacctgtacttcggcagcttctgccccggcggcagcatcaagcagatccaggtgaagcagaacatcagcgtgaccctgagaaccttcgcccccagcttccagcaggaggccagcagacagggcctgaccgtgagcttcatcccctacttcaaggaggagggcgtgttcaccgtgacccccgacaccaagagcaaggtgtacctgagaacccccaactgggacagaggcctgcccagcctgaccagcgtgagctggaacatcagcgtgcccagagaccaggtggcctgcctgaccttcttcaaggagagaagcggcgtggtgtgccagaccggcagagccttcatgatcatccaggagcagagaaccagagccgaggagatcttcagcctggacgaggacgtgctgcccaagcccagcttccaccaccacagcttctgggtgaacatcagcaactgcagccccaccagcggcaagcagctggacctgctgttcagcgtgaccctgacccccagaaccgtggacctgaccgtgatcctgatcgccgccgtgggcggcggcgtgctgctgctgagcgccctgggcctgatcatctgctgcgtgaagaagaagaagaagaagaccaacaagggccccgccgtgggcatctacaacgacaacatcaacaccgagatgcccagacagcccaagaagttccagaagggcagaaaggacaacgacagccacgtgtacgccgtgatcgaggacaccatggtgtacggccacctgctgcaggacagcagcggcagcttcctgcagcccgaggtggacacctacagacccttccagggcaccatgggcgtgtgcccccccagcccccccaccatctgcagcagagcccccaccgccaagctggccaccgaggagcccccccccagaagcccccccgagagcgagagcgagccctacaccttcagccaccccaacaacggcgacgtgagcagcaaggacaccgacatccccctgctgaacacccaggagcccatggagcccgccgagtag

SEQ ID NO: 77924 - DNA, 1032 bp, Artificial Sequence
  Description of Artificial Sequence: Synthetic coding sequence
atggccggcctgaactgcggcgtgagcatcgccctgctgggcgtgctgctgctgggcgccgccagactgcccagaggcgccgaggccttcgagatcgccctgcccagagagagcaacatcaccgtgctgatcaagctgggcacccccaccctgctggccaagccctgctacatcgtgatcagcaagagacacatcaccatgctgagcatcaagagcggcgagagaatcgtgttcaccttcagctgccagagccccgagaaccacttcgtgatcgagatccagaagaacatcgactgcatgagcggcccctgccccttcggcgaggtgcagctgcagcccagcaccagcctgctgcccaccctgaacagaaccttcatctgggacgtgaaggcccacaagagcatcggcctggagctgcagttcagcatccccagactgagacagatcggccccggcgagagctgccccgacggcgtgacccacagcatcagcggcagaatcgacgccaccgtggtgagaatcggcaccttctgcagcaacggcaccgtgagcagaatcaagatgcaggagggcgtgaagatggccctgcacctgccctggttccaccccagaaacgtgagcggcttcagcatcgccaacagaagcagcatcaagagactgtgcatcatcgagagcgtgttcgagggcgagggcagcgccaccctgatgagcgccaactaccccgagggcttccccgaggacgagctgatgacctggcagttcgtggtgcccgcccacctgagagccagcgtgagcttcctgaacttcaacctgagcaactgcgagagaaaggaggagagagtggagtactacatccccggcagcaccaccaaccccgaggtgttcaagctggaggacaagcagcccggcaacatggccggcaacttcaacctgagcctgcagggctgcgaccaggacgcccagagccccggcatcctgagactgcagttccaggtgctggtgcagcacccccagaacgagagcagcgagtag

SEQ ID NO: 77925 - DNA, 513 bp, Artificial Sequence
  Description of Artificial Sequence: Synthetic coding sequence
atgatgaacatgagcctgcccttcctgtggagcctgctgaccctgctgatcttcgccgaggtgaacggcgaggccggcgagctggagctgcagagacagaagagaagcatcaacctgcagcagcccagaatggccaccgagagaggcaacctggtgttcctgaccggcagcgcccagaacatcgagttcagaaccggcagcctgggcaagatcaagctgaacgacgaggacctgagcgagtgcctgcaccagatccagaagaacaaggaggacatcatcgagctgaagggcagcgccatcggcctgccccagaacatcagcagccagatctaccagctgaacagcaagctggtggacctggagagaaagttccagggcctgcagcagaccgtggacaagaaggtgtgcagcagcaacccctgccagaacggcggcacctgcctgaacctgcacgacagcttcttctgcatctgccccccccagtggaaggtgagccacctgctgttcggctag

SEQ ID NO: 77926 - DNA, 10872 bp, Artificial Sequence
  Description of Artificial Sequence: Synthetic coding sequence
atgatgaacatgagcctgcccttcctgtggagcctgctgaccctgctgatcttcgccgaggtgaacggcgaggccggcgagctggagctgcagagacagaagagaagcatcaacctgcagcagcccagaatggccaccgagagaggcaacctggtgttcctgaccggcagcgcccagaacatcgagttcagaaccggcagcctgggcaagatcaagctgaacgacgaggacctgagcgagtgcctgcaccagatccagaagaacaaggaggacatcatcgagctgaagggcagcgccatcggcctgccccagaacatcagcagccagatctaccagctgaacagcaagctggtggacctggagagaaagttccagggcctgcagcagaccgtggacaagaaggtgtgcagcagcaacccctgccagaacggcggcacctgcctgaacctgcacgacagcttcttctgcatctgccccccccagtggaagggccccctgtgcagcgccgacgtgaacgagtgcgagatctacagcggcacccccctgagctgccagaacggcggcacctgcgtgaacaccatgggcagctacagctgccactgcccccccgagacctacggcccccagtgcgccagcaagtacgacgactgcgagggcggcagcgtggccagatgcgtgcacggcatctgcgaggacctgatgagagagcaggccggcgagcccaagtacagctgcgtgtgcgacgccggctggatgttcagccccaacagccccgcctgcaccctggacagagacgagtgcagcttccagcccggcccctgcagcaccctggtgcagtgcttcaacacccagggcagcttctactgcggcgcctgccccaccggctggcagggcaacggctacatctgcgaggacatcaacgagtgcgagatcaacaacggcggctgcagcgtggccccccccgtggagtgcgtgaacacccccggcagcagccactgccaggcctgcccccccggctaccagggcgacggcagagtgtgcaccctgaccgacatctgcagcgtgagcaacggcggctgccaccccgacgccagctgcagcagcaccctgggcagcctgcccctgtgcacctgcctgcccggctacaccggcaacggctacggccccaacggctgcgtgcagctgagcaacatctgcctgagccacccctgcctgaacggccagtgcatcgacaccgtgagcggctacttctgcaagtgcgacagcggctggaccggcgtgaactgcaccgagaacatcaacgagtgcctgagcaacccctgcctgaacggcggcacctgcgtggacggcgtggacagcttcagctgcgagtgcaccagactgtggaccggcgccctgtgccaggtgccccagcaggtgtgcggcgagagcctgagcggcatcaacggcagcttcagctacagaagccccgacgtgggctacgtgcacgacgtgaactgcttctgggtgatcaagaccgagatgggcaaggtgctgagaatcaccttcaccttcttcagactggagagcatggacaactgcccccacgagttcctgcaggtgtacgacggcgacagcagcagcgccttccagctgggcagattctgcggcagcagcctgccccacgagctgctgagcagcgacaacgccctgtacttccacctgtacagcgagcacctgagaaacggcagaggcttcaccgtgagatgggagacccagcagcccgagtgcggcggcatcctgaccggcccctacggcagcatcaagagccccggctaccccggcaactacccccccggcagagactgcgtgtggatcgtggtgaccagccccgacctgctggtgaccttcaccttcggcaccctgagcctggagcaccacgacgactgcaacaaggactacctggagatcagagacggccccctgtaccaggaccccctgctgggcaagttctgcaccaccttcagcgtgccccccctgcagaccaccggccccttcgccagaatccacttccacagcgacagccagatcagcgaccagggcttccacatcacctacctgaccagccccagcgacctgagatgcggcggcaactacaccgaccccgagggcgagctgttcctgcccgagctgagcggccccttcacccacaccagacagtgcgtgtacatgatgaagcagccccagggcgagcagatccagatcaacttcacccacgtggagctgcagtgccagagcgacagcagccagaactacatcgaggtgagagacggcgagaccctgctgggcaaggtgtgcggcaacggcaccatcagccacatcaagagcatcaccaacagcgtgtggatcagattcaagatcgacgccagcgtggagaaggccagcttcagagccgtgtaccaggtggcctgcggcgacgagctgaccggcgagggcgtgatcagaagccccttcttccccaacgtgtaccccggcgagagaacctgcagatggaccatccaccagccccagagccaggtgatcctgctgaacttcaccgtgttcgagatcggcagcagcgcccactgcgagaccgactacgtggagatcggcagcagcagcatcctgggcagccccgagaacaagaagtactgcggcaccgacatccccagcttcatcaccagcgtgtacaacttcctgtacgtgaccttcgtgaagagcagcagcaccgagaaccacggcttcatggccaagttcagcgccgaggacctggcctgcggcgagatcctgaccgagagcaccggcaccatccagagccccggccaccccaacgtgtacccccacggcatcaactgcacctggcacatcctggtgcagcccaaccacctgatccacctgatgttcgagaccttccacctggagttccactacaactgcaccaacgactacctggaggtgtacgacaccgacagcgagaccagcctgggcagatactgcggcaagagcatcccccccagcctgaccagcagcggcaacagcctgatgctggtgttcgtgaccgacagcgacctggcctacgagggcttcctgatcaactacgaggccatcagcgccgccaccgcctgcctgcaggactacaccgacgacctgggcaccttcaccagccccaacttccccaacaactaccccaacaactgggagtgcatctacagaatcaccgtgagaaccggccagctgatcgccgtgcacttcaccaacttcagcctggaggaggccatcggcaactactacaccgacttcctggagatcagagacggcggctacgagaagagccccctgctgggcatcttctacggcagcaacctgccccccaccatcatcagccacagcaacaagctgtggctgaagttcaagagcgaccagatcgacaccagaagcggcttcagcgcctactgggacggcagcagcaccggctgcggcggcaacctgaccaccagcagcggcaccttcatcagccccaactaccccatgccctactaccacagcagcgagtgctactggtggctgaagagcagccacggcagcgccttcgagctggagttcaaggacttccacctggagcaccaccccaactgcaccctggactacctggccgtgtacgacggccccagcagcaacagccacctgctgacccagctgtgcggcgacgagaagccccccctgatcagaagcagcggcgacagcatgttcatcaagctgagaaccgacgagggccagcagggcagaggcttcaaggccgagtacagacagacctgcgagaacgtggtgatcgtgaaccagacctacggcatcctggagagcatcggctaccccaacccctacagcgagaaccagcactgcaactggaccatcagagccaccaccggcaacaccgtgaactacaccttcctggccttcgacctggagcaccacatcaactgcagcaccgactacctggagctgtacgacggccccagacagatgggcagatactgcggcgtggacctgcccccccccggcagcaccaccagcagcaagctgcaggtgctgctgctgaccgacggcgtgggcagaagagagaagggcttccagatgcagtggttcgtgtacggctgcggcggcgagctgagcggcgccaccggcagcttcagcagccccggcttccccaacagatacccccccaacaaggagtgcatctggtacatcagaaccgaccccggcagcagcatccagctgaccatccacgacttcgacgtggagtaccacagcagatgcaacttcgacgtgctggagatctacggcggccccgacttccacagccccagaatcgcccagctgtgcacccagagaagccccgagaaccccatgcaggtgagcagcaccggcaacgagctggccatcagattcaagaccgacctgagcatcaacggcagaggcttcaacgccagctggcaggccgtgaccggcggctgcggcggcatcttccaggcccccagcggcgagatccacagccccaactaccccagcccctacagaagcaacaccgactgcagctgggtgatcagagtggacagaaaccacagagtgctgctgaacttcaccgacttcgacctggagccccaggacagctgcatcatggcctacgacggcctgagcagcaccatgagcagactggccagaacctgcggcagagagcagctggccaaccccatcgtgagcagcggcaacagcctgttcctgagattccagagcggccccagcagacagaacagaggcttcagagcccagttcagacaggcctgcggcggccacatcctgaccagcagcttcgacaccgtgagcagccccagattccccgccaactaccccaacaaccagaactgcagctggatcatccaggcccagccccccctgaaccacatcaccctgagcttcacccacttcgagctggagagaagcaccacctgcgccagagacttcgtggagatcctggacggcggccacgaggacgcccccctgagaggcagatactgcggcaccgacatgccccaccccatcaccagcttcagcagcgccctgaccctgagattcgtgagcgacagcagcatcagcgccggcggcttccacaccaccgtgaccgccagcgtgagcgcctgcggcggcaccttctacatggccgagggcatcttcaacagccccggctaccccgacatctacccccccaacgtggagtgcgtgtggaacatcgtgagcagccccggcaacagactgcagctgagcttcatcagcttccagctggaggacagccaggactgcagcagagacttcgtggagatcagagagggcaacgccaccggccacctggtgggcagatactgcggcaacagcttccccctgaactacagcagcatcgtgggccacaccctgtgggtgagattcatcagcgacggcagcggcagcggcaccggcttccaggccaccttcatgaagatcttcggcaacgacaacatcgtgggcacccacggcaaggtggccagccccttctggcccgagaactacccccacaacagcaactaccagtggaccgtgaacgtgaacgccagccacgtggtgcacggcagaatcctggagatggacatcgaggagatccagaactgctactacgacaagctgagaatctacgacggccccagcatccacgccagactgatcggcgcctactgcggcacccagaccgagagcttcagcagcaccggcaacagcctgaccttccacttctacagcgacagcagcatcagcggcaagggcttcctgctggagtggttcgccgtggacgcccccgacggcgtgctgcccaccatcgcccccggcgcctgcggcggcttcctgagaaccggcgacgcccccgtgttcctgttcagccccggctggcccgacagctacagcaacagagtggactgcacctggctgatccaggcccccgacagcaccgtggagctgaacatcctgagcctggacatcgagagccacagaacctgcgcctacgacagcctggtgatcagagacggcgacaacaacctggcccagcagctggccgtgctgtgcggcagagagatccccggccccatcagaagcaccggcgagtacatgttcatcagattcaccagcgacagcagcgtgaccagagccggcttcaacgccagcttccacaagagctgcggcggctacctgcacgccgacagaggcatcatcaccagccccaagtaccccgagacctaccccagcaacctgaactgcagctggcacgtgctggtgcagagcggcctgaccatcgccgtgcacttcgagcagcccttccagatccccaacggcgacagcagctgcaaccagggcgactacctggtgctgagaaacggccccgacatctgcagcccccccctgggcccccccggcggcaacggccacttctgcggcagccacgccagcagcaccctgttcaccagcgacaaccagatgttcgtgcagttcatcagcgaccacagcaacgagggccagggcttcaagatcaagtacgaggccaagagcctggcctgcggcggcaacgtgtacatccacgacgccgacagcgccggctacgtgaccagccccaaccacccccacaactaccccccccacgccgactgcatctggatcctggccgccccccccgagaccagaatccagctgcagttcgaggacagattcgacatcgaggtgacccccaactgcaccagcaactacctggagctgagagacggcgtggacagcgacgcccccatcctgagcaagttctgcggcaccagcctgcccagcagccagtggagcagcggcgaggtgatgtacctgagattcagaagcgacaacagccccacccacgtgggcttcaaggccaagtacagcatcgcccagtgcggcggcagagtgcccggccagagcggcgtggtggagagcatcggccaccccaccctgccctacagagacaacctgttctgcgagtggcacctgcagggcctgagcggccactacctgaccatcagcttcgaggacttcaacctgcagaacagcagcggctgcgagaaggacttcgtggagatctgggacaaccacaccagcggcaacatcctgggcagatactgcggcaacaccatccccgacagcatcgacaccagcagcaacaccgccgtggtgagattcgtgaccgacggcagcgtgaccgccagcggcttcagactgagattcgagagcagcatggaggagtgcggcggcgacctgcagggcagcatcggcaccttcaccagccccaactaccccaaccccaacccccacggcagaatctgcgagtggagaatcaccgcccccgagggcagaagaatcaccctgatgttcaacaacctgagactggccacccaccccagctgcaacaacgagcacgtgatcgtgttcaacggcatcagaagcaacagcccccagctggagaagctgtgcagcagcgtgaacgtgagcaacgagatcaagagcagcggcaacaccatgaaggtgatcttcttcaccgacggcagcagaccctacggcggcttcaccgccagctacaccagcagcgaggacgccgtgtgcggcggcagcctgcccaacacccccgagggcaacttcaccagccccggctacgacggcgtgagaaactacagcagaaacctgaactgcgagtggaccctgagcaaccccaaccagggcaacagcagcatcagcatccacttcgaggacttctacctggagagccaccaggactgccagttcgacgtgctggagttcagagtgggcgacgccgacggccccctgatgtggagactgtgcggccccagcaagcccaccctgcccctggtgatcccctacagccaggtgtggatccacttcgtgaccaacgagagagtggagcacatcggcttccacgccaagtacagcttcaccgactgcggcggcatccagatcggcgacagcggcgtgatcaccagccccaactaccccaacgcctacgacagcctgacccactgcagcagcctgctggaggccccccagggccacaccatcaccctgaccttcagcgacttcgacatcgagccccacaccacctgcgcctgggacagcgtgaccgtgagaaacggcggcagccccgagagccccatcatcggccagtactgcggcaacagcaaccccagaaccatccagagcggcagcaaccagctggtggtgaccttcaacagcgaccacagcctgcagggcggcggcttctacgccacctggaacacccagaccctgggctgcggcggcatcttccacagcgacaacggcaccatcagaagcccccactggccccagaacttccccgagaacagcagatgcagctggaccgccatcacccacaagagcaagcacctggagatcagcttcgacaacaacttcctgatccccagcggcgacggccagtgccagaacagcttcgtgaaggtgtgggccggcaccgaggaggtggacaaggccctgctggccaccggctgcggcaacgtggcccccggccccgtgatcacccccagcaacaccttcaccgccgtgttccagagccaggaggcccccgcccagggcttcagcgccagcttcgtgagcagatgcggcagcaacttcaccggccccagcggctacatcatcagccccaactaccccaagcagtacgacaacaacatgaactgcacctacgtgatcgaggccaaccccctgagcgtggtgctgctgaccttcgtgagcttccacctggaggccagaagcgccgtgaccggcagctgcgtgaacgacggcgtgcacatcatcagaggctacagcgtgatgagcacccccttcgccaccgtgtgcggcgacgagatgcccgcccccctgaccatcgccggccccgtgctgctgaacttctacagcaacgagcagatcaccgacttcggcttcaagttcagctacagaatcatcagctgcggcggcgtgttcaacttcagcagcggcatcatcaccagccccgcctacagctacgccgactaccccaacgacatgcactgcctgtacaccatcaccgtgagcgacgacaaggtgatcgagctgaagttcagcgacttcgacgtggtgcccagcaccagctgcagccacgactacctggccatctacgacggcgccaacaccagcgaccccctgctgggcaagttctgcggcagcaagagaccccccaacgtgaagagcagcaacaacagcatgctgctggtgttcaagaccgacagcttccagaccgccaagggctggaagatgagcttcagacagaccctgggcccccagcagggctgcggcggctacctgaccggcagcaacaacaccttcgccagccccgacagcgacagcaacggcatgtacgacaagaacctgaactgcgtgtggatcatcatcgcccccgtgaacaaggtgatccacctgaccttcaacaccttcgccctggaggccgccagcaccagacagagatgcctgtacgactacgtgaagctgtacgacggcgacagcgagaacgccaacctggccggcaccttctgcggcagcaccgtgcccgcccccttcatcagcagcggcaacttcctgaccgtgcagttcatcagcgacctgaccctggagagagagggcttcaacgccacctacaccatcatggacatgccctgcggcggcacctacaacgccacctggaccccccagaacatcagcagccccaacagcagcgaccccgacgtgcccttcagcatctgcacctgggtgatcgacagccccccccaccagcaggtgaagatcaccgtgtgggccctgcagctgaccagccaggactgcacccagaactacctgcagctgcaggacagcccccagggccacggcaacagcagattccagttctgcggcagaaacgccagcgccgtgcccgtgttctacagcagcatgagcaccgccatggtgatcttcaagagcggcgtggtgaacagaaacagcagaatgagcttcacctaccagatcgccgactgcaacagagactaccacaaggccttcggcaacctgagaagccccggctggcccgacaactacgacaacgacaaggactgcaccgtgaccctgaccgccccccagaaccacaccatcagcctgttcttccacagcctgggcatcgagaacagcgtggagtgcagaaacgacttcctggaggtgagaaacggcagcaacagcaacagccccctgctgggcaagtactgcggcaccctgctgcccaaccccgtgttcagccagaacaacgagctgtacctgagattcaagagcgacagcgtgaccagcgacagaggctacgagatcatctggaccagcagccccagcggctgcggcggcaccctgtacggcgacagaggcagcttcaccagccccggctaccccggcacctaccccaacaacacctactgcgagtgggtgctggtggcccccgccggcagactggtgaccatcaacttctacttcatcagcatcgacgaccccggcgactgcgtgcagaactacctgaccctgtacgacggccccaacgccagcagccccagcagcggcccctactgcggcggcgacaccagcatcgcccccttcgtggccagcagcaaccaggtgttcatcaagttccacgccgactacgccagaagacccagcgccttcagactgacctgggacagctag

SEQ ID NO: 77927 - DNA, 318 bp, Artificial Sequence
  Description of Artificial Sequence: Synthetic coding sequence
aacagcaagctggtggacctggagagaaagttccagggcctgcagcagaccgtggacaagaaggtgtgcagcagcaacccctgccagaacggcggcacctgcctgaacctgcacgacagcttcttctgcatctgccccccccagtggaagggccccctgtgcagcgccgacgtgaacgagtgcgagatctacagcggcacccccctgagctgccagaacggcggcacctgcgtgaacaccatgggcagctacagaaacccctgcagcaacatccccaaggagcccgaggagggcagcagagactggcacagagagtag

SEQ ID NO: 77928 - DNA, 267 bp, Artificial Sequence
  Description of Artificial Sequence: Synthetic coding sequence
agcaccggcaacgagctggccatcagattcaagaccgacctgagcatcaacggcagaggcttcaacgccagctggcaggccgtgaccggcggctgcggcggcatcttccaggcccccagcggcgagatccacagccccaactaccccagcccctacagaagcaacaccgactgcagctgggtgatcagagtggacagaaaccacagagtgctgctgaacttcaccgacttcgacctggagccccaggacagctgcatcatggtgtag

SEQ ID NO: 77929 - DNA, 1395 bp, Artificial Sequence
  Description of Artificial Sequence: Synthetic coding sequence
atgagccacagctggaacgtgctgtggctgaccttctgcagcgacagcaacggcatgtacgacaagaacctgaactgcgtgtggatcatcatcgcccccgtgaacaaggtgatccacctgaccttcaacaccttcgccctggaggccgccagcaccagacagagatgcctgtacgactacgtgaagctgtacgacggcgacagcgagaacgccaacctggccggcaccttctgcggcagcaccgtgcccgcccccttcatcagcagcggcaacttcctgaccgtgcagttcatcagcgacctgaccctggagagagagggcttcaacgccacctacaccatcatggacatgccctgcggcggcacctacaacgccacctggaccccccagaacatcagcagccccaacagcagcgaccccgacgtgcccttcagcatctgcacctgggtgatcgacagccccccccaccagcaggtgaagatcaccgtgtgggccctgcagctgaccagccaggactgcacccagaactacctgcagctgcaggacagcccccagggccacggcaacagcagattccagttctgcggcagaaacgccagcgccgtgcccgtgttctacagcagcatgagcaccgccatggtgatcttcaagagcggcgtggtgaacagaaacagcagaatgagcttcacctaccagatcgccgactgcaacagagactaccacaaggccttcggcaacctgagaagccccggctggcccgacaactacgacaacgacaaggactgcaccgtgaccctgaccgccccccagaaccacaccatcagcctgttcttccacagcctgggcatcgagaacagcgtggagtgcagaaacgacttcctggaggtgagaaacggcagcaacagcaacagccccctgctgggcaagtactgcggcaccctgctgcccaaccccgtgttcagccagaacaacgagctgtacctgagattcaagagcgacagcgtgaccagcgacagaggctacgagatcatctggaccagcagccccagcggctgcggcggcaccctgtacggcgacagaggcagcttcaccagccccggctaccccggcacctaccccaacaacacctactgcgagtgggtgctggtggcccccgccggcagactggtgaccatcaacttctacttcatcagcatcgacgaccccggcgactgcgtgcagaactacctgaccctgtacgacggccccaacgccagcagccccagcagcggcccctactgcggcggcgacaccagcatcgcccccttcgtggccagcagcaaccaggtgttcatcaagttccacgccgactacgccagaagacccagcgccttcagactgacctgggacagctag

SEQ ID NO: 77930 - DNA, 864 bp, Artificial Sequence
  Description of Artificial Sequence: Synthetic coding sequence
atggagctggagagaatcgtgagcgccgccctgctggccttcgtgcagacccacctgcccgaggccgacctgagcggcctggacgaggtgatcttcagctacgtgctgggcgtgctggaggacctgggccccagcggccccagcgaggagaacttcgacatggaggccttcaccgagatgatggaggcctacgtgcccggcttcgcccacatccccagaggcaccatcggcgacatgatgcagaagctgagcggccagctgagcgacgccagaaacaaggagaacctgcagccccagagcagcggcgtgcagggccaggtgcccatcagccccgagcccctgcagagacccgagatgctgaaggaggagaccagaagcagcgccgccgccgccgccgacacccaggacgaggccaccggcgccgaggaggagctgctgcccggcgtggacgtgctgctggaggtgttccccacctgcagcgtggagcaggcccagtgggtgctggccaaggccagaggcgacctggaggaggccgtgcagatgctggtggagggcaaggaggagggccccgccgcctgggagggccccaaccaggacctgcccagaagactgagaggcccccagaaggacgagctgaagagcttcatcctgcagaagtacatgatggtggacagcgccgaggaccagaagatccacagacccatggcccccaaggaggcccccaagaagctgatcagatacatcgacaaccaggtggtgagcaccaagggcgagagattcaaggacgtgagaaaccccgaggccgaggagatgaaggccacctacatcaacctgaagcccgccagaaagtacagattccactag

SEQ ID NO: 77931 - DNA, 1365 bp, Artificial Sequence
  Description of Artificial Sequence: Synthetic coding sequence
atggccgccgcccccggcggcagcgcccagcccgccggccccggccccagactgggcttcagcaccgccgacagcggcgtgggcatgagcggcctgaaccccggccccgccgtgcccatgaaggaccacgacgccatcaagctgttcgtgggccagatccccagaggcctggacgagcaggacctgaagcccctgttcgaggagttcggcagaatctacgagctgaccgtgctgaaggacagactgaccggcctgcacaagggctgcgccttcctgacctactgcgccagagacagcgccctgaaggcccagagcgccctgcacgagcagaagaccctgcccggcatgaacagacccatccaggtgaagcccgccgccagcgagggcagaggcgaggacagaaagctgttcgtgggcatgctgggcaagcagcagggcgaggaggacgtgagaagactgttccagcccttcggccacatcgaggagtgcaccgtgctgagaagccccgacggcaccagcaagggctgcgccttcgtgaagttcggcagccagggcgaggcccaggccgccatcagaggcctgcacggcagcagaaccatggccggcgccagcagcagcctggtggtgaagctggccgacaccgacagagagagagccctgagaagaatgcagcagatggccggccacctgggcgccttccaccccgcccccctgcccctgggcgcctgcggcgcctacaccaccgccatcctgcagcaccaggccgccctgctggccgccgcccagggccccggcctgggccccgtggccgccgtggccgcccagatgcagcacgtggccgccttcagcctggtggccgcccccctgctgcccgccgccgccgccaacagcccccccggcagcggccccggcaccctgcccggcctgcccgcccccatcggcgtgaacggcttcggccccctgaccccccagaccaacggccagcccggcagcgacaccctgtacaacaacggcctgagcccctaccccgcccagagccccggcgtggccgaccccctgcagcaggcctacgccggcatgcaccactacgccggccccgagggctgcaacctgttcatctaccacctgccccaggagttcggcgacgccgagctgatccagaccttcctgcccttcggcgccgtggtgagcgccaaggtgttcgtggacagagccaccaaccagagcaagtgcttcggcttcgtgagcttcgacaaccccaccagcgcccagaccgccatccaggccatgaacggcttccagatcggcatgaagagactgaaggtgcagctgaagagacccaaggacgccaacagaccctactag

SEQ ID NO: 77932 - DNA, 1398 bp, Artificial Sequence
  Description of Artificial Sequence: Synthetic coding sequence
atgaaggagcccgacgccatcaagctgttcgtgggccagatccccagacacctggaggagaaggacctgaagcccatcttcgagcagttcggcagaatcttcgagctgaccgtgatcaaggacaagtacaccggcctgcacaagggctgcgccttcctgacctactgcgccagagacagcgccctgaaggcccagagcgccctgcacgagcagaagaccctgcccggcatgaacagacccatccaggtgaagcccgccgacagcgagagcagaggcgaggacagaaagctgttcgtgggcatgctgggcaagcagcagaccgacgaggacgtgagaaagatgttcgagcccttcggcaccatcgacgagtgcaccgtgctgagaggccccgacggcaccagcaagggctgcgccttcgtgaagttccagacccacgccgaggcccaggccgccatcaacaccctgcacagcagcagaaccctgcccggcgccagcagcagcctggtggtgaagttcgccgacaccgagaaggagagaggcctgagaagaatgcagcaggtggccacccagctgggcatgttcagccccatcgccctgcagttcggcgcctacagcgcctacacccaggccctgatgcagcagcaggccgccctggtggccgcccacagcgcctacctgagccccatggccaccatggccgccgtgcagatgcagcacatggccgccatcaacgccaacggcctgatcgccacccccatcacccccagcagcggcaccagcaccccccccgccatcgccgccacccccgtgagcgccatccccgccgccctgggcgtgaacggctacagccccgtgcccacccagcccaccggccagcccgcccccgacgccctgtaccccaacggcgtgcacccctaccccgcccagagccccgccgcccccgtggaccccctgcagcaggcctacgccggcatgcagcactacaccgccgcctaccccgccgcctacagcctggtggcccccgccttcccccagccccccgccctggtggcccagcagccccccccccccccccagcagcagcagcagcagcagcagcagcagcagcagcagcagcagagagagggccccgacggctgcaacatcttcatctaccacctgccccaggagttcaccgacagcgagatcctgcagatgttcgtgcccttcggccacgtgatcagcgccaaggtgttcgtggacagagccaccaaccagagcaagtgcttcggcttcgtgagcttcgacaaccccgccagcgcccaggccgccatccaggccatgaacggcttccagatcggcatgaagagactgaaggtgcagctgaagagacccaaggacgccaacagaccctactag

SEQ ID NO: 77933 - DNA, 1248 bp, Artificial Sequence
  Description of Artificial Sequence: Synthetic coding sequence
atgaaggagcccgacgccatcaagctgttcgtgggccagatccccagacacctggaggagaaggacctgaagcccatcttcgagcagttcggcagaatcttcgagctgaccgtgatcaaggacaagtacaccggcctgcacaagggctgcgccttcctgacctactgcgccagagacagcgccctgaaggcccagagcgccctgcacgagcagaagaccctgcccggcatgaacagacccatccaggtgaagcccgccgacagcgagagcagaggcgaggacagaaagctgttcgtgggcatgctgggcaagcagcagaccgacgaggacgtgagaaagatgttcgagcccttcggcaccatcgacgagtgcaccgtgctgagaggccccgacggcaccagcaagggctgcgccttcgtgaagttccagacccacgccgaggcccaggccgccatcaacaccctgcacagcagcagaaccctgcccggcgccagcagcagcctggtggtgaagttcgccgacaccgagaaggagagaggcctgagaagaatgcagcaggtggccacccagctgggcatgttcagccccatcgccctgcagttcggcgcctacagcgcctacacccaggccctgatgcagcagcaggccgccctggtggccgcccacagcgcctacctgagccccatggccaccatggccgccgtgcagatgcagcacatggccgccatcaacgccaacggcctgatcgccacccccatcacccccagcagcgcccagagccccgccgcccccgtggaccccctgcagcaggcctacgccggcatgcagcactacaccgccgcctaccccgccgcctacagcctggtggcccccgccttcccccagccccccgccctggtggcccagcagccccccccccccccccagcagcagcagcagcagcagcagcagcagcagcagcagcagcagagagagggccccgacggctgcaacatcttcatctaccacctgccccaggagttcaccgacagcgagatcctgcagatgttcgtgcccttcggccacgtgatcagcgccaaggtgttcgtggacagagccaccaaccagagcaagtgcttcggcttcgtgagcttcgacaaccccgccagcgcccaggccgccatccaggccatgaacggcttccagatcggcatgaagagactgaaggtgcagctgaagagacccaaggacgccaacagaccctactag

SEQ ID NO: 77934 - DNA, 900 bp, Artificial Sequence
  Description of Artificial Sequence: Synthetic coding sequence
atgaaggagcccgacgccatcaagctgttcgtgggccagatccccagacacctggaggagaaggacctgaagcccatcttcgagcagttcggcagaatcttcgagctgaccgtgatcaaggacaagtacaccggcctgcacaagggctgcgccttcctgacctactgcgccagagacagcgccctgaaggcccagagcgccctgcacgagcagaagaccctgcccggcatgaacagacccatccaggtgaagcccgccgacagcgagagcagaggcgacagaaagctgttcgtgggcatgctgggcaagcagcagaccgacgaggacgtgagaaagatgttcgagcccttcggcaccatcgacgagtgcaccgtgctgagaggccccgacggcaccagcaagggctgcgccttcgtgaagttccagacccacgccgaggcccaggccgccatcaacaccctgcacagcagcagaaccctgcccggcgccagcagcagcctggtggtgaagttcgccgacaccgagaaggagagaggcctgagaagaatgcagcaggtggccacccagctgggcatgttcagccccatcgccctgcagttcggcgcctacagcgcctacacccaggccctgatgcagcagcaggccgccctggtggccgcccacagcgcctacctgagccccatggccaccatggccgccgtgcagatgcagcacatggccgccatcaacgccaacggcctgatcgccacccccatcacccccagcagcgccaagggccacggctacgccagcctggcccccagagcccacttcctgctggacgccctgctggccttcgtgagagagagaggcaccggcagcaaggcccccggctacctgcccagcgccggcctgctgtag

SEQ ID NO: 77935 - DNA, 783 bp, Artificial Sequence
  Description of Artificial Sequence: Synthetic coding sequence
atgcagcaggtggccacccagctgggcatgttcagccccatcgccctgcagttcggcgcctacagcgcctacacccaggccctgatgcagcagcaggccgccctggtggccgcccacagcgcctacctgagccccatggccaccatggccgccgtgcagatgcagcacatggccgccatcaacgccaacggcctgatcgccacccccatcacccccagcagcggcaccagcaccccccccgccatcgccgccacccccgtgagcgccatccccgccgccctgggcgtgaacggctacagccccgtgcccacccagcccaccggccagcccgcccccgacgccctgtaccccaacggcgtgcacccctaccccgccgcctaccccgccgcctacagcctggtggcccccgccttcccccagccccccgccctggtggcccagcagccccccccccccccccagcagcagcagcagcagcagcagcagcagcagcagcagcagcagagagagggccccgacggctgcaacatcttcatctaccacctgccccaggagttcaccgacagcgagatcctgcagatgttcgtgcccttcggccacgtgatcagcgccaaggtgttcgtggacagagccaccaaccagagcaagtgcttcggcttcgtgagcttcgacaaccccgccagcgcccaggccgccatccaggccatgaacggcttccagatcggcatgaagagactgaaggtgcagctgaagagacccaaggacgccaacagaccctactag

SEQ ID NO: 77936 - DNA, 1401 bp, Artificial Sequence
  Description of Artificial Sequence: Synthetic coding sequence
tgagtggaggagagcgccgccggcgagcagagcagcggcacccagatccccagacacctggaggagaaggacctgaagcccatcttcgagcagttcggcagaatcttcgagctgaccgtgatcaaggacaagtacaccggcctgcacaagggctgcgccttcctgacctactgcgccagagacagcgccctgaaggcccagagcgccctgcacgagcagaagaccctgcccggcatgaacagacccatccaggtgaagcccgccgacagcgagagcagaggcgacagaaagctgttcgtgggcatgctgggcaagcagcagaccgacgaggacgtgagaaagatgttcgagcccttcggcaccatcgacgagtgcaccgtgctgagaggccccgacggcaccagcaagggctgcgccttcgtgaagttccagacccacgccgaggcccaggccgccatcaacaccctgcacagcagcagaaccctgcccggcgccagcagcagcctggtggtgaagttcgccgacaccgagaaggagagaggcctgagaagaatgcagcaggtggccacccagctgggcatgttcagccccatcgccctgcagttcggcgcctacagcgcctacacccaggccctgatgcagcagcaggccgccctggtggccgcccacagcgcctacctgagccccatggccaccatggccgccgtgcagatgcagcacatggccgccatcaacgccaacggcctgatcgccacccccatcacccccagcagcggcaccagcaccccccccgccatcgccgccacccccgtgagcgccatccccgccgccctgggcgtgaacggctacagccccgtgcccacccagcccaccggccagcccgcccccgacgccctgtaccccaacggcgtgcacccctaccccgcccagagccccgccgcccccgtggaccccctgcagcaggcctacgccggcatgcagcactacaccgccgcctaccccgccgcctacagcctggtggcccccgccttcccccagccccccgccctggtggcccagcagccccccccccccccccagcagcagcagcagcagcagcagcagcagcagcagcagcagcagagagagggccccgacggctgcaacatcttcatctaccacctgccccaggagttcaccgacagcgagatcctgcagatgttcgtgcccttcggccacgtgatcagcgccaaggtgttcgtggacagagccaccaaccagagcaagtgcttcggcttcgtgagcttcgacaaccccgccagcgcccaggccgccatccaggccatgaacggcttccagatcggcatgaagagactgaaggtgcagctgaagagacccaaggacgccaacagaccctactag

SEQ ID NO: 77937 - DNA, 1347 bp, Artificial Sequence
  Description of Artificial Sequence: Synthetic coding sequence
atgtacatcaagatggccaccctggccaacggccaggccgacaacgccagcctgagcaccaacggcctgggcagcagccccggcagcgccggccacatgaacggcctgagccacagccccggcaaccccagcaccatccccatgaaggaccacgacgccatcaagctgttcatcggccagatccccagaaacctggacgagaaggacctgaagcccctgttcgaggagttcggcaagatctacgagctgaccgtgctgaaggacagattcaccggcatgcacaagggctgcgccttcctgacctactgcgagagagagagcgccctgaaggcccagagcgccctgcacgagcagaagaccctgcccggcatgaacagacccatccaggtgaagcccgccgacagcgagagcagaggcgaggacagaaagctgttcgtgggcatgctgaacaagcagcagagcgaggacgacgtgagaagactgttcgaggccttcggcaacatcgaggagtgcaccatcctgagaggccccgacggcaacagcaagggctgcgccttcgtgaagtacagcagccacgccgaggcccaggccgccatcaacgccctgcacggcagccagaccatgcccggcgccagcagcagcctggtggtgaagttcgccgacaccgacaaggagagaaccatgagaagaatgcagcagatggccggccagatgggcatgttcaaccccatggccatccccttcggcgcctacggcgcctacgcccaggccctgatgcagcagcaggccgccctgatggccagcgtggcccagggcggctacctgaaccccatggccgccttcgccgccgcccagatgcagcagatggccgccctgaacatgaacggcctggccgccgcccccatgacccccaccagcggcggcagcaccccccccggcatcaccgcccccgccgtgcccagcatccccagccccatcggcgtgaacggcttcaccggcctgcccccccaggccaacggccagcccgccgccgaggccgtgttcgccaacggcatccacccctaccccgcccagagccccaccgccgccgaccccctgcagcaggcctacgccggcgtgcagcagtacgccggccccgccgcctaccccgccgcctacggccagatcagccaggccttcccccagcccccccccatgatcccccagcagcagagagagggcttcgtgagcttcgacaaccccgccagcgcccagaccgccatccaggccatgaacggcttccagatcggcatgaagagactgaaggtgcagctgaagagacccaaggacgccaacagaccctactag

SEQ ID NO: 77938 - DNA, 639 bp, Artificial Sequence
  Description of Artificial Sequence: Synthetic coding sequence
gtgagcgccgagggccccgagagagccgccagagccgaggacagcgccagagacgagcccgccgaccccggcgaggcctgcggccagagagagcccaaggacagaaagctgttcgtgggcatgctgaacaagcagcagagcgaggacgacgtgagaagactgttcgaggccttcggcaacatcgaggagtgcaccatcctgagaggccccgacggcaacagcaagggctgcgccttcgtgaagtacagcagccacgccgaggcccaggccgccatcaacgccctgcacggcagccagaccatgcccggcgccagcagcagcctggtggtgaagttcgccgacaccgacaaggagagaaccatgagaagaatgcagcagatggccggccagatgggcatgttcaaccccatggccatccccttcggcgcctacggcgcctacgcccaggccctgatgcagcagcaggccgccctgatggccagcgtggcccagggcggctacctgaaccccatggccgccttcgccgccgcccagatgcagcagatggccgccctgaacatgtggcccggcggcagaacctacgaccccaacctgagatggcagcaccccagcggccaccactgcaccagcagagcctag

SEQ ID NO: 77939 - DNA, 1461 bp, Artificial Sequence
  Description of Artificial Sequence: Synthetic coding sequence
atgtacatcaagatggccaccctggccaacggccaggccgacaacgccagcctgagcaccaacggcctgggcagcagccccggcagcgccggccacatgaacggcctgagccacagccccggcaaccccagcaccatccccatgaaggaccacgacgccatcaagctgttcatcggccagatccccagaaacctggacgagaaggacctgaagcccctgttcgaggagttcggcaagatctacgagctgaccgtgctgaaggacagattcaccggcatgcacaagggctgcgccttcctgacctactgcgagagagagagcgccctgaaggcccagagcgccctgcacgagcagaagaccctgcccggcatgaacagacccatccaggtgaagcccgccgacagcgagagcagaggcggcagcagctgcctgagacagccccccagccaggacagaaagctgttcgtgggcatgctgaacaagcagcagagcgaggacgacgtgagaagactgttcgaggccttcggcaacatcgaggagtgcaccatcctgagaggccccgacggcaacagcaagggctgcgccttcgtgaagtacagcagccacgccgaggcccaggccgccatcaacgccctgcacggcagccagaccatgcccggcgccagcagcagcctggtggtgaagttcgccgacaccgacaaggagagaaccatgagaagaatgcagcagatggccggccagatgggcatgttcaaccccatggccatccccttcggcgcctacggcgcctacgcccaggccctgatgcagcagcaggccgccctgatggccagcgtggcccagggcggctacctgaaccccatggccgccttcgccgccgcccagatgcagcagatggccgccctgaacatgaacggcctggccgccgcccccatgacccccaccagcggcggcagcaccccccccggcatcaccgcccccgccgtgcccagcatccccagccccatcggcgtgaacggcttcaccggcctgcccccccaggccaacggccagcccgccgccgaggccgtgttcgccaacggcatccacccctaccccgcccagagccccaccgccgccgaccccctgcagcaggcctacgccggcgtgcagcagtacgccggccccgccgcctaccccgccgcctacggccagatcagccaggccttcccccagcccccccccatgatcccccagcagcagagagagggccccgagggctgcaacctgttcatctaccacctgccccaggagttcggcgacgccgagctgatgcagatgttcctgcccttcggcttcgtgagcttcgacaaccccgccagcgcccagaccgccatccaggccatgaacggcttccagatcggcatgaagagactgaaggtgcagctgaagagacccaaggacgccaacagaccctactag

SEQ ID NO: 77940 - DNA, 1458 bp, Artificial Sequence
  Description of Artificial Sequence: Synthetic coding sequence
atgtacatcaagatggccaccctggccaacggccaggccgacaacgccagcctgagcaccaacggcctgggcagcagccccggcagcgccggccacatgaacggcctgagccacagccccggcaaccccagcaccatccccatgaaggaccacgacgccatcaagctgttcatcggccagatccccagaaacctggacgagaaggacctgaagcccctgttcgaggagttcggcaagatctacgagctgaccgtgctgaaggacagattcaccggcatgcacaagggctgcgccttcctgacctactgcgagagagagagcgccctgaaggcccagagcgccctgcacgagcagaagaccctgcccggcatgaacagacccatccaggtgaagcccgccgacagcgagagcagaggcggcagcagctgcctgagacagccccccagccaggacagaaagctgttcgtgggcatgctgaacaagcagcagagcgaggacgacgtgagaagactgttcgaggccttcggcaacatcgaggagtgcaccatcctgagaggccccgacggcaacagcaagggctgcgccttcgtgaagtacagcagccacgccgaggcccaggccgccatcaacgccctgcacggcagccagaccatgcccggcgccagcagcagcctggtggtgaagttcgccgacaccgacaaggagagaaccatgagaagaatgcagcagatggccggccagatgggcatgttcaaccccatggccatccccttcggcgcctacggcgcctacgcccaggccatgcagcagcaggccgccctgatggccagcgtggcccagggcggctacctgaaccccatggccgccttcgccgccgcccagatgcagcagatggccgccctgaacatgaacggcctggccgccgcccccatgacccccaccagcggcggcagcaccccccccggcatcaccgcccccgccgtgcccagcatccccagccccatcggcgtgaacggcttcaccggcctgcccccccaggccaacggccagcccgccgccgaggccgtgttcgccaacggcatccacccctaccccgcccagagccccaccgccgccgaccccctgcagcaggcctacgccggcgtgcagcagtacgccggccccgccgcctaccccgccgcctacggccagatcagccaggccttcccccagcccccccccatgatcccccagcagcagagagagggccccgagggctgcaacctgttcatctaccacctgccccaggagttcggcgacgccgagctgatgcagatgttcctgcccttcggcttcgtgagcttcgacaaccccgccagcgcccagaccgccatccaggccatgaacggcttccagatcggcatgaagagactgaaggtgcagctgaagagacccaaggacgccaacagaccctactag

SEQ ID NO: 77941 - DNA, 1455 bp, Artificial Sequence
  Description of Artificial Sequence: Synthetic coding sequence
atgtacatcaagatggccaccctggccaacggccaggccgacaacgccagcctgagcaccaacggcctgggcagcagccccggcagcgccggccacatgaacggcctgagccacagccccggcaaccccagcaccatccccatgaaggaccacgacgccatcaagctgttcatcggccagatccccagaaacctggacgagaaggacctgaagcccctgttcgaggagttcggcaagatctacgagctgaccgtgctgaaggacagattcaccggcatgcacaagggctgcgccttcctgacctactgcgagagagagagcgccctgaaggcccagagcgccctgcacgagcagaagaccctgcccggcatgaacagacccatccaggtgaagcccgccgacagcgagagcagaggcggcagcagctgcctgagacagccccccagccacagaaagctgttcgtgggcatgctgaacaagcagcagagcgaggacgacgtgagaagactgttcgaggccttcggcaacatcgaggagtgcaccatcctgagaggccccgacggcaacagcaagggctgcgccttcgtgaagtacagcagccacgccgaggcccaggccgccatcaacgccctgcacggcagccagaccatgcccggcgccagcagcagcctggtggtgaagttcgccgacaccgacaaggagagaaccatgagaagaatgcagcagatggccggccagatgggcatgttcaaccccatggccatccccttcggcgcctacggcgcctacgcccaggccatgcagcagcaggccgccctgatggccagcgtggcccagggcggctacctgaaccccatggccgccttcgccgccgcccagatgcagcagatggccgccctgaacatgaacggcctggccgccgcccccatgacccccaccagcggcggcagcaccccccccggcatcaccgcccccgccgtgcccagcatccccagccccatcggcgtgaacggcttcaccggcctgcccccccaggccaacggccagcccgccgccgaggccgtgttcgccaacggcatccacccctaccccgcccagagccccaccgccgccgaccccctgcagcaggcctacgccggcgtgcagcagtacgccggccccgccgcctaccccgccgcctacggccagatcagccaggccttcccccagcccccccccatgatcccccagcagcagagagagggccccgagggctgcaacctgttcatctaccacctgccccaggagttcggcgacgccgagctgatgcagatgttcctgcccttcggcttcgtgagcttcgacaaccccgccagcgcccagaccgccatccaggccatgaacggcttccagatcggcatgaagagactgaaggtgcagctgaagagacccaaggacgccaacagaccctactag

SEQ ID NO: 77942 - DNA, 1458 bp, Artificial Sequence
  Description of Artificial Sequence: Synthetic coding sequence
atggccagactgaccgagagcgaggccagaagacagcagcagcagctgctgcagcccagacccagccccgtgggcagcagcggccccgagccccccggcggccagcccgacggcatgaaggacctggacgccatcaagctgttcgtgggccagatccccagacacctggacgagaaggacctgaagcccctgttcgagcagttcggcagaatctacgagctgaccgtgctgaaggacccctacaccggcatgcacaagggctgcgccttcctgacctactgcgccagagacagcgccatcaaggcccagaccgccctgcacgagcagaagaccctgcccggcatggccagacccatccaggtgaagcccgccgacagcgagagcagaggcggcagagacagaaagctgttcgtgggcatgctgaacaagcagcagagcgaggaggacgtgctgagactgttccagcccttcggcgtgatcgacgagtgcaccgtgctgagaggccccgacggcagcagcaagggctgcgccttcgtgaagttcagcagccacaccgaggcccaggccgccatccacgccctgcacggcagccagaccatgcccggcgccagcagcagcctggtggtgaagttcgccgacaccgacaaggagagaaccctgagaagaatgcagcagatggtgggccagctgggcatcctgacccccagcctgaccctgcccttcagcccctacagcgcctacgcccaggccctgatgcagcagcagaccaccgtgctgagcaccagcggcagctacctgagccccggcgtggccttcagcccctgccacatccagcagatcggcgccgtgagcctgaacggcctgcccgccacccccatcgcccccgccagcggcctgcacagcccccccctgctgggcaccaccgccgtgcccggcctggtggcccccatcaccaacggcttcgccggcgtggtgcccttccccggcggccaccccgccctggagaccgtgtacgccaacggcctggtgccctaccccgcccagagccccaccgtggccgagaccctgcaccccgccttcagcggcgtgcagcagtacaccgccatgtaccccaccgccgccatcacccccatcgcccacagcgtgccccagcccccccccctgctgcagcagcagcagagagagggccccgagggctgcaacctgttcatctaccacctgccccaggagttcggcgacaccgagctgacccagatgttcctgcccttcggcaacatcatcagcagcaaggtgttcatggacagagccaccaaccagagcaagtgcttcggcttcgtgagcttcgacaaccccgccagcgcccaggccgccatccaggccatgaacggcttccagatcggcatgaagagactgaaggtgcagctgaagagacccaaggaccccggccacccctactag

SEQ ID NO: 77943 - DNA, 963 bp, Artificial Sequence
  Description of Artificial Sequence: Synthetic coding sequence
atggccagacccatccaggtgaagcccgccgacagcgagagcagaggcggcagagacagaaagctgttcgtgggcatgctgaacaagcagcagagcgaggaggacgtgctgagactgttccagcccttcggcgtgatcgacgagtgcaccgtgctgagaggccccgacggcagcagcaagggctgcgccttcgtgaagttcagcagccacaccgaggcccaggccgccatccacgccctgcacggcagccagaccatgcccggcgccagcagcagcctggtggtgaagttcgccgacaccgacaaggagagaaccctgagaagaatgcagcagatggtgggccagctgggcatcctgacccccagcctgaccctgcccttcagcccctacagcgcctacgcccaggccctgatgcagcagcagaccaccgtgctgagcaccagcggcagctacctgagccccggcgtggccttcagcccctgccacatccagcagatcggcgccgtgagcctgaacggcctgcccgccacccccatcgcccccgccagcggcctgcacagcccccccctgctgggcaccaccgccgtgcccggcctggtggcccccatcaccaacggcttcgccggcgtggtgcccttccccggcggccaccccgccctggagaccgtgtacgccaacggcctggtgccctaccccgcccagagccccaccgtggccgagaccctgcaccccgccttcagcggcgtgcagcagtacaccgccatgtaccccaccgccgccatcacccccatcgcccacagcgtgccccagcccccccccctgctgcagcagcagcagagagagggcgtgtggagacacggcgccgacgccgacgtgcccaccctgagacagtaccacttcctgcagggcgtgtacggcagcagctaccagcccgagcaggtgttcagactgagagagctgtag

SEQ ID NO: 77944 - DNA, 1230 bp, Artificial Sequence
  Description of Artificial Sequence: Synthetic coding sequence
atggccagactgaccgagagcgaggccagaagacagcagcagcagctgctgcagcccagacccagccccgtgggcagcagcggccccgagccccccggcggccagcccgacggcatgaaggacctggacgccatcaagctgttcgtgggccagatccccagacacctggacgagaaggacctgaagcccctgttcgagcagttcggcagaatctacgagctgaccgtgctgaaggacccctacaccggcatgcacaagggctgcgccttcctgacctactgcgccagagacagcgccatcaaggcccagaccgccctgcacgagcagaagaccctgcccggcatggccagacccatccaggtgaagcccgccgacagcgagagcagaggcggcagagacagaaagctgttcgtgggcatgctgaacaagcagcagagcgaggaggacgtgctgagactgttccagcccttcggcgtgatcgacgagtgcaccgtgctgagaggccccgacggcagcagcaagggctgcgccttcgtgaagttcagcagccacaccgaggcccaggccgccatccacgccctgcacggcagccagaccatgcccggcgccagcagcagcctggtggtgaagttcgccgacaccgacaaggagagaaccctgagaagaatgcagcagatggtgggccagctgggcatcctgacccccagcctgaccctgcccttcagcccctacagcgcctacgcccaggccctgatgcagcagcagaccaccgtgctgagcaccagcggcagctacctgagccccggcgtggccttcagcccctgccacatccagcagatcggcgccgtgagcctgaacggcctgcccgccacccccatcgcccccgccagcggcgtggtgcccttccccggcggccaccccgccctggagaccgtgtacgccaacggcctggtgccctaccccgcccagagccccaccgtggccgagaccctgcaccccgccttcagcggcgtgcagcagtacaccgccatgtaccccaccgccgccatcacccccatcgcccacagcgtgccccagcccccccccctgctgcagcagcagcagagagagggcgtgtggagacacggcgccgacgccgacgtgcccaccctgagacagtaccacttcctgcagggcgtgtacggcagcagctaccagcccgagcaggtgttcagactgagagagctgtag

SEQ ID NO: 77945 - DNA, 1446 bp, Artificial Sequence
  Description of Artificial Sequence: Synthetic coding sequence
atggccgccgcccccggcggcagcgcccagcccgccggccccggccccagactgggcttcagcaccgccgacagcggcgtgggcatgagcggcctgaaccccggccccgccgtgcccatgaaggaccacgacgccatcaagctgttcgtgggccagatccccagaggcctggacgagcaggacctgaagcccctgttcgaggagttcggcagaatctacgagctgaccgtgctgaaggacagactgaccggcctgcacaagggctgcgccttcctgacctactgcgccagagacagcgccctgaaggcccagagcgccctgcacgagcagaagaccctgcccggcatgaacagacccatccaggtgaagcccgccgccagcgagggcagaggcgaggacagaaagctgttcgtgggcatgctgggcaagcagcagggcgaggaggacgtgagaagactgttccagcccttcggccacatcgaggagtgcaccgtgctgagaagccccgacggcaccagcaagggctgcgccttcgtgaagttcggcagccagggcgaggcccaggccgccatcagaggcctgcacggcagcagaaccatggccggcgccagcagcagcctggtggtgaagctggccgacaccgacagagagagagccctgagaagaatgcagcagatggccggccacctgggcgccttccaccccgcccccctgcccctgggcgcctgcggcgcctacaccaccgccatcctgcagcaccaggccgccctgctggccgccgcccagggccccggcctgggccccgtggccgccgtggccgcccagatgcagcacgtggccgccttcagcctggtggccgcccccctgctgcccgccgccgccgccaacagcccccccggcagcggccccggcaccctgcccggcctgcccgcccccatcggcgtgaacggcttcggccccctgaccccccagaccaacggccagcccggcagcgacaccctgtacaacaacggcctgagcccctaccccgcccagagccccggcgtggccgaccccctgcagcaggcctacgccggcatgcaccactacgccgccgcctaccccagcgcctacgcccccgtgagcaccgccttcccccagcagcccagcgccctgccccagcagcagagagagggccccgagggctgcaacctgttcatctaccacctgccccaggagttcggcgacgccgagctgatccagaccttcctgcccttcggcgccgtggtgagcgccaaggtgttcgtggacagagccaccaaccagagcaagtgcttcggcttcgtgagcttcgacaaccccaccagcgcccagaccgccatccaggccatgaacggcttccagatcggcatgaagagactgaaggtgcagctgaagagacccaaggacgccaacagaccctactag

SEQ ID NO: 77946 - DNA, 1107 bp, Artificial Sequence
  Description of Artificial Sequence: Synthetic coding sequence
atgatcagcgacccccccagcaacaacagctggaacagcgtgctgtacctgctggaggacagaaagctgttcgtgggcatgctgggcaagcagcagggcgaggaggacgtgagaagactgttccagcccttcggccacatcgaggagtgcaccgtgctgagaagccccgacggcaccagcaagggctgcgccttcgtgaagttcggcagccagggcgaggcccaggccgccatcagaggcctgcacggcagcagaaccatggccggcgccagcagcagcctggtggtgaagctggccgacaccgacagagagagagccctgagaagaatgcagcagatggccggccacctgggcgccttccaccccgcccccctgcccctgggcgcctgcggcgcctacaccaccgccatcctgcagcaccaggccgccctgctggccgccgcccagggccccggcctgggccccgtggccgccgtggccgcccagatgcagcacgtggccgccttcagcctggtggccgcccccctgctgcccgccgccgccgccaacagcccccccggcagcggccccggcaccctgcccggcctgcccgcccccatcggcgtgaacggcttcggccccctgaccccccagaccaacggccagcccggcagcgacaccctgtacaacaacggcctgagcccctaccccgcccagagccccggcgtggccgaccccctgcagcaggcctacgccggcatgcaccactacgccgccgcctaccccagcgcctacgcccccgtgagcaccgccttcccccagcagcccagcgccctgccccagcagcagagagagggccccgagggctgcaacctgttcatctaccacctgccccaggagttcggcgacgccgagctgatccagaccttcctgcccttcggcgccgtggtgagcgccaaggtgttcgtggacagagccaccaaccagagcaagtgcttcggcttcgtgagcttcgacaaccccaccagcgcccagaccgccatccaggccatgaacggcttccagatcggcatgaagagactgaaggtgcagctgaagagacccaaggacgccaacagaccctactag

SEQ ID NO: 77947 - DNA, 1365 bp, Artificial Sequence; identical to SEQ ID NO: 77931
  Description of Artificial Sequence: Synthetic coding sequence

SEQ ID NO: 77948 - DNA, 1029 bp, Artificial Sequence
  Description of Artificial Sequence: Synthetic coding sequence
atgctgggcaagcagcagggcgaggaggacgtgagaagactgttccagcccttcggccacatcgaggagtgcaccgtgctgagaagccccgacggcaccagcaagggctgcgccttcgtgaagttcggcagccagggcgaggcccaggccgccatcagaggcctgcacggcagcagaaccatggccggcgccagcagcagcctggtggtgaagctggccgacaccgacagagagagagccctgagaagaatgcagcagatggccggccacctgggcgccttccaccccgcccccctgcccctgggcgcctgcggcgcctacaccaccgccatcctgcagcaccaggccgccctgctggccgccgcccagggccccggcctgggccccgtggccgccgtggccgcccagatgcagcacgtggccgccttcagcctggtggccgcccccctgctgcccgccgccgccgccaacagcccccccggcagcggccccggcaccctgcccggcctgcccgcccccatcggcgtgaacggcttcggccccctgaccccccagaccaacggccagcccggcagcgacaccctgtacaacaacggcctgagcccctaccccgcccagagccccggcgtggccgaccccctgcagcaggcctacgccggcatgcaccactacgccgccgcctaccccagcgcctacgcccccgtgagcaccgccttcccccagcagcccagcgccctgccccagcagcagagagagggccccgagggctgcaacctgttcatctaccacctgccccaggagttcggcgacgccgagctgatccagaccttcctgcccttcggcgccgtggtgagcgccaaggtgttcgtggacagagccaccaaccagagcaagtgcttcggcttcgtgagcttcgacaaccccaccagcgcccagaccgccatccaggccatgaacggcttccagatcggcatgaagagactgaaggtgcagctgaagagacccaaggacgccaacagaccctactag

SEQ ID NO: 77949 - DNA, 1035 bp, Artificial Sequence
  Description of Artificial Sequence: Synthetic coding sequence
atgaacagacccatccaggtgaagcccgccgccagcgagggcagaggcgaggacagaaagctgttcgtgggcatgctgggcaagcagcagggcgaggaggacgtgagaagactgttccagcccttcggccacatcgaggagtgcaccgtgctgagaagccccgacggcaccagcaagggctgcgccttcgtgaagttcggcagccagggcgaggcccaggccgccatcagaggcctgcacggcagcagaaccatggccggcgccagcagcagcctggtggtgaagctggccgacaccgacagagagagagccctgagaagaatgcagcagatggccggccacctgggcgccttccaccccgcccccctgcccctgggcgcctgcggcgcctacaccaccgccatcctgcagcaccaggccgccctgctggccgccgcccagggccccggcctgggccccgtggccgccgtggccgcccagatgcagcacgtggccgccttcagcctggtggccgcccccctgctgcccgccgccgccaacagcccccccggcagcggccccggcaccctgcccggcctgcccgcccccatcggcgtgaacggcttcggccccctgaccccccagaccaacggccagcccggcagcgacaccctgtacaacaacggcctgagcccctaccccgccgcctaccccagcgcctacgcccccgtgagcaccgccttcccccagcagcccagcgccctgccccagcagcagagagagggccccgagggctgcaacctgttcatctaccacctgccccaggagttcggcgacgccgagctgatccagaccttcctgcccttcggcgccgtggtgagcgccaaggtgttcgtggacagagccaccaaccagagcaagtgcttcggcttcgtgagcttcgacaaccccaccagcgcccagaccgccatccaggccatgaacggcttccagatcggcatgaagagactgaaggtgcagctgaagagacccaaggacgccaacagaccctactag

SEQ ID NO: 77950 - DNA, 1980 bp, Artificial Sequence
  Description of Artificial Sequence: Synthetic coding sequence
atgctgtacaagcagctgagacaggcctgcgaggaccacgtgcaggcccagatcctgcccttcagagaggacagcctggacagcgtgctgttcctgaagaagatcaacacctgctggcaggaccactgcagacagatgatcatgatcagaagcatcttcctgttcctggacagaacctacgtgctgcagaacagcaccctgcccagcatctgggacatgggcctggagctgttcagaacccacatcatcagcgacaagatggtgcagagcaagaccatcgacggcatcctgctgctgatcgagagagagagaagcggcgaggccgtggacagaagcctgctgagaagcctgctgggcatgctgagcgacctgcaggtgtacaaggacagcttcgagctgaagttcctggaggagaccaactgcctgtacgccgccgagggccagagactgatgcaggagagagaggtgcccgagtacctgaaccacgtgagcaagagactggaggaggagggcgacagagtgatcacctacctggaccacagcacccagaagcccctgatcgcctgcgtggagaagcagctgctgggcgagcacctgaccgccatcctgcagaagggcctggaccacctgctggacgagaacagagtgcccgacctggcccagatgtaccagctgttcagcagagtgagaggcggccagcaggccctgctgcagcactggagcgagtacatcaagaccttcggcaccgccatcgtgatcaaccccgagaaggacaaggacatggtgcaggacctgctggacttcaaggacaaggtggaccacgtgatcgaggtgtgcttccagaagaacgagagattcgtgaacctgatgaaggagagcttcgagaccttcatcaacaagagacccaacaagcccgccgagctgatcgccaagcacgtggacagcaagctgagagccggcaacaaggaggccaccgacgaggagctggagagaaccctggacaagatcatgatcctgttcagattcatccacggcaaggacgtgttcgaggccttctacaagaaggacctggccaagagactgctggtgggcaagagcgccagcgtggacgccgagaagagcatgctgagcaagctgaagcacgagtgcggcgccgccttcaccagcaagctggagggcatgttcaaggacatggagctgagcaaggacatcatggtgcacttcaagcagcacatgcagaaccagagcgacagcggccccatcgacctgaccgtgaacatcctgaccatgggctactggcccacctacacccccatggaggtgcacctgacccccgagatgatcaagctgcaggaggtgttcaaggccttctacctgggcaagcacagcggcagaaagctgcagtggcagaccaccctgggccacgccgtgctgaaggccgagttcaaggagggcaagaaggagttccaggtgagcctgttccagaccctggtgctgctgatgttcaacgagggcgacggcttcagcttcgaggagatcaagatggccaccggcatcgaggacagcgagctgagaagaaccctgcagagcctggcctgcggcaaggccagagtgctgatcaagagccccaagggcaaggaggtggaggacggcgacaagttcatcttcaacggcgagttcaagcacaagctgttcagaatcaagatcaaccagatccagatgaaggagaccgtggaggagcaggtgagcaccaccgagagagtgttccaggacagacagtaccagatcgacgccgccatcgtgagaatcatgaagatgagaaagaccctgggccacaacctgctggtgagcgagctgtacaaccagctgaagttccccgtgaagcccggcgacctgaagaagagaatcgagagcctgatcgacagagactacatggagagagacaaggacaaccccaaccagtaccactacgtggcctag

SEQ ID NO: 77951 - DNA, 2280 bp, Artificial Sequence
  Description of Artificial Sequence: Synthetic coding sequence
atggccgacgaggcccccagaaagggcagcttcagcgccctggtgggcagaaccaacggcctgaccaagcccgccgccctggccgccgcccccgccaagcccggcggcgccggcggcagcaagaagctggtgatcaagaacttcagagacagacccagactgcccgacaactacacccaggacacctggagaaagctgcacgaggccgtgagagccgtgcagagcagcaccagcatcagatacaacctggaggagctgtaccaggccgtggagaacctgtgcagccacaaggtgagccccatgctgtacaagcagctgagacaggcctgcgaggaccacgtgcaggcccagatcctgcccttcagagaggacagcctggacagcgtgctgttcctgaagaagatcaacacctgctggcaggaccactgcagacagatgatcatgatcagaagcatcttcctgttcctggacagaacctacgtgctgcagaacagcaccctgcccagcatctgggacatgggcctggagctgttcagaacccacatcatcagcgacaagatggtgcagagcaagaccatcgacggcatcctgctgctgatcgagagagagagaagcggcgaggccgtggacagaagcctgctgagaagcctgctgggcatgctgagcgacctgcaggtgtacaaggacagcttcgagctgaagttcctggaggagaccaactgcctgtacgccgccgagggccagagactgatgcaggagagagaggtgcccgagtacctgaaccacgtgagcaagagactggaggaggagggcgacagagtgatcacctacctggaccacagcacccagaagcccctgatcgcctgcgtggagaagcagctgctgggcgagcacctgaccgccatcctgcagaagggcctggaccacctgctggacgagaacagagtgcccgacctggcccagatgtaccagctgttcagcagagtgagaggcggccagcaggccctgctgcagcactggagcgagtacatcaagaccttcggcaccgccatcgtgatcaaccccgagaaggacaaggacatggtgcaggacctgctggacttcaaggacaaggtggaccacgtgatcgaggtgtgcttccagaagaacgagagattcgtgaacctgatgaaggagagcttcgagaccttcatcaacaagagacccaacaagcccgccgagctgatcgccaagcacgtggacagcaagctgagagccggcaacaaggaggccaccgacgaggagctggagagaaccctggacaagatcatgatcctgttcagattcatccacggcaaggacgtgttcgaggccttctacaagaaggacctggccaagagactgctggtgggcaagagcgccagcgtggacgccgagaagagcatgctgagcaagctgaagcacgagtgcggcgccgccttcaccagcaagctggagggcatgttcaaggacatggagctgagcaaggacatcatggtgcacttcaagcagcacatgcagaaccagagcgacagcggccccatcgacctgaccgtgaacatcctgaccatgggctactggcccacctacacccccatggaggtgcacctgacccccgagatgatcaagctgcaggaggtgttcaaggccttctacctgggcaagcacagcggcagaaagctgcagtggcagaccaccctgggccacgccgtgctgaaggccgagttcaaggagggcaagaaggagttccaggtgagcctgttccagaccctggtgctgctgatgttcaacgagggcgacggcttcagcttcgaggagatcaagatggccaccggcatcgaggacagcgagctgagaagaaccctgcagagcctggcctgcggcaaggccagagtgctgatcaagagccccaagggcaaggaggtggaggacggcgacaagttcatcttcaacggcgagttcaagcacaagctgttcagaatcaagatcaaccagatccagatgaaggagaccgtggaggagcaggtgagcaccaccgagagagtgttccaggacagacagtaccagatcgacgccgccatcgtgagaatcatgaagatgagaaagaccctgggccacaacctgctggtgagcgagctgtacaaccagctgaagttccccgtgaagcccggcgacctgaagaagagaatcgagagcctgatcgacagagactacatggagagagacaaggacaaccccaaccagtaccactacgtggcctag

SEQ ID NO: 77952 - DNA, 1980 bp, Artificial Sequence; identical to SEQ ID NO: 77950
  Description of Artificial Sequence: Synthetic coding sequence

SEQ ID NO: 77953 - DNA, 1980 bp, Artificial Sequence; identical to SEQ ID NO: 77950
  Description of Artificial Sequence: Synthetic coding sequence

SEQ ID NO: 77954 - DNA, 2703 bp, Artificial Sequence
  Description of Artificial Sequence: Synthetic coding sequence
atgaagagcgtgtgccccgtgaccagcggcttcagcagccccagccccagcgccgccgccgccgcccaggaggtgagaagcgccaccgacggcaacaccagcaccaccccccccaccagcgccaagaagagaaagctgaacagcagcagcagcagcagcagcaacagcagcaacgagagagaggacttcgacagcaccagcagcagcagcagcaccccccccctgcagcccagagacagcgccagccccagcaccagcagcttctgcctgggcgtgagcgtggccgccagcagccacgtgcccatccagaagaagctgagattcgaggacaccctggagttcgtgggcttcgacgccaagatggccgaggagagcagcagcagcagcagcagcagcagccccaccgccgccaccagccagcagcagcagctgaagaacaagagcatcctgatcagcagcgtggccagcgtgcaccacgccaacggcctggccaagagcagcaccaccgtgagcagcttcgccaacagcaagcccggcagcgccaagaagctggtgatcaagaacttcaaggacaagcccaagctgcccgagaactacaccgacgagacctggcagaagctgaaggaggccgtggaggccatccagaacagcaccagcatcaagtacaacctggaggagctgtaccaggccgtggagaacctgtgcagctacaagatcagcgccaacctgtacaagcagctgagacagatctgcgaggaccacatcaaggcccagatccaccagttcagagaggacagcctggacagcgtgctgttcctgaagaagatcgacagatgctggcagaaccactgcagacagatgatcatgatcagaagcatcttcctgttcctggacagaacctacgtgctgcagaacagcatgctgcccagcatctgggacatgggcctggagctgttcagagcccacatcatcagcgaccagaaggtgcagaacaagaccatcgacggcatcctgctgctgatcgagagagagagaaacggcgaggccatcgacagaagcctgctgagaagcctgctgagcatgctgagcgacctgcagatctaccaggacagcttcgagcagagattcctggaggagaccaacagactgtacgccgccgagggccagaagctgatgcaggagagagaggtgcccgagtacctgcaccacgtgaacaagagactggaggaggaggccgacagactgatcacctacctggaccagaccacccagaagagcctgatcgccaccgtggagaagcagctgctgggcgagcacctgaccgccatcctgcagaagggcctgaacaacctgctggacgagaacagaatccaggacctgagcctgctgtaccagctgttcagcagagtgagaggcggcgtgcaggtgctgctgcagcagtggatcgagtacatcaaggccttcggcagcaccatcgtgatcaaccccgagaaggacaagaccatggtgcaggagctgctggacttcaaggacaaggtggaccacatcatcgacatctgcttcctgaagaacgagaagttcatcaacgccatgaaggaggccttcgagaccttcatcaacaagagacccaacaagcccgccgagctgatcgccaagtacgtggacagcaagctgagagccggcaacaaggaggccaccgacgaggagctggagaagatgctggacaagatcatgatcatcttcagattcatctacggcaaggacgtgttcgaggccttctacaagaaggacctggccaagagactgctggtgggcaagagcgccagcgtggacgccgagaagagcatgctgagcaagctgaagcacgagtgcggcgccgccttcaccagcaagctggagggcatgttcaaggacatggagctgagcaaggacatcatgatccagttcaagcagtacatgcagaaccagaacgtgcccggcaacatcgagctgaccgtgaacatcctgaccatgggctactggcccacctacgtgcccatggaggtgcacctgccccccgagatggtgaagctgcaggagatcttcaagaccttctacctgggcaagcacagcggcagaaagctgcagtggcagagcaccctgggccactgcgtgctgaaggccgagttcaaggagggcaagaaggagctgcaggtgagcctgttccagaccctggtgctgctgatgttcaacgagggcgaggagttcagcctggaggagatcaagcaggccaccggcatcgaggacggcgagctgagaagaaccctgcagagcctggcctgcggcaaggccagagtgctggccaagaaccccaagggcaaggacatcgaggacggcgacaagttcatctgcaacgacgacttcaagcacaagctgttcagaatcaagatcaaccagatccagatgaaggagaccgtggaggagcaggccagcaccaccgagagagtgttccaggacagacagtaccagatcgacgccgccatcgtgagaatcatgaagatgagaaagaccctgagccacaacctgctggtgagcgaggtgtacaaccagctgaagttccccgtgaagcccgccgacctgaagaagagaatcgagagcctgatcgacagagactacatggagagagacaaggagaaccccaaccagtacaactacatcgcctag

SEQ ID NO: 77955 - DNA, 2688 bp, Artificial Sequence
  Description of Artificial Sequence: Synthetic coding sequence
atgttccccaccggcttcagcagccccagccccagcgccgccgccgccgcccaggaggtgagaagcgccaccgacggcaacaccagcaccaccccccccaccagcgccaagaagagaaagctgaacagcagcagcagcagcagcagcaacagcagcaacgagagagaggacttcgacagcaccagcagcagcagcagcaccccccccctgcagcccagagacagcgccagccccagcaccagcagcttctgcctgggcgtgagcgtggccgccagcagccacgtgcccatccagaagaagctgagattcgaggacaccctggagttcgtgggcttcgacgccaagatggccgaggagagcagcagcagcagcagcagcagcagccccaccgccgccaccagccagcagcagcagctgaagaacaagagcatcctgatcagcagcgtggccagcgtgcaccacgccaacggcctggccaagagcagcaccaccgtgagcagcttcgccaacagcaagcccggcagcgccaagaagctggtgatcaagaacttcaaggacaagcccaagctgcccgagaactacaccgacgagacctggcagaagctgaaggaggccgtggaggccatccagaacagcaccagcatcaagtacaacctggaggagctgtaccaggccgtggagaacctgtgcagctacaagatcagcgccaacctgtacaagcagctgagacagatctgcgaggaccacatcaaggcccagatccaccagttcagagaggacagcctggacagcgtgctgttcctgaagaagatcgacagatgctggcagaaccactgcagacagatgatcatgatcagaagcatcttcctgttcctggacagaacctacgtgctgcagaacagcatgctgcccagcatctgggacatgggcctggagctgttcagagcccacatcatcagcgaccagaaggtgcagaacaagaccatcgacggcatcctgctgctgatcgagagagagagaaacggcgaggccatcgacagaagcctgctgagaagcctgctgagcatgctgagcgacctgcagatctaccaggacagcttcgagcagagattcctggaggagaccaacagactgtacgccgccgagggccagaagctgatgcaggagagagaggtgcccgagtacctgcaccacgtgaacaagagactggaggaggaggccgacagactgatcacctacctggaccagaccacccagaagagcctgatcgccaccgtggagaagcagctgctgggcgagcacctgaccgccatcctgcagaagggcctgaacaacctgctggacgagaacagaatccaggacctgagcctgctgtaccagctgttcagcagagtgagaggcggcgtgcaggtgctgctgcagcagtggatcgagtacatcaaggccttcggcagcaccatcgtgatcaaccccgagaaggacaagaccatggtgcaggagctgctggacttcaaggacaaggtggaccacatcatcgacatctgcttcctgaagaacgagaagttcatcaacgccatgaaggaggccttcgagaccttcatcaacaagagacccaacaagcccgccgagctgatcgccaagtacgtggacagcaagctgagagccggcaacaaggaggccaccgacgaggagctggagaagatgctggacaagatcatgatcatcttcagattcatctacggcaaggacgtgttcgaggccttctacaagaaggacctggccaagagactgctggtgggcaagagcgccagcgtggacgccgagaagagcatgctgagcaagctgaagcacgagtgcggcgccgccttcaccagcaagctggagggcatgttcaaggacatggagctgagcaaggacatcatgatccagttcaagcagtacatgcagaaccagaacgtgcccggcaacatcgagctgaccgtgaacatcctgaccatgggctactggcccacctacgtgcccatggaggtgcacctgccccccgagatggtgaagctgcaggagatcttcaagaccttctacctgggcaagcacagcggcagaaagctgcagtggcagagcaccctgggccactgcgtgctgaaggccgagttcaaggagggcaagaaggagctgcaggtgagcctgttccagaccctggtgctgctgatgttcaacgagggcgaggagttcagcctggaggagatcaagcaggccaccggcatcgaggacggcgagctgagaagaaccctgcagagcctggcctgcggcaaggccagagtgctggccaagaaccccaagggcaaggacatcgaggacggcgacaagttcatctgcaacgacgacttcaagcacaagctgttcagaatcaagatcaaccagatccagatgaaggagaccgtggaggagcaggccagcaccaccgagagagtgttccaggacagacagtaccagatcgacgccgccatcgtgagaatcatgaagatgagaaagaccctgagccacaacctgctggtgagcgaggtgtacaaccagctgaagttccccgtgaagcccgccgacctgaagaagagaatcgagagcctgatcgacagagactacatggagagagacaaggagaaccccaaccagtacaactacatcgcctag

SEQ ID NO: 77956 - DNA, 705 bp, Artificial Sequence
  Description of Artificial Sequence: Synthetic coding sequence
atgatcgaccccgacttcgccgacaagcccaagctgcccgagaactacaccgacgagacctggcagaagctgaaggaggccgtggaggccatccagaacagcaccagcatcaagtacaacctggaggagctgtaccaggccgtggagaacctgtgcagctacaagatcagcgccaacctgtacaagcagctgagacagatctgcgaggaccacatcaaggcccagatccaccagttcagagaggacagcctggacagcgtgctgttcctgaagaagatcgacagatgctggcagaaccactgcagacagatgatcatgatcagaagcatcttcctgttcctggacagaacctacgtgctgcagaacagcatgctgcccagcatctgggacatgggcctggagctgttcagagcccacatcatcagcgaccagaaggtgcagaacaagaccatcgacggcatcctgctgctgatcgagagagagagaaacggcgaggccatcgacagaagcctgctgagaagcctgctgagcatgctgagcgacctgcagatctaccaggacagcttcgagcagagattcctggaggagaccaacagactgtacgccgccgagggccagaagctgatgcaggagagagaggtgcccgagtacctgcaccacgtgaacaagagactggaggaggaggccgacagactgatcacctag

SEQ ID NO: 77957 - DNA, 2742 bp, Artificial Sequence
  Description of Artificial Sequence: Synthetic coding sequence
atgatgagccagagcagcggcagcggcgacggcaacgacgacgaggccaccaccagcaaggacggcggcttcagcagccccagccccagcgccgccgccgccgcccaggaggtgagaagcgccaccgacggcaacaccagcaccaccccccccaccagcgccaagaagagaaagctgaacagcagcagcagcagcagcagcaacagcagcaacgagagagaggacttcgacagcaccagcagcagcagcagcaccccccccctgcagcccagagacagcgccagccccagcaccagcagcttctgcctgggcgtgagcgtggccgccagcagccacgtgcccatccagaagaagctgagattcgaggacaccctggagttcgtgggcttcgacgccaagatggccgaggagagcagcagcagcagcagcagcagcagccccaccgccgccaccagccagcagcagcagctgaagaacaagagcatcctgatcagcagcgtggccagcgtgcaccacgccaacggcctggccaagagcagcaccaccgtgagcagcttcgccaacagcaagcccggcagcgccaagaagctggtgatcaagaacttcaaggacaagcccaagctgcccgagaactacaccgacgagacctggcagaagctgaaggaggccgtggaggccatccagaacagcaccagcatcaagtacaacctggaggagctgtaccaggccgtggagaacctgtgcagctacaagatcagcgccaacctgtacaagcagctgagacagatctgcgaggaccacatcaaggcccagatccaccagttcagagaggacagcctggacagcgtgctgttcctgaagaagatcgacagatgctggcagaaccactgcagacagatgatcatgatcagaagcatcttcctgttcctggacagaacctacgtgctgcagaacagcatgctgcccagcatctgggacatgggcctggagctgttcagagcccacatcatcagcgaccagaaggtgcagaacaagaccatcgacggcatcctgctgctgatcgagagagagagaaacggcgaggccatcgacagaagcctgctgagaagcctgctgagcatgctgagcgacctgcagatctaccaggacagcttcgagcagagattcctggaggagaccaacagactgtacgccgccgagggccagaagctgatgcaggagagagaggtgcccgagtacctgcaccacgtgaacaagagactggaggaggaggccgacagactgatcacctacctggaccagaccacccagaagagcctgatcgccaccgtggagaagcagctgctgggcgagcacctgaccgccatcctgcagaagggcctgaacaacctgctggacgagaacagaatccaggacctgagcctgctgtaccagctgttcagcagagtgagaggcggcgtgcaggtgctgctgcagcagtggatcgagtacatcaaggccttcggcagcaccatcgtgatcaaccccgagaaggacaagaccatggtgcaggagctgctggacttcaaggacaaggtggaccacatcatcgacatctgcttcctgaagaacgagaagttcatcaacgccatgaaggaggccttcgagaccttcatcaacaagagacccaacaagcccgccgagctgatcgccaagtacgtggacagcaagctgagagccggcaacaaggaggccaccgacgaggagctggagaagatgctggacaagatcatgatcatcttcagattcatctacggcaaggacgtgttcgaggccttctacaagaaggacctggccaagagactgctggtgggcaagagcgccagcgtggacgccgagaagagcatgctgagcaagctgaagcacgagtgcggcgccgccttcaccagcaagctggagggcatgttcaaggacatggagctgagcaaggacatcatgatccagttcaagcagtacatgcagaaccagaacgtgcccggcaacatcgagctgaccgtgaacatcctgaccatgggctactggcccacctacgtgcccatggaggtgcacctgccccccgagatggtgaagctgcaggagatcttcaagaccttctacctgggcaagcacagcggcagaaagctgcagtggcagagcaccctgggccactgcgtgctgaaggccgagttcaaggagggcaagaaggagctgcaggtgagcctgttccagaccctggtgctgctgatgttcaacgagggcgaggagttcagcctggaggagatcaagcaggccaccggcatcgaggacggcgagctgagaagaaccctgcagagcctggcctgcggcaaggccagagtgctggccaagaaccccaagggcaaggacatcgaggacggcgacaagttcatctgcaacgacgacttcaagcacaagctgttcagaatcaagatcaaccagatccagatgaaggagaccgtggaggagcaggccagcaccaccgagagagtgttccaggacagacagtaccagatcgacgccgccatcgtgagaatcatgaagatgagaaagaccctgagccacaacctgctggtgagcgaggtgtacaaccagctgaagttccccgtgaagcccgccgacctgaagaagagaatcgagagcctgatcgacagagactacatggagagagacaaggagaaccccaaccagtacaactacatcgcctag

SEQ ID NO: 77958 - DNA, 2343 bp, Artificial Sequence
  Description of Artificial Sequence: Synthetic coding sequence
atggccaccagcaacctgctgaagaacaagggcagcctgcagttcgaggacaagtgggacttcatgagacccatcgtgctgaagctgctgagacaggagagcgtgaccaagcagcagtggttcgacctgttcagcgacgtgcacgccgtgtgcctgtgggacgacaagggccccgccaagatccaccaggccctgaaggaggacatcctggagttcatcaagcaggcccaggccagagtgctgagccaccaggacgacaccgccctgctgaaggcctacatcgtggagtggagaaagttcttcacccagtgcgacatcctgcccaagcccttctgccagctggagatcaccctgatgggcaagcagggcagcaacaagaagagcaacgtggaggacagcatcgtgagaaagctgatgctggacacctggaacgagagcatcttcagcaacatcaagaacagactgcaggacagcgccatgaagctggtgcacgccgagagactgggcgaggccttcgacagccagctggtgatcggcgtgagagagagctacgtgaacctgtgcagcaaccccgaggacaagctgcagatctacagagacaacttcgagaaggcctacctggacagcaccgagagattctacagaacccaggcccccagctacctgcagcagaacggcgtgcagaactacatgaagtacgccgacgccaagctgaaggaggaggagaagagagccctgagatacctggagaccagaagagagtgcaacagcgtggaggccctgatggagtgctgcgtgaacgccctggtgaccagcttcaaggagaccatcctggccgagtgccagggcatgatcaagagaaacgagaccgagaagctgcacctgatgttcagcctgatggacaaggtgcccaacggcatcgagcccatgctgaaggacctggaggagcacatcatcagcgccggcctggccgacatggtggccgccgccgagaccatcaccaccgacagcgagaagtacgtggagcagctgctgaccctgttcaacagattcagcaagctggtgaaggaggccttccaggacgaccccagattcctgaccgccagagacaaggcctacaaggccgtggtgaacgacgccaccatcttcaagctggagctgcccctgaagcagaagggcgtgggcctgaagacccagcccgagagcaagtgccccgagctgctggccaactactgcgacatgctgctgagaaagacccccctgagcaagaagctgaccagcgaggagatcgaggccaagctgaaggaggtgctgctggtgctgaagtacgtgcagaacaaggacgtgttcatgagataccacaaggcccacctgaccagaagactgatcctggacatcagcgccgacagcgagatcgaggagaacatggtggagtggctgagagaggtgggcatgcccgccgactacgtgaacaagctggccagaatgttccaggacatcaaggtgagcgaggacctgaaccaggccttcaaggagatgcacaagaacaacaagctggccctgcccgccgacagcgtgaacatcaagatcctgaacgccggcgcctggagcagaagcagcgagaaggtgttcgtgagcctgcccaccgagctggaggacctgatccccgaggtggaggagttctacaagaagaaccacagcggcagaaagctgcactggcaccacctgatgagcaacggcatcatcaccttcaagaacgaggtgggccagtacgacctggaggtgaccaccttccagctggccgtgctgttcgcctggaaccagagacccagagagaagatcagcttcgagaacctgaagctggccaccgagctgcccgacgccgagctgagaagaaccctgtggagcctggtggccttccccaagctgaagagacaggtgctgctgtacgagccccaggtgaacagccccaaggacttcaccgagggcaccctgttcagcgtgaaccaggagttcagcctgatcaagaacgccaaggtgcagaagagaggcaagatcaacctgatcggcagactgcagctgaccaccgagagaatgagagaggaggagaacgagggcatcgtgcagctgagaatcctgagaacccaggaggccatcatccagatcatgaagatgagaaagaagatcagcaacgcccagctgcagaccgagctggtggagatcctgaagaacatgttcctgccccagaagaagatgatcaaggagcagatcgagtggctgatcgagcacaagtacatcagaagagacgagagcgacatcaacaccttcatctacatggcctag

SEQ ID NO: 77959 - DNA, 2343 bp, Artificial Sequence; identical to SEQ ID NO: 77958
  Description of Artificial Sequence: Synthetic coding sequence

SEQ ID NO: 77960 - DNA, 5097 bp, Artificial Sequence
  Description of Artificial Sequence: Synthetic coding sequence
atggtgggcgagctgagatacagagagttcagagtgcccctgggccccggcctgcacgcctaccccgacgagctgatcagacagagagtgggccacgacggccaccccgagtaccagatcagatggctgatcctgagaagaggcgacgagggcgacggcggcagcggccaggtggactgcaaggccgagcacatcctgctgtggatgagcaaggacgagatctacgccaactgccacaagatgctgggcgaggacggccaggtgatcggccccagccaggagagcgccggcgaggtgggcgccctggacaagagcgtgctggaggagatggagaccgacgtgaagagcctgatccagagagccctgagacagctggaggagtgcgtgggcaccatcccccccgcccccctgctgcacaccgtgcacgtgctgagcgcctacgccagcatcgagcccctgaccggcgtgttcaaggaccccagagtgctggacctgctgatgcacatgctgagcagccccgactaccagatcagatggagcgccggcagaatgatccaggccctgagcagccacgacgccggcaccagaacccagatcctgctgagcctgagccagcaggaggccatcgagaagcacctggacttcgacagcagatgcgccctgctggccctgttcgcccaggccaccctgagcgagcaccccatgagcttcgagggcatccagctgccccaggtgcccggcagagtgctgttcagcctggtgaagagatacctgcacgtgaccagcctgctggaccagctgaacgacagcgccgccgagcccggcgcccagaacaccagcgcccccgaggagctgagcggcgagagaggccagctggagctggagttcagcatggccatgggcaccctgatcagcgagctggtgcaggccatgagatgggaccaggccagcgacagacccagaagcagcgccagaagccccggcagcatcttccagccccagctggccgacgtgagccccggcctgcccgccgcccaggcccagcccagcttcagaagaagcagaagattcagacccagaagcgagttcgccagcggcaacacctacgccctgtacgtgagagacaccctgcagcccggcatgagagtgagaatgctggacgactacgaggagatcagcgccggcgacgagggcgagttcagacagagcaacaacggcgtgccccccgtgcaggtgttctgggagagcaccggcagaacctactgggtgcactggcacatgctggagatcctgggcttcgaggaggacatcgaggacatggtggaggccgacgagtaccagggcgccgtggccagcagagtgctgggcagagccctgcccgcctggagatggagacccatgaccgagctgtacgccgtgccctacgtgctgcccgaggacgaggacaccgaggagtgcgagcacctgaccctggccgagtggtgggagctgctgttcttcatcaagaagctggacggccccgaccaccaggaggtgctgcagatcctgcaggagaacctggacggcgagatcctggacgacgagatcctggccgagctggccgtgcccatcgagctggcccaggacctgctgctgaccctgccccagagactgaacgacagcgccctgagagacctgatcaactgccacgtgtacaagaagtacggccccgaggccctggccggcaaccaggcctaccccagcctgctggaggcccaggaggacgtgctgctgctggacgcccaggcccaggccaaggacagcgaggacgccgccaaggtggaggccaaggagccccccagccagagccccaacacccccctgcagagactggtggagggctacggccccgccggcaagatcctgctggacctggagcaggccctgagcagcgagggcacccaggagaacaaggtgaagcccctgctgctgcagctgcagagacagccccagcccttcctggccctgatgcagagcctggacacccccgagaccaacagaaccctgcacctgaccgtgctgagaatcctgaagcagctggtggacttccccgaggccctgctgctgccctggcacgaggccgtggacgcctgcatggcctgcctgagaagccccaacaccgacagagaggtgctgcaggagctgatcttcttcctgcacagactgaccagcgtgagcagagactacgccgtggtgctgaaccagctgggcgccagagacgccatcagcaaggccctggagaagcacctgggcaagctggagctggcccaggagctgagagacatggtgttcaagtgcgagaagcacgcccacctgtacagaaagctgatcaccaacatcctgggcggctgcatccagatggtgctgggccagatcgaggaccacagaagaacccaccagcccatcaacatccccttcttcgacgtgttcctgagatacctgtgccagggcagcagcgtggaggtgaaggaggacaagtgctgggagaaggtggaggtgagcagcaacccccacagagccagcaagctgaccgaccacaaccccaagacctactgggagagcaacggcagcgccggcagccactacatcaccctgcacatgagaagaggcatcctgatcagacagctgaccctgctggtggccagcgaggacagcagctacatgcccgccagagtggtggtgtgcggcggcgacagcaccagcagcctgcacaccgagctgaacagcgtgaacgtgatgcccagcgccagcagagtgatcctgctggagaacctgaccagattctggcccatcatccagatcagaatcaagagatgccagcagggcggcatcgacaccagaatcagaggcctggagatcctgggccccaagcccaccttctggcccgtgttcagagagcagctgtgcagacacaccagactgttctacatggtgagagcccaggcctggagccaggacatggccgaggacagaagaagcctgctgcacctgagcagcagactgaacggcgccctgagacaggagcagaacttcgccgacagattcctgcccgacgacgaggccgcccaggccctgggcaagacctgctgggaggccctggtgagccccgtggtgcagaacatcaccagccccgacgaggacggcatcagccccctgggctggctgctggaccagtacctggagtgccaggaggccgtgttcaacccccagagcagaggccccgccttcttcagcagagtgagaagactgacccacctgctggtgcacgtggagccctgcgaggcccccccccccgtggtggccacccccagacccaagggcagaaacagaagccacgactggagcagcctggccaccagaggcctgcccagcagcatcatgagaaacctgaccagatgctggagagccgtggtggagaagcaggtgaacaacttcctgaccagcagctggagagacgacgacttcgtgcccagatactgcgagcacttcaacatcctgcagaacagcagcagcgagctgttcggccccagagccgccttcctgctggccctgcagaacggctgcgccggcgccctgctgaagctgcccttcctgaaggccgcccacgtgagcgagcagttcgccagacacatcgaccagcagatccagggcagcagaatcggcggcgcccaggagatggagagactggcccagctgcagcagtgcctgcaggccgtgctgatcttcagcggcctggagatcgccaccaccttcgagcactactaccagcactacatggccgacagactgctgggcgtggtgagcagctggctggagggcgccgtgctggagcagatcggcccctgcttccccaacagactgccccagcagatgctgcagagcctgagcaccagcaaggagctgcagagacagttccacgtgtaccagctgcagcagctggaccaggagctgctgaagctggaggacaccgagaagaagatccaggtgggcctgggcgccagcggcaaggagcacaagagcgagaaggaggaggaggccggcgccgccgccgtggtggacgtggccgagggcgaggaggaggaggaggagaacgaggacctgtactacgagggcgccatgcccgaggtgagcgtgctggtgctgagcagacacagctggcccgtggccagcatctgccacaccctgaaccccagaacctgcctgcccagctacctgagaggcaccctgaacagatacagcaacttctacaacaagagccagagccaccccgccctggagagaggcagccagagaagactgcagtggacctggctgggctgggccgagctgcagttcggcaaccagaccctgcacgtgagcaccgtgcagatgtggctgctgctgtacctgaacgacctgaaggccgtgagcgtggagagcctgctggccttcagcggcctgagcgccgacatgctgaaccaggccatcggccccctgaccagcagcagaggccccctggacctgcacgagcagaaggacatccccggcggcgtgctgaagatcagagacggcagcaaggagcccagaagcagatgggacatcgtgagactgatccccccccagacctacctgcaggccgagggcgaggacggccagaacctggagaagagaagaaacctgctgaactgcctgatcgtgagaatcctgaaggcccacggcgacgagggcctgcacatcgaccagctggtgtgcctggtgctggaggcctggcagaagggcccctgcccccccagaggcctggtgagcagcctgggcaagggcagcgcctgcagcagcaccgacgtgctgagctgcatcctgcacctgctgggcaagggcaccctgagaagacacgacgacagaccccaggtgctgagctacgccgtgcccgtgaccgtgatggagccccacaccgagagcctgaaccccggcagcagcggccccaacccccccctgaccttccacaccctgcagatcagaagcagaggcgtgccctacgccagctgcaccgccacccagagcttcagcaccttcagatag

SEQ ID NO: 77961 - DNA, 5349 bp, Artificial Sequence
  Description of Artificial Sequence: Synthetic coding sequence
atgagcagaggcttctggctggccgagcccctggccggcaccggcccccaccccgcccccgtggccgccgacagcagaggctgcagcagcgtgcccagaagacacgcccccagcagactgagcgtgagcacccccagcagaggccccggcgccagaatggtgggcgagctgagatacagagagttcagagtgcccctgggccccggcctgcacgcctaccccgacgagctgatcagacagagagtgggccacgacggccaccccgagtaccagatcagatggctgatcctgagaagaggcgacgagggcgacggcggcagcggccaggtggactgcaaggccgagcacatcctgctgtggatgagcaaggacgagatctacgccaactgccacaagatgctgggcgaggacggccaggtgatcggccccagccaggagagcgccggcgaggtgggcgccctggacaagagcgtgctggaggagatggagaccgacgtgaagagcctgatccagagagccctgagacagctggaggagtgcgtgggcaccatcccccccgcccccctgctgcacaccgtgcacgtgctgagcgcctacgccagcatcgagcccctgaccggcgtgttcaaggaccccagagtgctggacctgctgatgcacatgctgagcagccccgactaccagatcagatggagcgccggcagaatgatccaggccctgagcagccacgacgccggcgagggccagtgcggcgaggagggcaaggccggcgagggcctgggcagactgagagacagccaggacaccgtggccggcgccagcgacctgatcagaaccagaacccagatcctgctgagcctgagccagcaggaggccatcgagaagcacctggacttcgacagcagatgcgccctgctggccctgttcgcccaggccaccctgagcgagcaccccatgagcttcgagggcatccagctgccccaggtgcccggcagagtgctgttcagcctggtgaagagatacctgcacgtgaccagcctgctggaccagctgaacgacagcgccgccgagcccggcgcccagaacaccagcgcccccgaggagctgagcggcgagagaggccagctggagctggagttcagcatggccatgggcaccctgatcagcgagctggtgcaggccatgagatgggaccaggccagcgacagacccagaagcagcgccagaagccccggcagcatcttccagccccagctggccgacgtgagccccggcctgcccgccgcccaggcccagcccagcttcagaagaagcagaagattcagacccagaagcgagttcgccagcggcaacacctacgccctgtacgtgagagacaccctgcagcccggcatgagagtgagaatgctggacgactacgaggagatcagcgccggcgacgagggcgagttcagacagagcaacaacggcgtgccccccgtgcaggtgttctgggagagcaccggcagaacctactgggtgcactggcacatgctggagatcctgggcttcgaggaggacatcgaggacatggtggaggccgacgagtaccagggcgccgtggccagcagagtgctgggcagagccctgcccgcctggagatggagacccatgaccgagctgtacgccgtgccctacgtgctgcccgaggacgaggacaccgaggagtgcgagcacctgaccctggccgagtggtgggagctgctgttcttcatcaagaagctggacggccccgaccaccaggaggtgctgcagatcctgcaggagaacctggacggcgagatcctggacgacgagatcctggccgagctggccgtgcccatcgagctggcccaggacctgctgctgaccctgccccagagactgaacgacagcgccctgagagacctgatcaactgccacgtgtacaagaagtacggccccgaggccctggccggcaaccaggcctaccccagcctgctggaggcccaggaggacgtgctgctgctggacgcccaggcccaggccaaggacagcgaggacgccgccaaggtggaggccaaggagccccccagccagagccccaacacccccctgcagagactggtggagggctacggccccgccggcaagatcctgctggacctggagcaggccctgagcagcgagggcacccaggagaacaaggtgaagcccctgctgctgcagctgcagagacagccccagcccttcctggccctgatgcagagcctggacacccccgagaccaacagaaccctgcacctgaccgtgctgagaatcctgaagcagctggtggacttccccgaggccctgctgctgccctggcacgaggccgtggacgcctgcatggcctgcctgagaagccccaacaccgacagagaggtgctgcaggagctgatcttcttcctgcacagactgaccagcgtgagcagagactacgccgtggtgctgaaccagctgggcgccagagacgccatcagcaaggccctggagaagcacctgggcaagctggagctggcccaggagctgagagacatggtgttcaagtgcgagaagcacgcccacctgtacagaaagctgatcaccaacatcctgggcggctgcatccagatggtgctgggccagatcgaggaccacagaagaacccaccagcccatcaacatccccttcttcgacgtgttcctgagatacctgtgccagggcagcagcgtggaggtgaaggaggacaagtgctgggagaaggtggaggtgagcagcaacccccacagagccagcaagctgaccgaccacaaccccaagacctactgggagagcaacggcagcgccggcagccactacatcaccctgcacatgagaagaggcatcctgatcagacagctgaccctgctggtggccagcgaggacagcagctacatgcccgccagagtggtggtgtgcggcggcgacagcaccagcagcctgcacaccgagctgaacagcgtgaacgtgatgcccagcgccagcagagtgatcctgctggagaacctgaccagattctggcccatcatccagatcagaatcaagagatgccagcagggcggcatcgacaccagaatcagaggcctggagatcctgggccccaagcccaccttctggcccgtgttcagagagcagctgtgcagacacaccagactgttctacatggtgagagcccaggcctggagccaggacatggccgaggacagaagaagcctgctgcacctgagcagcagactgaacggcgccctgagacaggagcagaacttcgccgacagattcctgcccgacgacgaggccgcccaggccctgggcaagacctgctgggaggccctggtgagccccgtggtgcagaacatcaccagccccgacgaggacggcatcagccccctgggctggctgctggaccagtacctggagtgccaggaggccgtgttcaacccccagagcagaggccccgccttcttcagcagagtgagaagactgacccacctgctggtgcacgtggagccctgcgaggcccccccccccgtggtggccacccccagacccaagggcagaaacagaagccacgactggagcagcctggccaccagaggcctgcccagcagcatcatgagaaacctgaccagatgctggagagccgtggtggagaagcaggtgaacaacttcctgaccagcagctggagagacgacgacttcgtgcccagatactgcgagcacttcaacatcctgcagaacagcagcagcgagctgttcggccccagagccgccttcctgctggccctgcagaacggctgcgccggcgccctgctgaagctgcccttcctgaaggccgcccacgtgagcgagcagttcgccagacacatcgaccagcagatccagggcagcagaatcggcggcgcccaggagatggagagactggcccagctgcagcagtgcctgcaggccgtgctgatcttcagcggcctggagatcgccaccaccttcgagcactactaccagcactacatggccgacagactgctgggcgtggtgagcagctggctggagggcgccgtgctggagcagatcggcccctgcttccccaacagactgccccagcagatgctgcagagcctgagcaccagcaaggagctgcagagacagttccacgtgtaccagctgcagcagctggaccaggagctgctgaagctggaggacaccgagaagaagatccaggtgggcctgggcgccagcggcaaggagcacaagagcgagaaggaggaggaggccggcgccgccgccgtggtggacgtggccgagggcgaggaggaggaggaggagaacgaggacctgtactacgagggcgccatgcccgaggtgagcgtgctggtgctgagcagacacagctggcccgtggccagcatctgccacaccctgaaccccagaacctgcctgcccagctacctgagaggcaccctgaacagatacagcaacttctacaacaagagccagagccaccccgccctggagagaggcagccagagaagactgcagtggacctggctgggctgggccgagctgcagttcggcaaccagaccctgcacgtgagcaccgtgcagatgtggctgctgctgtacctgaacgacctgaaggccgtgagcgtggagagcctgctggccttcagcggcctgagcgccgacatgctgaaccaggccatcggccccctgaccagcagcagaggccccctggacctgcacgagcagaaggacatccccggcggcgtgctgaagatcagagacggcagcaaggagcccagaagcagatgggacatcgtgagactgatccccccccagacctacctgcaggccgagggcgaggacggccagaacctggagaagagaagaaacctgctgaactgcctgatcgtgagaatcctgaaggcccacggcgacgagggcctgcacatcgaccagctggtgtgcctggtgctggaggcctggcagaagggcccctgcccccccagaggcctggtgagcagcctgggcaagggcagcgcctgcagcagcaccgacgtgctgagctgcatcctgcacctgctgggcaagggcaccctgagaagacacgacgacagaccccaggtgctgagctacgccgtgcccgtgaccgtgatggagccccacaccgagagcctgaaccccggcagcagcggccccaacccccccctgaccttccacaccctgcagatcagaagcagaggcgtgccctacgccagctgcaccgccacccagagcttcagcaccttcagatag

SEQ ID NO: 77962 - DNA, 435 bp, Artificial Sequence
  Description of Artificial Sequence: Synthetic coding sequence
atgggcgtgctgcaggtggtgaagcagagcgtgcagatccccgtgttcgtgatgatcagacccagaggcggcgacttcctgtacagcgacagagagatcgaggtgatgaaggccgacatcagactggccaagctgtacggcgccgacggcctggtgttcggcgccctgaccgaggacggccacatcgacaaggagctgtgcatgagcctgatggccatctgcagacccctgcccgtgaccttccacagagccttcgacatggtgcacgaccccatggccgccctggagaccctgctgaccctgggcttcgagagagtgctgaccagcggctgcgacagcagcgccctggagggcctgcccctgatcaagagactgatcgagcaggccaagggcagaatcgtggtgatgcccggcggcggcatcaccgacagatag

SEQ ID NO: 77963 - DNA, 822 bp, Artificial Sequence
  Description of Artificial Sequence: Synthetic coding sequence
atgaagagacagggcgccagcagcgagagaaagagagccagaatccccagcggcaaggccggcgccgccaacggcttcctgatggaggtgtgcgtggacagcgtggagagcgccgtgaacgccgagagaggcggcgccgacagaatcgagctgtgcagcggcctgagcgagggcggcaccacccccagcatgggcgtgctgcaggtggtgaagcagagcgtgcagatccccgtgttcgtgatgatcagacccagaggcggcgacttcctgtacagcgacagagagatcgaggtgatgaaggccgacatcagactggccaagctgtacggcgccgacggcctggtgttcggcgccctgaccgaggacggccacatcgacaaggagctgtgcatgagcctgatggccatctgcagacccctgcccgtgaccttccacagagccttcgacatggtgcacgaccccatggccgccctggagaccctgctgaccctgggcttcgagagagtgctgaccagcggctgcgacagcagcgccctggagggcctgcccctgatcaagagactgatcgagcaggccaagggcagaatcgtggtgatgcccggcggcggcatcaccgacagaaacctgcagagaatcctggagggcagcggcgccaccgagttccactgcagcgccagaagcaccagagacagcggcatgaagttcagaaacagcagcgtggccatgggcgccagcctgagctgcagcgagtacagcctgaaggtgaccgacgtgaccaaggtgagaaccctgaacgccatcgccaagaacatcctggtgtag

SEQ ID NO: 77964 - DNA, 1122 bp, Artificial Sequence
  Description of Artificial Sequence: Synthetic coding sequence
atgagcctgctgctgctgctgctgctggtgagctactacgtgggcaccctgggcacccacaccgagatcaagagagtggccgaggagaaggtgaccctgccctgccaccaccagctgggcctgcccgagaaggacaccctggacatcgagtggctgctgaccgacaacgagggcaaccagaaggtggtgatcacctacagcagcagacacgtgtacaacaacctgaccgaggagcagaagggcagagtggccttcgccagcaacttcctggccggcgacgccagcctgcagatcgagcccctgaagcccagcgacgagggcagatacacctgcaaggtgaagaacagcggcagatacgtgtggagccacgtgatcctgaaggtgctggtgagacccagcaagcccaagtgcgagctggagggcgagctgaccgagggcagcgacctgaccctgcagtgcgagagcagcagcggcaccgagcccatcgtgtactactggcagagaatcagagagaaggagggcgaggacgagagactgccccccaagagcagaatcgactacaaccaccccggcagagtgctgctgcagaacctgaccatgagctacagcggcctgtaccagtgcaccgccggcaacgaggccggcaaggagagctgcgtggtgagagtgaccgtgcagtacgtgcagagcatcggcatggtggccggcgccgtgaccggcatcgtggccggcgccctgctgatcttcctgctggtgtggctgctgatcagaagaaaggacaaggagagatacgaggaggaggagagacccaacgagatcagagaggacgccgaggcccccaaggccagactggtgaagcccagcagcagcagcagcggcagcagaagcagcagaagcggcagcagcagcaccagaagcaccgccaacagcgccagcagaagccagagaaccctgagcaccgacgccgccccccagcccggcctggccacccaggcctacagcctggtgggccccgaggtgagaggcagcgagcccaagaaggtgcaccacgccaacctgaccaaggccgagaccacccccagcatgatccccagccagagcagagccttccagaccgtgtag

SEQ ID NO: 77965 - DNA, 597 bp, Artificial Sequence
  Description of Artificial Sequence: Synthetic coding sequence
atgcaccacagaaacgacagccagagactgggcaaggccggctgcccccccgagcccagcctgcagatggccaacaccaacttcctgagcaccctgagccccgagcactgcagacccctggccggcgagtgcatgaacaagctgaagtgcggcgccgccgaggccgagatcatgaacctgcccgagagagtgggcaccttcagcgccatccccgccctgggcggcatcagcctgccccccggcgtgatcgtgatgaccgccctgcacagccccgccgccgccagcgccgccgtgaccgacagcgccttccagatcgccaacctggccgactgcccccagaaccacagcagcagcagcagcagcagcagcggcggcgccggcggcgccaaccccgccaagaagaagagaaagagatgcggcgtgtgcgtgccctgcaagagactgatcaactgcggcgtgtgcagcagctgcagaaacagaaagaccggccaccagatctgcaagttcagaaagtgcgaggagctgaagaagaagcccggcaccagcctggagagaacccccgtgcccagcgccgaggccttcagatggttcttctag

SEQ ID NO: 77966 - DNA, 597 bp, Artificial Sequence; identical to SEQ ID NO: 77965
  Description of Artificial Sequence: Synthetic coding sequence

SEQ ID NO: 77967 - DNA, 969 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagcagcttcggcagcagcggcggcagcggcggcggcagcatgatgggcggcgagagcgccgacaaggccaccgccgccgccgccgccgccagcctgctggccaacggccacgacctggccgccgccatggccgtggacaagagcaaccccaccagcaagcacaagagcggcgccgtggccagcctgctgagcaaggccgagagagccaccgagctggccgccgagggccagctgaccctgcagcagttcgcccagagcaccgagatgctgaagagagtggtgcaggagcacctgcccctgatgagcgaggccggcgccggcctgcccgacatggaggccgtggccggcgccgaggccctgaacggccagagcgacttcccctacctgggcgccttccccatcaaccccggcctgttcatcatgacccccgccggcgtgttcctggccgagagcgccctgcacatggccggcctggccgagtaccccatgcagggcgagctggccagcgccatcagcagcggcaagaagaagagaaagagatgcggcatgtgcgccccctgcagaagaagaatcaactgcgagcagtgcagcagctgcagaaacagaaagaccggccaccagatctgcaagttcagaaagtgcgaggagctgaagaagaagcccagcgccgccctggagaaggtgatgctgcccaccggcgccgccttcagatggttccagtag

SEQ ID NO: 77968 - DNA, 210 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgtag

SEQ ID NO: 77969 - DNA, 243 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagctag

SEQ ID NO: 77970 - DNA, 546 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagcagcttcggcagcagcggcggcagcggcggcggcagcatgatgggcggcgagagcgccgacaaggccaccgccgccgccgccgccgccagcctgctggccaacggccacgacctggccgccgccatggccgtggacaagagcaaccccaccagcaagcacaagagcggcgccgtggccagcctgctgagcaaggccgagagagccaccgagctggccgccgagggccagctgaccctgcagcagttcgcccagagcaccgagatgctgaagagagtggtgcaggagcacctgccctag

SEQ ID NO: 77971 - DNA, 252 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagctag

SEQ ID NO: 77972 - DNA, 486 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagcagcttcggcagcagcggcggcagcggcggcggcagcatgatgggcggcgagagcgccgacaaggccaccgccgccgccgccgccgccagcctgctggccaacggccacgacctggccgccgccatggccgtggacaagagcaaccccaccagcaagcacaagagcggcgccgtggccagcctgctgagcaaggccgagagagccaccgagctggccgccgagggccagctgacctag

SEQ ID NO: 77973 - DNA, 309 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagcagcttcggcagcagcggcggcagcggcggcggcagcatgatgggcggcgagagcgcctag

SEQ ID NO: 77974 - DNA, 36 bp, Artificial Sequence
  Description of Artificial Sequence: Synthetic coding sequence
atgagcagcctgggcggcggcagccaggacgcctag

SEQ ID NO: 77975 - DNA, 297 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagcagcttcggcagcagcggcggcagcggcggcggcagcatgatgggctag

SEQ ID NO: 77976 - DNA, 969 bp, Artificial Sequence; identical to SEQ ID NO: 77967
  Description of Artificial Sequence: Synthetic coding sequence

SEQ ID NO: 77977 - DNA, 594 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagcagcttcggcagcagcggcggcagcggcggcggcagcatgatgggcggcgagagcgccgacaaggccaccgccgccgccgccgccgccagcctgctggccaacggccacgacctggccgccgccatggccgtggacaagagcaaccccaccagcaagcacaagagcggcgccgtggccagcctgctgagcaaggccgagagagccaccgagctggccgccgagggccagctgaccctgcagcagttcgcccagagcaccgagatgctgaagagagtggtgcaggagcacctgcccctgatgagcgaggccggcgccggcctgcccgacatggaggccgtggcctag

SEQ ID NO: 77978 - DNA, 27 bp, Artificial Sequence
  Description of Artificial Sequence: Synthetic coding sequence
atgagcagcctgggcggcggcagctag

SEQ ID NO: 77979 - DNA, 222 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgtag

SEQ ID NO: 77980 - DNA, 414 bp, Artificial Sequence
  Description of Artificial Sequence: Synthetic coding sequence
atgagcagcctgggcggcggcagccaggacgccggcggcagcagcagcagcagcaccaacggcagcggcggcagcggcagcagcggccccaaggccggcgccgccgacaagagcgccgtggtggccgccgccgcccccgccagcgtggccgacgacacccccccccccgagagaagaaacaagagcggcatcatcagcgagcccctgaacaagagcctgagaagaagcagacccctgagccactacagcagcttcggcagcagcggcggcagcggcggcggcagcatgatgggcggcgagagcgccgacaaggccaccgccgccgccgccgccgccagcctgctggccaacggccacgacctggccgccgccatggccgtggacaagagcaaccccaccagcaagcacaagtag

SEQ ID NO: 77981 - DNA, 2073 bp, Artificial Sequence
  Description of Artificial Sequence: Synthetic coding sequence
atgaagctgagcatgaagaacaacatcatcaacacccagcagagcttcgtgaccatgcccaacgtgatcgtgcccgacatcgagaaggagatcagaagaatggagaacggcgcctgcagcagcttcagcgaggacgacgacagcgccagcaccagcgaggagagcgagaacgagaacccccacgccagaggcagcttcagctacaagagcctgagaaagggcggccccagccagagagagcagtacctgcccggcgccatcgccctgttcaacgtgaacaacagcagcaacaaggaccaggagcccgaggagaagaagaagaagaagaaggagaagaagagcaagagcgacgacaagaacgagaacaagaacgaccccgagaagaagaagaagaagaaggacaaggagaagaagaagaaggaggagaagagcaaggacaagaaggaggaggagaagaaggaggtggtggtgatcgaccccagcggcaacacctactacaactggctgttctgcatcaccctgcccgtgatgtacaactggaccatggtgatcgccagagcctgcttcgacgagctgcagagcgactacctggagtactggctgatcctggactacgtgagcgacatcgtgtacctgatcgacatgttcgtgagaaccagaaccggctacctggagcagggcctgctggtgaaggaggagctgaagctgatcaacaagtacaagagcaacctgcagttcaagctggacgtgctgagcctgatccccaccgacctgctgtacttcaagctgggctggaactaccccgagatcagactgaacagactgctgagattcagcagaatgttcgagttcttccagagaaccgagaccagaaccaactaccccaacatcttcagaatcagcaacctggtgatgtacatcgtgatcatcatccactggaacgcctgcgtgttctacagcatcagcaaggccatcggcttcggcaacgacacctgggtgtaccccgacatcaacgaccccgagttcggcagactggccagaaagtacgtgtacagcctgtactggagcaccctgaccctgaccaccatcggcgagacccccccccccgtgagagacagcgagtacgtgttcgtggtggtggacttcctgatcggcgtgctgatcttcgccaccatcgtgggcaacatcggcagcatgatcagcaacatgaacgccgccagagccgagttccaggccagaatcgacgccatcaagcagtacatgcacttcagaaacgtgagcaaggacatggagaagagagtgatcaagtggttcgactacctgtggaccaacaagaagaccgtggacgagaaggaggtgctgaagtacctgcccgacaagctgagagccgagatcgccatcaacgtgcacctggacaccctgaagaaggtgagaatcttcgccgactgcgaggccggcctgctggtggagctggtgctgaagctgcagccccaggtgtacagccccggcgactacatctgcaagaagggcgacatcggcagagagatgtacatcatcaaggagggcaagctggccgtggtggccgacgacggcgtgacccagttcgtggtgctgagcgacggcagctacttcggcgagatcagcatcctgaacatcaagggcagcaaggccggcaacagaagaaccgccaacatcaagagcatcggctacagcgacctgttctgcctgagcaaggacgacctgatggaggccctgaccgagtaccccgacgccaagaccatgctggaggagaagggcaagcagatcctgatgaaggacggcctgctggacctgaacatcgccaacgccggcagcgaccccaaggacctggaggagaaggtgaccagaatggagggcagcgtggacctgctgcagaccagattcgccagaatcctggccgagtacgagagcatgcagcagaagctgaagcagagactgaccaaggtggagaagttcctgaagcccctgatcgacaccgagttcagcagcatcgagggccccggcgccgagagcggccccatcgacagcacctag

SEQ ID NO: 77982 - DNA, 2280 bp, Artificial Sequence
  Description of Artificial Sequence: Synthetic coding sequence
atggagagcagaagcagccccagactggagtgcagcggcgccatcagcgcccactgcagcctgcacctgcccgacagcagcgacttccagctgatcttcgtgttcctggtggagatgggcttccaccacgtgggccaggccggcctggagctgctgatcagcagcgacctgcccaccagcgccagccagagcgccggcatcaccgacatgaagctgagcatgaagaacaacatcatcaacacccagcagagcttcgtgaccatgcccaacgtgatcgtgcccgacatcgagaaggagatcagaagaatggagaacggcgcctgcagcagcttcagcgaggacgacgacagcgccagcaccagcgaggagagcgagaacgagaacccccacgccagaggcagcttcagctacaagagcctgagaaagggcggccccagccagagagagcagtacctgcccggcgccatcgccctgttcaacgtgaacaacagcagcaacaaggaccaggagcccgaggagaagaagaagaagaagaaggagaagaagagcaagagcgacgacaagaacgagaacaagaacgaccccgagaagaagaagaagaagaaggacaaggagaagaagaagaaggaggagaagagcaaggacaagaaggaggaggagaagaaggaggtggtggtgatcgaccccagcggcaacacctactacaactggctgttctgcatcaccctgcccgtgatgtacaactggaccatggtgatcgccagagcctgcttcgacgagctgcagagcgactacctggagtactggctgatcctggactacgtgagcgacatcgtgtacctgatcgacatgttcgtgagaaccagaaccggctacctggagcagggcctgctggtgaaggaggagctgaagctgatcaacaagtacaagagcaacctgcagttcaagctggacgtgctgagcctgatccccaccgacctgctgtacttcaagctgggctggaactaccccgagatcagactgaacagactgctgagattcagcagaatgttcgagttcttccagagaaccgagaccagaaccaactaccccaacatcttcagaatcagcaacctggtgatgtacatcgtgatcatcatccactggaacgcctgcgtgttctacagcatcagcaaggccatcggcttcggcaacgacacctgggtgtaccccgacatcaacgaccccgagttcggcagactggccagaaagtacgtgtacagcctgtactggagcaccctgaccctgaccaccatcggcgagacccccccccccgtgagagacagcgagtacgtgttcgtggtggtggacttcctgatcggcgtgctgatcttcgccaccatcgtgggcaacatcggcagcatgatcagcaacatgaacgccgccagagccgagttccaggccagaatcgacgccatcaagcagtacatgcacttcagaaacgtgagcaaggacatggagaagagagtgatcaagtggttcgactacctgtggaccaacaagaagaccgtggacgagaaggaggtgctgaagtacctgcccgacaagctgagagccgagatcgccatcaacgtgcacctggacaccctgaagaaggtgagaatcttcgccgactgcgaggccggcctgctggtggagctggtgctgaagctgcagccccaggtgtacagccccggcgactacatctgcaagaagggcgacatcggcagagagatgtacatcatcaaggagggcaagctggccgtggtggccgacgacggcgtgacccagttcgtggtgctgagcgacggcagctacttcggcgagatcagcatcctgaacatcaagggcagcaaggccggcaacagaagaaccgccaacatcaagagcatcggctacagcgacctgttctgcctgagcaaggacgacctgatggaggccctgaccgagtaccccgacgccaagaccatgctggaggagaagggcaagcagatcctgatgaaggacggcctgctggacctgaacatcgccaacgccggcagcgaccccaaggacctggaggagaaggtgaccagaatggagggcagcgtggacctgctgcagaccagattcgccagaatcctggccgagtacgagagcatgcagcagaagctgaagcagagactgaccaaggtggagaagttcctgaagcccctgatcgacaccgagttcagcagcatcgagggccccggcgccgagagcggccccatcgacagcacctag

SEQ ID NO: 77983 - DNA, 2073 bp, Artificial Sequence; identical to SEQ ID NO: 77981
  Description of Artificial Sequence: Synthetic coding sequence

SEQ ID NO: 77984 - DNA, 387 bp, Artificial Sequence
  Description of Artificial Sequence: Synthetic coding sequence
atgaagctgagcatgaagaacaacatcatcaacacccagcagagcttcgtgaccatgcccaacgtgatcgtgcccgacatcgagaaggagatcagaagaatggagaacggcgcctgcagcagcttcagcgaggacgacgacagcgccagcaccagcgaggagagcgagaacgagaacccccacgccagaggcagcttcagctacaagagcctgagaaagggcggccccagccagagagagcagtacctgcccggcgccatcgccctgttcaacgtgaacaacagcagcaacaaggaccaggagcccgaggagaagaagaagaagaagaaggagaagaagagcaagagcgacgacaagaacgagaacaagaacgaccccgagaagtag

SEQ ID NO: 77985 - DNA, 300 bp, Artificial Sequence
  Description of Artificial Sequence: Synthetic coding sequence
atgaagctgagcatgaagaacaacatcatcaacacccagcagagcttcgtgaccatgcccaacgtgatcgtgcccgacatcgagaaggagatcagaagaatggagaacggcgcctgcagcagcttcagcgaggacgacgacagcgccagcaccagcgaggagagcgagaacgagaacccccacgccagaggcagcttcagctacaagagcctgagaaagggcggccccagccagagagagcagtacctgcccggcgccatcgccctgttcaacgtgaacaacagcagcaacaaggactag

SEQ ID NO: 77986 - DNA, 2073 bp, Artificial Sequence; identical to SEQ ID NO: 77981
  Description of Artificial Sequence: Synthetic coding sequence

SEQ ID NO: 77987 - DNA, 300 bp, Artificial Sequence; identical to SEQ ID NO: 77985
  Description of Artificial Sequence: Synthetic coding sequence

SEQ ID NO: 77988 - DNA, 2073 bp, Artificial Sequence; identical to SEQ ID NO: 77981
  Description of Artificial Sequence: Synthetic coding sequence

SEQ ID NO: 77989 - DNA, 1995 bp, Artificial Sequence
  Description of Artificial Sequence: Synthetic coding sequence
atgaccgagaagaccaacggcgtgaagagcagccccgccaacaaccacaaccaccacgccccccccgccatcaaggccaacggcaaggacgaccacagaaccagcagcagaccccacagcgccgccgacgacgacaccagcagcgagctgcagagactggccgacgtggacgccccccagcagggcagaagcggcttcagaagaatcgtgagactggtgggcatcatcagagagtgggccaacaagaacttcagagaggaggagcccagacccgacagcttcctggagagattcagaggccccgagctgcagaccgtgaccacccaggagggcgacggcaagggcgacaaggacggcgaggacaagggcaccaagaagaagttcgagctgttcgtgctggaccccgccggcgactggtactactgctggctgttcgtgatcgccatgcccgtgctgtacaactggtgcctgctggtggccagagcctgcttcagcgacctgcagaagggctactacctggtgtggctggtgctggactacgtgagcgacgtggtgtacatcgccgacctgttcatcagactgagaaccggcttcctggagcagggcctgctggtgaaggacaccaagaagctgagagacaactacatccacaccctgcagttcaagctggacgtggccagcatcatccccaccgacctgatctacttcgccgtggacatccacagccccgaggtgagattcaacagactgctgcacttcgccagaatgttcgagttcttcgacagaaccgagaccagaaccaactaccccaacatcttcagaatcagcaacctggtgctgtacatcctggtgatcatccactggaacgcctgcatctactacgccatcagcaagagcatcggcttcggcgtggacacctgggtgtaccccaacatcaccgaccccgagtacggctacctggccagagagtacatctactgcctgtactggagcaccctgaccctgaccaccatcggcgagacccccccccccgtgaaggacgaggagtacctgttcgtgatcttcgacttcctgatcggcgtgctgatcttcgccaccatcgtgggcaacgtgggcagcatgatcagcaacatgaacgccaccagagccgagttccaggccaagatcgacgccgtgaagcactacatgcagttcagaaaggtgagcaagggcatggaggccaaggtgatcagatggttcgactacctgtggaccaacaagaagaccgtggacgagagagagatcctgaagaacctgcccgccaagctgagagccgagatcgccatcaacgtgcacctgagcaccctgaagaaggtgagaatcttccacgactgcgaggccggcctgctggtggagctggtgctgaagctgagaccccaggtgttcagccccggcgactacatctgcagaaagggcgacatcggcaaggagatgtacatcatcaaggagggcaagctggccgtggtggccgacgacggcgtgacccagtacgccctgctgagcgccggcagctgcttcggcgagatcagcatcctgaacatcaagggcagcaagatgggcaacagaagaaccgccaacatcagaagcctgggctacagcgacctgttctgcctgagcaaggacgacctgatggaggccgtgaccgagtaccccgacgccaagaaggtgctggaggagagaggcagagagatcctgatgaaggagggcctgctggacgagaacgaggtggccaccagcatggaggtggacgtgcaggagaagctgggccagctggagaccaacatggagaccctgtacaccagattcggcagactgctggccgagtacaccggcgcccagcagaagctgaagcagagaatcaccgtgctggagaccaagatgaagcagaacaacgaggacgactacctgagcgacggcatgaacagccccgagctggccgccgccgacgagccctag

SEQ ID NO: 77990 - DNA, 2085 bp, Artificial Sequence
  Description of Artificial Sequence: Synthetic coding sequence
atggccaagatcaacacccagtacagccaccccagcagaacccacctgaaggtgaagaccagcgacagagacctgaacagagccgagaacggcctgagcagagcccacagcagcagcgaggagaccagcagcgtgctgcagcccggcatcgccatggagaccagaggcctggccgacagcggccagggcagcttcaccggccagggcatcgccagactgagcagactgatcttcctgctgagaagatgggccgccagacacgtgcaccaccaggaccagggccccgacagcttccccgacagattcagaggcgccgagctgaaggaggtgagcagccaggagagcaacgcccaggccaacgtgggcagccaggagcccgccgacagaggcagaagcgcctggcccctggccaagtgcaacaccaacaccagcaacaacaccgaggaggagaagaagaccaagaagaaggacgccatcgtggtggaccccagcagcaacctgtactacagatggctgaccgccatcgccctgcccgtgttctacaactggtacctgctgatctgcagagcctgcttcgacgagctgcagagcgagtacctgatgctgtggctggtgctggactacagcgccgacgtgctgtacgtgctggacgtgctggtgagagccagaaccggcttcctggagcagggcctgatggtgagcgacaccaacagactgtggcagcactacaagaccaccacccagttcaagctggacgtgctgagcctggtgcccaccgacctggcctacctgaaggtgggcaccaactaccccgaggtgagattcaacagactgctgaagttcagcagactgttcgagttcttcgacagaaccgagaccagaaccaactaccccaacatgttcagaatcggcaacctggtgctgtacatcctgatcatcatccactggaacgcctgcatctacttcgccatcagcaagttcatcggcttcggcaccgacagctgggtgtaccccaacatcagcatccccgagcacggcagactgagcagaaagtacatctacagcctgtactggagcaccctgaccctgaccaccatcggcgagacccccccccccgtgaaggacgaggagtacctgttcgtggtggtggacttcctggtgggcgtgctgatcttcgccaccatcgtgggcaacgtgggcagcatgatcagcaacatgaacgccagcagagccgagttccaggccaagatcgacagcatcaagcagtacatgcagttcagaaaggtgaccaaggacctggagaccagagtgatcagatggttcgactacctgtgggccaacaagaagaccgtggacgagaaggaggtgctgaagagcctgcccgacaagctgaaggccgagatcgccatcaacgtgcacctggacaccctgaagaaggtgagaatcttccaggactgcgaggccggcctgctggtggagctggtgctgaagctgagacccaccgtgttcagccccggcgactacatctgcaagaagggcgacatcggcaaggagatgtacatcatcaacgagggcaagctggccgtggtggccgacgacggcgtgacccagttcgtggtgctgagcgacggcagctacttcggcgagatcagcatcctgaacatcaagggcagcaagagcggcaacagaagaaccgccaacatcagaagcatcggctacagcgacctgttctgcctgagcaaggacgacctgatggaggccctgaccgagtaccccgaggccaagaaggccctggaggagaagggcagacagatcctgatgaaggacaacctgatcgacgaggagctggccagagccggcgccgaccccaaggacctggaggagaaggtggagcagctgggcagcagcctggacaccctgcagaccagattcgccagactgctggccgagtacaacgccacccagatgaagatgaagcagagactgagccagctggagagccaggtgaagggcggcggcgacaagcccctggccgacggcgaggtgcccggcgacgccaccaagaccgaggacaagcagcagtag

SEQ ID NO: 77991 - DNA, 2085 bp, Artificial Sequence; identical to SEQ ID NO: 77990
  Description of Artificial Sequence: Synthetic coding sequence

SEQ ID NO: 77992 - DNA, 2031 bp, Artificial Sequence
  Description of Artificial Sequence: Synthetic coding sequence
atggccaagatcaacacccagtacagccaccccagcagaacccacctgaaggtgaagaccagcgacagagacctgaacagagccgagaacggcctgagcagagcccacagcagcagcgaggagaccagcagcgtgctgcagcccggcatcgccatggagaccagaggcctggccgacagcggccagggcagcttcaccggccagggcatcgccagactgagcagactgatcttcctgctgagaagatgggccgccagacacgtgcaccaccaggaccagggccccgacagcttccccgacagattcagaggcgccgagctgaaggaggtgagcagccaggagagcaacgcccaggccaacgtgggcagccaggagcccgccgacagaggcagaagaaagaagaccaagaagaaggacgccatcgtggtggaccccagcagcaacctgtactacagatggctgaccgccatcgccctgcccgtgttctacaactggtacctgctgatctgcagagcctgcttcgacgagctgcagagcgagtacctgatgctgtggctggtgctggactacagcgccgacgtgctgtacgtgctggacgtgctggtgagagccagaaccggcttcctggagcagggcctgatggtgagcgacaccaacagactgtggcagcactacaagaccaccacccagttcaagctggacgtgctgagcctggtgcccaccgacctggcctacctgaaggtgggcaccaactaccccgaggtgagattcaacagactgctgaagttcagcagactgttcgagttcttcgacagaaccgagaccagaaccaactaccccaacatgttcagaatcggcaacctggtgctgtacatcctgatcatcatccactggaacgcctgcatctacttcgccatcagcaagttcatcggcttcggcaccgacagctgggtgtaccccaacatcagcatccccgagcacggcagactgagcagaaagtacatctacagcctgtactggagcaccctgaccctgaccaccatcggcgagacccccccccccgtgaaggacgaggagtacctgttcgtggtggtggacttcctggtgggcgtgctgatcttcgccaccatcgtgggcaacgtgggcagcatgatcagcaacatgaacgccagcagagccgagttccaggccaagatcgacagcatcaagcagtacatgcagttcagaaaggtgaccaaggacctggagaccagagtgatcagatggttcgactacctgtgggccaacaagaagaccgtggacgagaaggaggtgctgaagagcctgcccgacaagctgaaggccgagatcgccatcaacgtgcacctggacaccctgaagaaggtgagaatcttccaggactgcgaggccggcctgctggtggagctggtgctgaagctgagacccaccgtgttcagccccggcgactacatctgcaagaagggcgacatcggcaaggagatgtacatcatcaacgagggcaagctggccgtggtggccgacgacggcgtgacccagttcgtggtgctgagcgacggcagctacttcggcgagatcagcatcctgaacatcaagggcagcaagagcggcaacagaagaaccgccaacatcagaagcatcggctacagcgacctgttctgcctgagcaaggacgacctgatggaggccctgaccgagtaccccgaggccaagaaggccctggaggagaagggcagacagatcctgatgaaggacaacctgatcgacgaggagctggccagagccggcgccgaccccaaggacctggaggagaaggtggagcagctgggcagcagcctggacaccctgcagaccagattcgccagactgctggccgagtacaacgccacccagatgaagatgaagcagagactgagccagctggagagccaggtgaagggcggcggcgacaagcccctggccgacggcgaggtgcccggcgacgccaccaagaccgaggacaagcagcagtag

SEQ ID NO: 77993 - DNA, 3756 bp, Artificial Sequence
  Description of Artificial Sequence: Synthetic coding sequence
atgctgggctgggtgcagagagtgctgccccagccccccggcacccccagaaagaccaagatgcaggaggaggaggaggtggagcccgagcccgagatggaggccgaggtggagcccgagcccaaccccgaggaggccgagaccgagagcgagagcatgccccccgaggagagcttcaaggaggaggaggtggccgtggccgaccccagcccccaggagaccaaggaggccgccctgaccagcaccatcagcctgagagcccagggcgccgagatcagcgagatgaacagccccagcagaagagtgctgacctggctgatgaagggcgtggagaaggtgatcccccagcccgtgcacagcatcaccgaggaccccgcccagatcctgggccacggcagcaccggcgacaccggctgcaccgacgagcccaacgaggccctggaggcccaggacaccagacccggcctgagactgctgctgtggctggagcagaacctggagagagtgctgccccagccccccaagagcagcgaggtgtggagagacgagcccgccgtggccaccggcgccgccagcgaccccgccccccccggcagaccccaggagatgggccccaagctgcaggccagagagacccccagcctgcccacccccatccccctgcagcccaaggaggagcccaaggaggcccccgcccccgagccccagcccggcagccaggcccagaccagcagcctgccccccaccagagaccccgccagactggtggcctgggtgctgcacagactggagatggccctgccccagcccgtgctgcacggcaagatcggcgagcaggagcccgacagccccggcatctgcgacgtgcagaccatcagcatcctgcccggcggccaggtggagcccgacctggtgctggaggaggtggagcccccctgggaggacgcccaccaggacgtgagcaccagcccccagggcaccgaggtggtgcccgcctacgaggaggagaacaaggccgtggagaagatgcccagagagctgagcagaatcgaggaggagaaggaggacgaggaggaggaggaggaggaggaggaggaggaggaggaggaggaggtgaccgaggtgctgctggacagctgcgtggtgagccaggtgggcgtgggccagagcgaggaggacggcaccagaccccagagcaccagcgaccagaagctgtgggaggaggtgggcgaggaggccaagaaggaggccgaggagaaggccaaggaggaggccgaggaggtggccgaggaggaggccgagaaggagccccaggactgggccgagaccaaggaggagcccgaggccgaggccgaggccgccagcagcggcgtgcccgccaccaagcagcaccccgaggtgcaggtggaggacaccgacgccgacagctgccccctgatggccgaggagaacccccccagcaccgtgctgcccccccccagccccgccaagagcgacaccctgatcgtgcccagcagcgccagcggcacccacagaaagaagctgcccagcgaggacgacgaggccgaggagctgaaggccctgagccccgccgagagccccgtggtggcctggagcgaccccaccacccccaaggacaccgacggccaggacagagccgccagcaccgccagcaccaacagcgccatcatcaacgacagactgcaggagctggtgaagctgttcaaggagagaaccgagaaggtgaaggagaagctgatcgaccccgacgtgaccagcgacgaggagagccccaagcccagccccgccaagaaggcccccgagcccgcccccgacaccaagcccgccgaggccgagcccgtggaggaggagcactactgcgacatgctgtgctgcaagttcaagcacagaccctggaagaagtaccagttcccccagagcatcgaccccctgaccaacctgatgtacgtgctgtggctgttcttcgtggtgatggcctggaactggaactgctggctgatccccgtgagatgggccttcccctaccagacccccgacaacatccaccactggctgctgatggactacctgtgcgacctgatctacttcctggacatcaccgtgttccagaccagactgcagttcgtgagaggcggcgacatcatcaccgacaagaaggacatgagaaacaactacctgaagagcagaagattcaagatggacctgctgagcctgctgcccctggacttcctgtacctgaaggtgggcgtgaaccccctgctgagactgcccagatgcctgaagtacatggccttcttcgagttcaacagcagactggagagcatcctgagcaaggcctacgtgtacagagtgatcagaaccaccgcctacctgctgtacagcctgcacctgaacagctgcctgtactactgggccagcgcctaccagggcctgggcagcacccactgggtgtacgacggcgtgggcaacagctacatcagatgctactacttcgccgtgaagaccctgatcaccatcggcggcctgcccgaccccaagaccctgttcgagatcgtgttccagctgctgaactacttcaccggcgtgttcgccttcagcgtgatgatcggccagatgagagacgtggtgggcgccgccaccgccggccagacctactacagaagctgcatggacagcaccgtgaagtacatgaacttctacaagatccccaagagcgtgcagaacagagtgaagacctggtacgagtacacctggcacagccagggcatgctggacgagagcgagctgatggtgcagctgcccgacaagatgagactggacctggccatcgacgtgaactacaacatcgtgagcaaggtggccctgttccagggctgcgacagacagatgatcttcgacatgctgaagagactgagaagcgtggtgtacctgcccaacgactacgtgtgcaagaagggcgagatcggcagagagatgtacatcatccaggccggccaggtgcaggtgctgggcggccccgacggcaagagcgtgctggtgaccctgaaggccggcagcgtgttcggcgagatcagcctgctggccgtgggcggcggcaacagaagaaccgccaacgtggtggcccacggcttcaccaacctgttcatcctggacaagaaggacctgaacgagatcctggtgcactaccccgagagccagaagctgctgagaaagaaggccagaagaatgctgagaagcaacaacaagcccaaggaggagaagagcgtgctgatcctgccccccagagccggcacccccaagctgttcaacgccgccctggccatgaccggcaagatgggcggcaagggcgccaagggcggcaagctggcccacctgagagccagactgaaggagctggccgccctggaggccgccgccaagcagcaggagctggtggagcaggccaagagcagccaggacgtgaagggcgaggagggcagcgccgcccccgaccagcacacccaccccaaggaggccgccaccgacccccccgcccccagaaccccccccgagccccccggcagcccccccagcagccccccccccgccagcctgggcagacccgagggcgaggaggagggccccgccgagcccgaggagcacagcgtgagaatctgcatgagccccggccccgagcccggcgagcagatcctgagcgtgaagatgcccgaggagagagaggagaaggccgagtag

SEQ ID NO: 77994 - DNA, 900 bp, Artificial Sequence
  Description of Artificial Sequence: Synthetic coding sequence
atgctgggctgggtgcagagagtgctgccccagccccccggcacccccagaaagaccaagatgcaggaggaggaggaggtggagcccgagcccgagatggaggccgaggtggagcccgagcccaaccccgaggaggccgagaccgagagcgagagcatgccccccgaggagagcttcaaggaggaggaggtggccgtggccgaccccagcccccaggagaccaaggaggccgccctgaccagcaccatcagcctgagagcccagggcgccgagatcagcgagatgaacagccccagcagaagagtgctgacctggctgatgaagggcgtggagaaggtgatcccccagcccgtgcacagcatcaccgaggaccccgcccagatcctgggccacggcagcaccggcgacaccggctgcaccgacgagcccaacgaggccctggaggcccaggacaccagacccggcctgagactgctgctgtggctggagcagaacctggagagagtgctgccccagccccccaagagcagcgaggtgtggagagacgagcccgccgtggccaccggcgccgccagcgaccccgccccccccggcagaccccaggagatgggccccaagctgcaggccagagagacccccagcctgcccacccccatccccctgcagcccaaggaggagcccaaggaggcccccgcccccgagccccagcccggcagccaggcccagaccagcagcctgccccccaccagagaccccgccagactggtggcctgggtgctgcacagactggagatggccctgccccagcccgtgctgcacggcaagatcggcgagcaggagcccgacagccccggcatctgcgacgtgcagaccagagtgatgggcgccggcggcctgtag

SEQ ID NO: 77995 - DNA, 2430 bp, Artificial Sequence
  Description of Artificial Sequence: Synthetic coding sequence
atgttcaagagcctgaccaaggtgaacaaggtgaagcccatcggcgagaacaacgagaacgagcagagcagcagaagaaacgaggagggcagccaccccagcaaccagagccagcagaccaccgcccaggaggagaacaagggcgaggagaagagcctgaagaccaagagcacccccgtgaccagcgaggagccccacaccaacatccaggacaagctgagcaagaagaacagcagcggcgacctgaccaccaaccccgacccccagaacgccgccgagcccaccggcaccgtgcccgagcagaaggagatggaccccggcaaggagggccccaacagcccccagaacaagccccccgccgcccccgtgatcaacgagtacgccgacgcccagctgcacaacctggtgaagagaatgagacagagaaccgccctgtacaagaagaagctggtggagggcgacctgagcagccccgaggccagcccccagaccgccaagcccaccgccgtgccccccgtgaaggagagcgacgacaagcccaccgagcactactacagactgctgtggttcaaggtgaagaagatgcccctgaccgagtacctgaagagaatcaagctgcccaacagcatcgacagctacaccgacagactgtacctgctgtggctgctgctggtgaccctggcctacaactggaactgctgcttcatccccctgagactggtgttcccctaccagaccgccgacaacatccactactggctgatcgccgacatcatctgcgacatcatctacctgtacgacatgctgttcatccagcccagactgcagttcgtgagaggcggcgacatcatcgtggacagcaacgagctgagaaagcactacagaaccagcaccaagttccagctggacgtggccagcatcatccccttcgacatctgctacctgttcttcggcttcaaccccatgttcagagccaacagaatgctgaagtacaccagcttcttcgagttcaaccaccacctggagagcatcatggacaaggcctacatctacagagtgatcagaaccaccggctacctgctgttcatcctgcacatcaacgcctgcgtgtactactgggccagcaactacgagggcatcggcaccaccagatgggtgtacgacggcgagggcaacgagtacctgagatgctactactgggccgtgagaaccctgatcaccatcggcggcctgcccgagccccagaccctgttcgagatcgtgttccagctgctgaacttcttcagcggcgtgttcgtgttcagcagcctgatcggccagatgagagacgtgatcggcgccgccaccgccaaccagaactacttcagagcctgcatggacgacaccatcgcctacatgaacaactacagcatccccaagctggtgcagaagagagtgagaacctggtacgagtacacctgggacagccagagaatgctggacgagagcgacctgctgaagaccctgcccaccaccgtgcagctggccctggccatcgacgtgaacttcagcatcatcagcaaggtggacctgttcaagggctgcgacacccagatgatctacgacatgctgctgagactgaagagcgtgctgtacctgcccggcgacttcgtgtgcaagaagggcgagatcggcaaggagatgtacatcatcaagcacggcgaggtgcaggtgctgggcggccccgacggcaccaaggtgctggtgaccctgaaggccggcagcgtgttcggcgagatcagcctgctggccgccggcggcggcaacagaagaaccgccaacgtggtggcccacggcttcgccaacctgctgaccctggacaagaagaccctgcaggagatcctggtgcactaccccgacagcgagagaatcctgatgaagaaggccagagtgctgctgaagcagaaggccaagaccgccgaggccaccccccccagaaaggacctggccctgctgttcccccccaaggaggagacccccaagctgttcaagaccctgctgggcggcaccggcaaggccagcctggccagactgctgaagctgaagagagagcaggccgcccagaagaaggagaacagcgagggcggcgaggaggagggcaaggagaacgaggacaagcagaaggagaacgaggacaagcagaaggagaacgaggacaagggcaaggagaacgaggacaaggacaagggcagagagcccgaggagaagcccctggacagacccgagtgcaccgccagccccatcgccgtggaggaggagccccacagcgtgagaagaaccgtgctgcccagaggcaccagcagacagagcctgatcatcagcatggcccccagcgccgagggcggcgaggaggtgctgaccatcgaggtgaaggagaaggccaagcagtag

SEQ ID NO: 77996 - DNA, 4188 bp, Artificial Sequence
  Description of Artificial Sequence: Synthetic coding sequence
atgctgctgcccctgcccccccagagcagcaagcccgtgcccaagaagagccagagcagcaagatcgtgcccagccaccacgaccccagcgagaagaccggcgagaactgccagaccaagatcagccccagcagcctgcaggagagccccagcagcctgcagggcgccctgaagaagagaagcgccttcgaggacctgaccaacgccagccagtgccagcccgtgcagcccaagaaggaggccaacaaggagttcgtgaaggtggtgagcaagaagatcaacagaaacacccacgccctgggcctggccaagaagaacaagagaaacctgaagtggcacaagctggaggtgacccccgtggtggccagcaccaccgtggtgcccaacatcatggagaagcccctgatcctggacatcagcaccaccagcaagacccccaacaccgaggaggccagcctgttcagaaagcccctggtgctgaaggaggagcccaccatcgaggacgagaccctgatcaacaagagcctgagcctgaagaagtgcagcaaccacgaggaggtgagcctgctggagaagctgcagcccctgcaggaggagagcgacagcgacgacgccttcgtgatcgagcccatgaccttcaagaagacccacaagaccgaggaggccgccatcaccaagaagaccctgagcctgaagaagaagatgtgcgccagccagagaaagcagagctgccaggaggagagcctggccgtgcaggacgtgaacatggaggaggacagcttcttcatggagagcatgagcttcaagaagaagcccaagaccgaggagagcatccccacccacaagctgagcagcctgaagaagaagtgcaccatctacggcaagatctgccacttcagaaagccccccgtgctgcagaccaccatctgcggcgccatgagcagcatcaagaagcccaccaccgagaaggagaccctgttccaggagctgagcgtgctgcaggagaagcacaccaccgagcacgagatgagcatcctgaagaagagcctggccctgcagaagaccaacttcaaggaggacagcctggtgaaggagagcctggccttcaagaagaagcccagcaccgaggaggccatcatgatgcccgtgatcctgaaggagcagtgcatgaccgagggcaagagaagcagactgaagcccctggtgctgcaggagatcaccagcggcgagaagagcctgatcatgaagcccctgagcatcaaggagaagcccagcaccgagaaggagagcttcagccaggagcccagcgccctgcagaagaagcacaccacccaggaggaggtgagcatcctgaaggagcccagcagcctgctgaagagccccaccgaggagagccccttcgacgaggccctggccttcaccaagaagtgcaccatcgaggaggccccccccaccaagaagcccctgatcctgaagagaaagcacgccacccagggcaccatgagccacctgaagaagcccctgatcctgcagaccaccagcggcgagaagagcctgatcaaggagcccctgcccttcaaggaggagaaggtgagcctgaagaagaagtgcaccacccaggagatgatgagcatctgccccgagctgctggacttccaggacatgatcggcgaggacaagaacagcttcttcatggagcccatgagcttcagaaagaaccccaccaccgaggagaccgtgctgaccaagaccagcctgagcctgcaggagaagaagatcacccagggcaagatgagccacctgaagaagcccctggtgctgcagaagatcaccagcgaggaggagagcttctacaagaagctgctgcccttcaagatgaagagcaccaccgaggagaagttcctgagccaggagcccagcgccctgaaggagaagcacaccaccctgcaggaggtgagcctgagcaaggagagcctggccatccaggagaaggccaccaccgaggaggagttcagccaggagctgttcagcctgcacgtgaagcacaccaacaagagcggcagcctgttccaggaggccctggtgctgcaggagaagaccgacgccgaggaggacagcctgaagaacctgctggccctgcaggagaagagcaccatggaggaggagagcctgatcaacaagctgctggccctgaaggaggagctgagcgccgaggccgccaccaacatccagacccagctgagcctgaagaagaagagcaccagccacggcaaggtgttcttcctgaagaagcagctggccctgaacgagaccatcaacgaggaggagttcctgaacaagcagcccctggccctggagggctaccccagcatcgccgagggcgagaccctgttcaagaagctgctggccatgcaggaggagcccagcatcgagaaggaggccgtgctgaaggagcccaccatcgacaccgaggcccacttcaaggagcccctggccctgcaggaggagcccagcaccgagaaggaggccgtgctgaaggagcccagcgtggacaccgaggcccacttcaaggagaccctggccctgcaggagaagcccagcatcgagcaggaggccctgttcaagagacacagcgccctgtgggagaagcccagcaccgagaaggagaccatcttcaaggagagcctggacctgcaggagaagcccagcatcaagaaggagaccctgctgaagaagcccctggccctgaagatgagcaccatcaacgaggccgtgctgttcgaggacatgatcgccctgaacgagaagcccaccaccggcaaggagctgagcttcaaggagcccctggccctgcaggagagccccacctacaaggaggacaccttcctgaagaccctgctggtgccccaggtgggcaccagccccaacgtgagcagcaccgcccccgagagcatcaccagcaagagcagcatcgccaccatgaccagcgtgggcaagagcggcaccatcaacgaggccttcctgttcgaggacatgatcaccctgaacgagaagcccaccaccggcaaggagctgagcttcaaggagcccctggccctgcaggagagccccacctgcaaggaggacaccttcctggagaccttcctgatcccccagatcggcaccagcccctacgtgttcagcaccacccccgagagcatcaccgagaagagcagcatcgccaccatgaccagcgtgggcaagagcagaaccaccaccgagagcagcgcctgcgagagcgccagcgacaagcccgtgagcccccaggccaagggcacccccaaggagatcacccccagagaggacatcgacgaggacagcagcgaccccagcttcaaccccatgtacgccaaggagatcttcagctacatgaaggagagagaggagcagttcatcctgaccgactacatgaacagacagatcgagatcaccagcgacatgagagccatcctggtggactggctggtggaggtgcaggtgagcttcgagatgacccacgagaccctgtacctggccgtgaagctggtggacctgtacctgatgaaggccgtgtgcaagaaggacaagctgcagctgctgggcgccaccgccttcatgatcgccgccaagttcgaggagcacaacagccccagagtggacgacttcgtgtacatctgcgacgacaactaccagagaagcgaggtgctgagcatggagatcaacatcctgaacgtgctgaagtgcgacatcaacatccccatcgcctaccacttcctgagaagatacgccagatgcatccacaccaacatgaagaccctgaccctgagcagatacatctgcgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgagacagctgaacaagctgctgaccttcagcagctacgacagcctgaaggccgtgtactacaagtacagccaccccgtgttcttcgaggtggccaagatccccgccctggacatgctgaagctggaggagatcctgaactgcgactgcgaggcccagggcctggtgctgtag

SEQ ID NO: 77997 - DNA, 876 bp, Artificial Sequence
  Description of Artificial Sequence: Synthetic coding sequence
atgctgctgcccctgcccccccagagcagcaagcccgtgcccaagaagagccagagcagcaagatcgtgcccagccaccacgaccccagcgagaagaccggcgagaactgccagaccaagatcagccccagcagcctgcaggagagccccagcagcctgcagggcgccctgaagaagagaagcgccttcgaggacctgaccaacgtgagcttcgagatgacccacgagaccctgtacctggccgtgaagctggtggacctgtacctgatgaaggccgtgtgcaagaaggacaagctgcagctgctgggcgccaccgccttcatgatcgccgccaagttcgaggagcacaacagccccagagtggacgacttcgtgtacatctgcgacgacaactaccagagaagcgaggtgctgagcatggagatcaacatcctgaacgtgctgaagtgcgacatcaacatccccatcgcctaccacttcctgagaagatacgccagatgcatccacaccaacatgaagaccctgaccctgagcagatacatctgcgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgagacagctgaacaagctgctgaccttcagcagctacgacagcctgaaggccgtgtactacaagtacagccaccccgtgttcttcgaggtggccaagatccccgccctggacatgctgaagctggaggagatcctgaactgcgactgcgaggcccagggcctggtgctgtag

SEQ ID NO: 77998 - DNA, 876 bp, Artificial Sequence; identical to SEQ ID NO: 77997
  Description of Artificial Sequence: Synthetic coding sequence

SEQ ID NO: 77999 - DNA, 4188 bp, Artificial Sequence; identical to SEQ ID NO: 77996
  Description of Artificial Sequence: Synthetic coding sequence

SEQ ID NO: 78000 - DNA, 336 bp, Artificial Sequence
  Description of Artificial Sequence: Synthetic coding sequence
atgctgctgcccctgcccccccagagcagcaagcccgtgcccaagaagagccagagcagcaagatcgtgcccagccaccacgaccccagcgagaagaccggcgagaactgccagaccaagatcagccccagcagcctgcaggagagccccagcagcctgcagggcgccctgaagaagagaagcgccttcgaggacctgaccaacgccagccagtgccagcccgtgcagcccaagaaggaggccaacaaggagttcgtgaaggtggtgagcaagaagatcaacagaaacacccacgccctgggcctggccaagaagaacaagagaaacctgaagtag

SEQ ID NO: 78001 - DNA, 1083 bp, Artificial Sequence
  Description of Artificial Sequence: Synthetic coding sequence
atggccagcgccaccgcccccgccgccgccgtgcccaccctggccagccccctggagcagctgagacacctggccgaggagctgagactgctgctgcccagagtgagagtgggcgaggcccaggagaccaccgaggagttcaacagagagatgttctggagaagactgaacgaggccgccgtgaccgtgagcagagaggccaccaccctgaccatcgtgttcagccagctgcccctgcccagcccccaggagacccagaagttctgcgagcaggtgcacgccgccatcaaggccttcatcgccgtgtactacctgctgcccaaggaccagggcatcaccctgagaaagctggtgagaggcgccaccctggacatcgtggacggcatggcccagctgatggaggtgctgagcgtgacccccacccagagccccgagaacaacgacctgatcagctacaacagcgtgtgggtggcctgccagcagatgccccagatccccagagacaacaaggccgccgccctgctgatgctgaccaagaacgtggacttcgtgaaggacgcccacgaggagatggagcaggccgtggaggagtgcgacccctacagcggcctgctgaacgacaccgaggagaacaacagcgacaaccacaaccacgaggacgacgtgctgggcttccccagcaaccaggacctgtactggagcgaggacgaccaggagctgatcatcccctgcctggccctggtgagagccagcaaggcctgcctgaagaagatcagaatgctggtggccgagaacggcaagaaggaccaggtggcccagctggacgacatcgtggacatcagcgacgagatcagccccagcgtggacgacctggccctgagcatctacccccccatgtgccacctgaccgtgagaatcaacagcgccaagctggtgagcgtgctgaagaaggccctggagatcaccaaggccagccacgtgaccccccagcccgaggacagctggatccccctgctgatcaacgccatcgaccactgcatgaacagaatcaaggagctgacccagagcgagctggagctgtag

SEQ ID NO: 78002 - DNA, 600 bp, Artificial Sequence
  Description of Artificial Sequence: Synthetic coding sequence
atgccccagatccccagagacaacaaggccgccgccctgctgatgctgaccaagaacgtggacttcgtgaaggacgcccacgaggagatggagcaggccgtggaggagtgcgacccctacagcggcctgctgaacgacaccgaggagaacaacagcgacaaccacaaccacgaggacgacgtgctgggcttccccagcaaccaggacctgtactggagcgaggacgaccaggagctgatcatcccctgcctggccctggtgagagccagcaaggcctgcctgaagaagatcagaatgctggtggccgagaacggcaagaaggaccaggtggcccagctggacgacatcgtggacatcagcgacgagatcagccccagcgtggacgacctggccctgagcatctacccccccatgtgccacctgaccgtgagaatcaacagcgccaagctggtgagcgtgctgaagaaggccctggagatcaccaaggccagccacgtgaccccccagcccgaggacagctggatccccctgctgatcaacgccatcgaccactgcatgaacagaatcaaggagctgacccagagcgagctggagctgtag

SEQ ID NO: 78003 - DNA, 699 bp, Artificial Sequence
  Description of Artificial Sequence: Synthetic coding sequence
atggcccagctgatggaggtgctgagcgtgacccccacccagagccccgagaacaacgacctgatcagctacaacagcgtgtgggtggcctgccagcagatgccccagatccccagagacaacaaggccgccgccctgctgatgctgaccaagaacgtggacttcgtgaaggacgcccacgaggagatggagcaggccgtggaggagtgcgacccctacagcggcctgctgaacgacaccgaggagaacaacagcgacaaccacaaccacgaggacgacgtgctgggcttccccagcaaccaggacctgtactggagcgaggacgaccaggagctgatcatcccctgcctggccctggtgagagccagcaaggcctgcctgaagaagatcagaatgctggtggccgagaacggcaagaaggaccaggtggcccagctggacgacatcgtggacatcagcgacgagatcagccccagcgtggacgacctggccctgagcatctacccccccatgtgccacctgaccgtgagaatcaacagcgccaagctggtgagcgtgctgaagaaggccctggagatcaccaaggccagccacgtgaccccccagcccgaggacagctggatccccctgctgatcaacgccatcgaccactgcatgaacagaatcaaggagctgacccagagcgagctggagctgtag

SEQ ID NO: 78004 - DNA, 3936 bp, Artificial Sequence
  Description of Artificial Sequence: Synthetic coding sequence
atgagcctgctgcagagcgccctggacttcctggccggccccggcagcctgggcggcgccagcggcagagaccagagcgacttcgtgggccagaccgtggagctgggcgagctgagactgagagtgagaagagtgctggccgagggcggcttcgccttcgtgtacgaggcccaggacgtgggcagcggcagagagtacgccctgaagagactgctgagcaacgaggaggagaagaacagagccatcatccaggaggtgtgcttcatgaagaagctgagcggccaccccaacatcgtgcagttctgcagcgccgccagcatcggcaaggaggagagcgacaccggccaggccgagttcctgctgctgaccgagctgtgcaagggccagctggtggagttcctgaagaagatggagagcagaggccccctgagctgcgacaccgtgctgaagatcttctaccagacctgcagagccgtgcagcacatgcacagacagaagccccccatcatccacagagacctgaaggtggagaacctgctgctgagcaaccagggcaccatcaagctgtgcgacttcggcagcgccaccaccatcagccactaccccgactacagctggagcgcccagagaagagccctggtggaggaggagatcaccagaaacaccacccccatgtacagaacccccgagatcatcgacctgtacagcaacttccccatcggcgagaagcaggacatctgggccctgggctgcatcctgtacctgctgtgcttcagacagcaccccttcgaggacggcgccaagctgagaatcgtgaacggcaagtacagcatccccccccacgacacccagtacaccgtgttccacagcctgatcagagccatgctgcaggtgaaccccgaggagagactgagcatcgccgaggtggtgcaccagctgcaggagatcgccgccgccagaaacgtgaaccccaagagccccatcaccgagctgctggagcagaacggcggctacggcagcgccaccctgagcagaggcccccccccccccgtgggccccgccggcagcggctacagcggcggcctggccctggccgagtacgaccagccctacggcggcttcctggacatcctgagaggcggcaccgagagactgttcaccaacctgaaggacaccagcagcaaggtgatccagagcgtggccaactacgccaagggcgacctggacatcagctacatcaccagcagaatcgccgtgatgagcttccccgccgagggcgtggagagcgccctgaagaacaacatcgaggacgtgagactgttcctggacagcaagcaccccggccactacgccgtgtacaacctgagccccagaacctacagacccagcagattccacaacagagtgagcgagtgcggctgggccgccagaagagccccccacctgcacaccctgtacaacatctgcagaaacatgcacgcctggctgagacaggaccacaagaacgtgtgcgtggtgcactgcatggacggcagagccgccagcgccgtggccgtgtgcagcttcctgtgcttctgcagactgttcagcaccgccgaggccgccgtgtacatgttcagcatgaagagatgcccccccggcatctggcccagccacaagagatacatcgagtacatgtgcgacatggtggccgaggagcccatcaccccccacagcaagcccatcctggtgagagccgtggtgatgacccccgtgcccctgttcagcaagcagagaagcggctgcagacccttctgcgaggtgtacgtgggcgacgagagagtggccagcaccagccaggagtacgacaagatgagagacttcaagatcgaggacggcaaggccgtgatccccctgggcgtgaccgtgcagggcgacgtgctgatcgtgatctaccacgccagaagcaccctgggcggcagactgcaggccaagatggccagcatgaagatgttccagatccagttccacaccggcttcgtgcccagaaacgccaccaccgtgaagttcgccaagtacgacctggacgcctgcgacatccaggagaagtaccccgacctgttccaggtgaacctggaggtggaggtggagcccagagacagacccagcagagaggcccccccctgggagaacagcagcatgagaggcctgaaccccaagatcctgttcagcagcagagaggagcagcaggacatcctgagcaagttcggcaagcccgagctgcccagacagcccggcagcaccgcccagtacgacgccggcgccggcagccccgaggccgagcccaccgacagcgacagcccccccagcagcagcgccgacgccagcagattcctgcacaccctggactggcaggaggagaaggaggccgagaccggcgccgagaacgccagcagcaaggagagcgagagcgccctgatggaggacagagacgagagcgaggtgagcgacgagggcggcagccccatcagcagcgagggccaggagcccagagccgaccccgagccccccggcctggccgccggcctggtgcagcaggacctggtgttcgaggtggagacccccgccgtgctgcccgagcccgtgccccaggaggacggcgtggacctgctgggcctgcacagcgaggtgggcgccggccccgccgtgcccccccaggcctgcaaggcccccagcagcaacaccgacctgctgagctgcctgctgggcccccccgaggccgccagccagggcccccccgaggacctgctgagcgaggaccccctgctgctggccagccccgccccccccctgagcgtgcagagcacccccagaggcggcccccccgccgccgccgaccccttcggccccctgctgcccagcagcggcaacaacagccagccctgcagcaaccccgacctgttcggcgagttcctgaacagcgacagcgtgaccgtgccccccagcttccccagcgcccacagcgcccccccccccagctgcagcgccgacttcctgcacctgggcgacctgcccggcgagcccagcaagatgaccgccagcagcagcaaccccgacctgctgggcggctgggccgcctggaccgagaccgccgccagcgccgtggcccccacccccgccaccgagggccccctgttcagccccggcggccagcccgccccctgcggcagccaggccagctggaccaagagccagaaccccgaccccttcgccgacctgggcgacctgagcagcggcctgcagggcagccccgccggcttcccccccggcggcttcatccccaagaccgccaccacccccaagggcagcagcagctggcagaccagcagaccccccgcccagggcgccagctggcccccccaggccaagcccccccccaaggcctgcacccagcccagacccaactacgccagcaacttcagcgtgatcggcgccagagaggagagaggcgtgagagcccccagcttcgcccagaagcccaaggtgagcgagaacgacttcgaggacctgctgagcaaccagggcttcagcagcagaagcgacaagaagggccccaagaccatcgccgagatgagaaagcaggacctggccaaggacaccgaccccctgaagctgaagctgctggactggatcgagggcaaggagagaaacatcagagccctgctgagcaccctgcacaccgtgctgtgggacggcgagagcagatggacccccgtgggcatggccgacctggtggcccccgagcaggtgaagaagcactacagaagagccgtgctggccgtgcaccccgacaaggccgccggccagccctacgagcagcacgccaagatgatcttcatggagctgaacgacgcctggagcgagttcgagaaccagggcagcagacccctgttctag

SEQ ID NO: 78005 - DNA, 1764 bp, Artificial Sequence
  Description of Artificial Sequence: Synthetic coding sequence
atgagcctgctgcagagcgccctggacttcctggccggccccggcagcctgggcggcgccagcggcagagaccagagcgacttcgtgggccagaccgtggagctgggcgagctgagactgagagtgagaagagtgctggccgagggcggcttcgccttcgtgtacgaggcccaggacgtgggcagcggcagagagtacgccctgaagagactgctgagcaacgaggaggagaagaacagagccatcatccaggaggtgtgcttcatgaagaagctgagcggccaccccaacatcgtgcagttctgcagcgccgccagcatcggcaaggaggagagcgacaccggccaggccgagttcctgctgctgaccgagccccccggcctggccgccggcctggtgcagcaggacctggtgttcgaggtggagacccccgccgtgctgcccgagcccgtgccccaggaggacggcgtggacctgctgggcctgcacagcgaggtgggcgccggccccgccgtgcccccccaggcctgcaaggcccccagcagcaacaccgacctgctgagctgcctgctgggcccccccgaggccgccagccagggcccccccgaggacctgctgagcgaggaccccctgctgctggccagccccgccccccccctgagcgtgcagagcacccccagaggcggcccccccgccgccgccgaccccttcggccccctgctgcccagcagcggcaacaacagccagccctgcagcaaccccgacctgttcggcgagttcctgaacagcgacagcgtgaccgtgccccccagcttccccagcgcccacagcgcccccccccccagctgcagcgccgacttcctgcacctgggcgacctgcccggcgagcccagcaagatgaccgccagcagcagcaaccccgacctgctgggcggctgggccgcctggaccgagaccgccgccagcgccgtggcccccacccccgccaccgagggccccctgttcagccccggcggccagcccgccccctgcggcagccaggccagctggaccaagagccagaaccccgaccccttcgccgacctgggcgacctgagcagcggcctgcagggcagccccgccggcttcccccccggcggcttcatccccaagaccgccaccacccccaagggcagcagcagctggcagaccagcagaccccccgcccagggcgccagctggcccccccaggccaagcccccccccaaggcctgcacccagcccagacccaactacgccagcaacttcagcgtgatcggcgccagagaggagagaggcgtgagagcccccagcttcgcccagaagcccaaggtgagcgagaacgacttcgaggacctgctgagcaaccagggcttcagcagcagaagcgacaagaagggccccaagaccatcgccgagatgagaaagcaggacctggccaaggacaccgaccccctgaagctgaagctgctggactggatcgagggcaaggagagaaacatcagagccctgctgagcaccctgcacaccgtgctgtgggacggcgagagcagatggacccccgtgggcatggccgacctggtggcccccgagcaggtgaagaagcactacagaagagccgtgctggccgtgcaccccgacaaggccgccggccagccctacgagcagcacgccaagatgatcttcatggagctgaacgacgcctggagcgagttcgagaaccagggcagcagacccctgttctag

SEQ ID NO: 78006 - DNA, 2238 bp, Artificial Sequence
  Description of Artificial Sequence: Synthetic coding sequence
atgcccttccccgtgaccacccagggcagccagcagacccagcccccccagaagcactacggcatcaccagccccatcagcctggccgcccccaaggagaccgactgcgtgctgacccagaagctgatcgagaccctgaagcccttcggcgtgttcgaggaggaggaggagctgcagagaagaatcctgatcctgggcaagctgaacaacctggtgaaggagtggatcagagagatcagcgagagcaagaacctgccccagagcgtgatcgagaacgtgggcggcaagatcttcaccttcggcagctacagactgggcgtgcacaccaagggcgccgacatcgacgccctgtgcgtggcccccagacacgtggacagaagcgacttcttcaccagcttctacgacaagctgaagctgcaggaggaggtgaaggacctgagagccgtggaggaggccttcgtgcccgtgatcaagctgtgcttcgacggcatcgagatcgacatcctgttcgccagactggccctgcagaccatccccgaggacctggacctgagagacgacagcctgctgaagaacctggacatcagatgcatcagaagcctgaacggctgcagagtgaccgacgagatcctgcacctggtgcccaacatcgacaacttcagactgaccctgagagccatcaagctgtgggccaagagacacaacatctacagcaacatcctgggcttcctgggcggcgtgagctgggccatgctggtggccagaacctgccagctgtaccccaacgccatcgccagcaccctggtgcacaagttcttcctggtgttcagcaagtgggagtggcccaaccccgtgctgctgaagcagcccgaggagtgcaacctgaacctgcccgtgtgggaccccagagtgaaccccagcgacagataccacctgatgcccatcatcacccccgcctacccccagcagaacagcacctacaacgtgagcgtgagcaccagaatggtgatggtggaggagttcaagcagggcctggccatcaccgacgagatcctgctgagcaaggccgagtggagcaagctgttcgaggcccccaacttcttccagaagtacaagcactacatcgtgctgctggccagcgcccccaccgagaagcagagactggagtgggtgggcctggtggagagcaagatcagaatcctggtgggcagcctggagaagaacgagttcatcaccctggcccacgtgaacccccagagcttccccgcccccaaggagaaccccgacaaggaggagttcagaaccatgtgggtgatcggcctggtgttcaagaagaccgagaacagcgagaacctgagcgtggacctgacctacgacatccagagcttcaccgacaccgtgtacagacaggccatcaacagcaagatgttcgaggtggacatgaagatcgccgccatgcacgtgaagagaaagcagctgcaccagctgctgcccaaccacgtgctgcagaagaagaagaagcacagcaccgagggcgtgaagctgaccgccctgaacgacagcagcctggacctgagcatggacagcgacaacagcatgagcgtgcccagccccaccagcgccaccaagaccagccccctgaacagcagcggcagcagccagggcagaaacagccccgcccccgccgtgaccgccgccagcgtgaccaacatccaggccaccgaggtgagcgtgccccaggtgaacagcagcgagagcagcggcggcaccagcagcgagagcatcccccagaccgccacccagcccgccatcagccccccccccaagcccaccgtgagcagagtggtgagcagcaccagactggtgaaccccccccccagaagcagcggcaacgccgccaccagcggcaacgccgccaccaagatccccacccccatcgtgggcgtgaagagaaccagcagcccccacaaggaggagagccccaagaagaccaagaccgaggaggacgagaccagcgaggacgccaactgcctggccctgagcggccacgacaagaccgaggccaaggagcagctggacaccgagaccagcaccacccagagcgagaccatccagaccgccgccagcctgctggccagccagaagaccagcagcaccgacctgagcgacatccccgccctgcccgccaaccccatccccgtgatcaagaacagcatcaagctgagactgaacagatag

SEQ ID NO: 78007 - DNA, 1080 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccccgccaccgaggccagatacagaagagagggcgccagattcatcttcgacgtgggcaccagactgggcctgcactacgacaccctggccaccggcatcatctacttccacagattctacatgttccacagcttcaagcagttccccagatacgtgaccggcgcctgctgcctgttcctggccggcaaggtggaggagacccccaagaagtgcaaggacatcatcaagaccgccagaagcctgctgaacgacgtgcagttcggccagttcggcgacgaccccaaggaggaggtgatggtgctggagagaatcctgctgcagaccatcaagttcgacctgcaggtggagcacccctaccagttcctgctgaagtacgccaagcagctgaagggcgacaagaacaagatccagaagctggtgcagatggcctggaccttcgtgaacgacagaaccagcctgtgcaccaccctgagcctgcagtgggagcccgagatcatcgccgtggccgtgatgtacctggccggcagactgtgcaagttcgagatccaggagtggaccagcaagcccatgtacagaagatggtgggagcagttcgtgcaggacgtgcccgtggacgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggacccccagcagcccgcccagcagcagcagcccgcccagcagcccaagaagcccagcccccagcccagcagccccagacaggtgaagagagccgtggtggtgagccccaaggaggagaacaaggccgccggcaaggccagcctgaagcacacctggtag

SEQ ID NO: 78008 - DNA, 1743 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccccgccaccgaggccagatacagaagagagggcgccagattcatcttcgacgtgggcaccagactgggcctgcactacgacaccctggccaccggcatcatctacttccacagattctacatgttccacagcttcaagcagttccccagatacgtgaccggcgcctgctgcctgttcctggccggcaaggtggaggagacccccaagaagtgcaaggacatcatcaagaccgccagaagcctgctgaacgacgtgcagttcggccagttcggcgacgaccccaaggaggaggtgatggtgctggagagaatcctgctgcagaccatcaagttcgacctgcaggtggagcacccctaccagttcctgctgaagtacgccaagcagctgaagggcgacaagaacaagatccagaagctggtgcagatggcctggaccttcgtgaacgacagcctgtgcaccaccctgagcctgcagtgggagcccgagatcatcgccgtggccgtgatgtacctggccggcagactgtgcaagttcgagatccaggagtggaccagcaagcccatgtacagaagatggtgggagcagttcgtgcaggacgtgcccgtggacgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggacccccagcagcccgcccagcagcagcagcccgcccagcagcccaagaagcccagcccccagcccagcagccccagacaggtgaagagagccgtggtggtgagccccaaggaggagaacaaggccgccgagccccccccccccaagatccccaagatcgagaccacccacccccccctgccccccgcccaccccccccccgacagaaagccccccctggccgccgccctgggcgaggccgagccccccggccccgtggacgccaccgacctgcccaaggtgcagatccccccccccgcccaccccgcccccgtgcaccagcccccccccctgccccacagaccccccccccccccccccagcagctacatgaccggcatgagcaccaccagcagctacatgagcggcgagggctaccagagcctgcagagcatgatgaagaccgagggccccagctacggcgccctgccccccgcctacggcccccccgcccacctgccctaccacccccacgtgtacccccccaaccccccccccccccccgtgccccccccccccgccagcttccccccccccgccatccccccccccacccccggctaccccccccccccccccacctacaaccccaacttccccccccccccccccagactgccccccacccacgccgtgcccccccaccccccccccggcctgggcctgccccccgccagctaccccccccccgccgtgccccccggcggccagccccccgtgcccccccccatccccccccccggcatgccccccgtgggcggcctgggcagagccgcctggatgagatag

SEQ ID NO: 78009 - DNA, 1803 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccccgccaccgaggccagatacagaagagagggcgccagattcatcttcgacgtgggcaccagactgggcctgcactacgacaccctggccaccggcatcatctacttccacagattctacatgttccacagcttcaagcagttccccagatacgtgaccggcgcctgctgcctgttcctggccggcaaggtggaggagacccccaagaagtgcaaggacatcatcaagaccgccagaagcctgctgaacgacgtgcagttcggccagttcggcgacgaccccaaggaggaggtgatggtgctggagagaatcctgctgcagaccatcaagttcgacctgcaggtggagcacccctaccagttcctgctgaagtacgccaagcagctgaagggcgacaagaacaagatccagaagctggtgcagatggcctggaccttcgtgaacgacagcctgtgcaccaccctgagcctgcagtgggagcccgagatcatcgccgtggccgtgatgtacctggccggcagactgtgcaagttcgagatccaggagtggaccagcaagcccatgtacagaagatggtgggagcagttcgtgcaggacgtgcccgtggacgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggacccccagcagcccgcccagcagcagcagcccgcccagcagcccaagaagcccagcccccagcccagcagccccagacaggtgaagagagccgtggtgagcggcctgaagcaggccctgggcagagccggcttccccggcggcggcaacaccaccgtggtgagccccaaggaggagaacaaggccgccgagccccccccccccaagatccccaagatcgagaccacccacccccccctgccccccgcccaccccccccccgacagaaagccccccctggccgccgccctgggcgaggccgagccccccggccccgtggacgccaccgacctgcccaaggtgcagatccccccccccgcccaccccgcccccgtgcaccagcccccccccctgccccacagaccccccccccccccccccagcagctacatgaccggcatgagcaccaccagcagctacatgagcggcgagggctaccagagcctgcagagcatgatgaagaccgagggccccagctacggcgccctgccccccgcctacggcccccccgcccacctgccctaccacccccacgtgtacccccccaaccccccccccccccccgtgccccccccccccgccagcttccccccccccgccatccccccccccacccccggctaccccccccccccccccacctacaaccccaacttccccccccccccccccagactgccccccacccacgccgtgcccccccaccccccccccggcctgggcctgccccccgccagctaccccccccccgccgtgccccccggcggccagccccccgtgcccccccccatccccccccccggcatgccccccgtgggcggcctgggcagagccgcctggatgagatag

SEQ ID NO: 78010 - DNA, 333 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccccgccaccgaggccagatacagaagagagggcgccagattcatcttcgacgtgggcaccagactgggcctgcactacgacaccctggccaccggcatcatctacttccacagattctacatgttccacagcttcaagcagttccccagatacgtgaccggcgcctgctgcctgttcctggccggcaaggtggaggagaccccctag

SEQ ID NO: 78011 - DNA, 684 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccccgccaccgaggccagatacagaagagagggcgccagattcatcttcgacgtgggcaccagactgggcctgcactacgacaccctggccaccggcatcatctacttccacagattctacatgttccacagcttcaagcagttccccagatacgtgaccggcgcctgctgcctgttcctggccggcaaggtggaggagacccccaagaagtgcaaggacatcatcaagaccgccagaagcctgctgaacgacgtgcagttcggccagttcggcgacgaccccaaggaggaggtgatggtgctggagagaatcctgctgcagaccatcaagttcgacctgcaggtggagcacccctaccagttcctgctgaagtacgccaagcagctgaagggcgacaagaacaagatccagaagctggtgcagatggcctggaccttcgtgaacgacagcctgtgcaccaccctgagcctgcagtgggagcccgagatcatcgccgtggccgtgatgtacctggccggcagactgtgcaagttcgagatccaggagtggaccagctag

SEQ ID NO: 78012 - DNA, 519 bp, Artificial Sequence
  Description of Artificial Sequence: Synthetic coding sequence
atggccagcggcccccacagcaccgccaccgccgccgccgccgccagcagcgccgcccccagcgccggcggcagcagcagcggcaccaccaccaccaccaccaccaccaccggcggcatcctgatcggcgacagactgtacagcgaggtgagcctgaccatcgaccacagcctgatccccgaggagagactgagccccacccccagcatgcaggacggcctggacctgcccagcgagaccgacctgagaatcctgggctgcgagctgatccaggccgccggcatcctgctgagactgccccaggtggccatggccaccggccaggtgctgttccacagattcttctacagcaagagcttcgtgaagcacagcttcgagatcgtggccatggcctgcatcaacctggccagcaagatcgaggaggcccccagaagaatcagagacgtgatcaacgtgttccaccacctgagacagctgagaggcaagagcgaccagctgcacctgcccaagcccggctag

SEQ ID NO: 78013 - DNA, 1581 bp, Artificial Sequence
  Description of Artificial Sequence: Synthetic coding sequence
atggccagcggcccccacagcaccgccaccgccgccgccgccgccagcagcgccgcccccagcgccggcggcagcagcagcggcaccaccaccaccaccaccaccaccaccggcggcatcctgatcggcgacagactgtacagcgaggtgagcctgaccatcgaccacagcctgatccccgaggagagactgagccccacccccagcatgcaggacggcctggacctgcccagcgagaccgacctgagaatcctgggctgcgagctgatccaggccgccggcatcctgctgagactgccccaggtggccatggccaccggccaggtgctgttccacagattcttctacagcaagagcttcgtgaagcacagcttcgagatcgtggccatggcctgcatcaacctggccagcaagatcgaggaggcccccagaagaatcagagacgtgatcaacgtgttccaccacctgagacagctgagaggcaagagaacccccagccccctgatcctggaccagaactacatcaacaccaagaaccaggtgatcaaggccgagagaagagtgctgaaggagctgggcttctgcgtgcacgtgaagcacccccacaagatcatcgtgatgtacctgcaggtgctggagtgcgagagaaaccagaccctggtgcagaccgcctggaactacatgaacgacagcctgagaaccaacgtgttcgtgagattccagcccgagaccatcgcctgcgcctgcatctacctggccgccagagccctgcagatccccctgcccaccagaccccactggttcctgctgttcggcaccaccgaggaggagatccaggagatctgcatcgagaccctgagactgtacaccagaaagaagcccaactacgagctgctggagaaggaggtggagaagagaaaggtggccctgcaggaggccaagctgaaggccaagggcctgaaccccgacggcacccccgccctgagcaccctgggcggcttcagccccgccagcaagcccagcagccccagagaggtgaaggccgaggagaagagccccatcagcatcaacgtgaagaccgtgaagaaggagcccgaggacagacagcaggccagcaagagcccctacaacggcgtgagaaaggacagcaagagaagcagaaacagcagaagcgccagcagaagcagaagcagaaccagaagcagaagcagaagccacacccccagaagacactacaacaacagaagaagcagaagcggcacctacagcagcagaagcagaagcagaagcagaagccacagcgagagccccagaagacaccacaaccacggcagcccccacctgaaggccaagcacaccagagacgacctgaagagcagcaacagacacggccacaagagaaagaagagcagaagcagaagccagagcaagagcagagaccacagcgacgccgccaagaagcacagacacgagagaggccaccacagagacagaagagagagaagcagaagcttcgagagaagccacaagagcaagcaccacggcggcagcagaagcggccacggcagacacagaagatag

SEQ ID NO: 78014 - DNA, 1563 bp, Artificial Sequence
  Description of Artificial Sequence: Synthetic coding sequence
atggccgccgccgccgccgccgccggcgccgccggcagcgccgcccccgccgccgccgccggcgcccccggcagcggcggcgcccccagcggcagccagggcgtgctgatcggcgacagactgtacagcggcgtgctgatcaccctggagaactgcctgctgcccgacgacaagctgagattcacccccagcatgagcagcggcctggacaccgacaccgagaccgacctgagagtggtgggctgcgagctgatccaggccgccggcatcctgctgagactgccccaggtggccatggccaccggccaggtgctgttccagagattcttctacaccaagagcttcgtgaagcacagcatggagcacgtgagcatggcctgcgtgcacctggccagcaagatcgaggaggcccccagaagaatcagagacgtgatcaacgtgttccacagactgagacagctgagagacaagaagaagcccgtgcccctgctgctggaccaggactacgtgaacctgaagaaccagatcatcaaggccgagagaagagtgctgaaggagctgggcttctgcgtgcacgtgaagcacccccacaagatcatcgtgatgtacctgcaggtgctggagtgcgagagaaaccagcacctggtgcagaccagctggaactacatgaacgacagcctgagaaccgacgtgttcgtgagattccagcccgagagcatcgcctgcgcctgcatctacctggccgccagaaccctggagatccccctgcccaacagaccccactggttcctgctgttcggcgccaccgaggaggagatccaggagatctgcctgaagatcctgcagctgtacgccagaaagaaggtggacctgacccacctggagggcgaggtggagaagagaaagcacgccatcgaggaggccaaggcccaggccagaggcctgctgcccggcggcacccaggtgctggacggcaccagcggcttcagccccgcccccaagctggtggagagccccaaggagggcaagggcagcaagcccagccccctgagcgtgaagaacaccaagagaagactggagggcgccaagaaggccaaggccgacagccccgtgaacggcctgcccaagggcagagagagcagaagcagaagcagaagcagagagcagagctacagcagaagccccagcagaagcgccagccccaagagaagaaagagcgacagcggcagcaccagcggcggcagcaagagccagagcagaagcagaagcagaagcgacagcccccccagacaggcccccagaagcgccccctacaagggcagcgagatcagaggcagcagaaagagcaaggactgcaagtacccccagaagccccacaagagcagaagcagaagcagcagcagaagcagaagcagaagcagagagagagccgacaaccccggcaagtacaagaagaagagccactactacagagaccagagaagagagagaagcagaagctacgagagaaccggcagaagatacgagagagaccaccccggccacagcagacacagaagatag

SEQ ID NO: 78015 - DNA, 681 bp, Artificial Sequence
  Description of Artificial Sequence: Synthetic coding sequence
atggccgccgccgccgccgccgccggcgccgccggcagcgccgcccccgccgccgccgccggcgcccccggcagcggcggcgcccccagcggcagccagggcgtgctgatcggcgacagactgtacagcggcgtgctgatcaccctggagaactgcctgctgcccgacgacaagctgagattcacccccagcatgagcagcggcctggacaccgacaccgagaccgacctgagagtggtgggctgcgagctgatccaggccgccggcatcctgctgagactgccccaggtggccatggccaccggccaggtgctgttccagagattcttctacaccaagagcttcgtgaagcacagcatggagcacgtgagcatggcctgcgtgcacctggccagcaagatcgaggaggcccccagaagaatcagagacgtgatcaacgtgttccacagactgagacagctgagagacaagaagaagcccgtgcccctgctgctggaccaggactacgtgaacctgaagaaccagatcatcaaggccgagagaagagtgctgaaggagctgggcttctgcgtgcacgtgaagcacccccacaagatcatcgtgatgtacctgcaggtgctggagtgcgagagaaaccagcacctggtgcagaccagctgggtggccagcgagggcaagtag

SEQ ID NO: 78016 - DNA, 1044 bp, Artificial Sequence
  Description of Artificial Sequence: Synthetic coding sequence
atgaacgacagcctgagaaccgacgtgttcgtgagattccagcccgagagcatcgcctgcgcctgcatctacctggccgccagaaccctggagatccccctgcccaacagaccccactggttcctgctgttcggcgccaccgaggaggagatccaggagatctgcctgaagatcctgcagctgtacgccagaaagaaggtggacctgacccacctggagggcgaggtggagaagagaaagcacgccatcgaggagggccccagccccggccccgtggcctggggccacaccggcgccggctggtacctgggcgtgctgagctgcccccaggccggctgctgggactacagcctggagtgcagcggcgccatctgggaccactgcaagctgagactgcccgacagcggcgacagctgcgccagcgccagccaggtggccggcatcgccggcgcccaccaccacgcccagagcctggccgtgctgcccgtggagagccccaaggagggcaagggcagcaagcccagccccctgagcgtgaagaacaccaagagaagactggagggcgccaagaaggccaaggccgacagccccgtgaacggcctgcccaagggcagagagagcagaagcagaagcagaagcagagagcagagctacagcagaagccccagcagaagcgccagccccaagagaagaaagagcgacagcggcagcaccagcggcggcagcaagagccagagcagaagcagaagcagaagcgacagcccccccagacaggcccccagaagcgccccctacaagggcagcgagatcagaggcagcagaaagagcaaggactgcaagtacccccagaagccccacaagagcagaagcagaagcagcagcagaagcagaagcagaagcagagagagagccgacaaccccggcaagtacaagaagaagagccactactacagagaccagagaagagagagaagcagaagctacgagagaaccggcagaagatacgagagagaccaccccggccacagcagacacagaagatag

SEQ ID NO: 78017 - DNA, 2856 bp, Artificial Sequence
  Description of Artificial Sequence: Synthetic coding sequence
atggccgccgccgccgccgccgccgccgccgtgggcgtgagactgagagactgctgcagcagaggcgccgtgctgctgctgttcttcagcctgagccccagaccccccgccgccgccgcctggctgctgggcctgagacccgaggacaccgccggcggcagagtgagcctggagggcggcaccctgagagccgccgagggcaccagcttcctgctgagagtgtacttccagcccggcccccccgccaccgccgcccccgtgcccagccccaccctgaacagcggcgagaacggcaccggcgactgggcccccagactggtgttcatcgaggagccccccggcggcggcggcgtggcccccagcgccgtgcccaccagaccccccggcccccagagatgcagagagcagagcgactgggccagcgacgtggaggtgctgggccccctgagacccggcggcgtggccggcagcgccctggtgcaggtgagagtgagagagctgagaaagggcgaggccgagagaggcggcgccggcggcggcggcaagctgttcagcctgtgcgcctgggacggcagagcctggcaccaccacggcgccgccggcggcttcctgctgagagtgagacccagactgtacggccccggcggcgacctgctgccccccgcctggctgagagccctgggcgccctgctgctgctggccctgagcgccctgttcagcggcctgagactgagcctgctgagcctggaccccgtggagctgagagtgctgagaaacagcggcagcgccgccgagcaggagcaggccagaagagtgcaggccgtgagaggcagaggcacccacctgctgtgcaccctgctgctgggccaggccggcgccaacgccgccctggccggctggctgtacaccagcctgccccccggcttcggcggcaccggcgaggactacagcgaggagggcatccacttcccctggctgcccgccctggtgtgcaccggcgccgtgttcctgggcgccgagatctgcccctacagcgtgtgcagcagacacggcctggccatcgccagccacagcgtgtgcctgaccagactgctgatggccgccgccttccccgtgtgctaccccctgggcagactgctggactgggccctgagacaggagatcagcaccttctacaccagagagaagctgctggagaccctgagagccgccgacccctacagcgacctggtgaaggaggagctgaacatcatccagggcgccctggagctgagaaccaaggtggtggaggaggtgctgacccccctgggcgactgcttcatgctgagaagcgacgccgtgctggacttcgccaccgtgagcgagatcctgagaagcggctacaccagaatccccgtgtacgagggcgaccagagacacaacatcgtggacatcctgttcgtgaaggacctggccttcgtggaccccgacgactgcacccccctgctgaccgtgaccagattctacaacagacccctgcactgcgtgttcaacgacaccagactggacaccgtgctggaggagttcaagaagggcaagagccacctggccatcgtgcagagagtgaacaacgagggcgagggcgaccccttctacgaggtgatgggcatcgtgaccctggaggacatcatcgaggagatcatcaagagcgagatcctggacgagaccgacctgtacaccgacaacagaaagaagcagagagtgccccagagagagagaaagagacacgacttcagcctgttcaagctgagcgacaccgagatgagagtgaagatcagcccccagctgctgctggccacccacagattcatggccaccgaggtggagcccttcaagagcctgtacctgagcgagaagatcctgctgagactgctgaagcaccccaacgtgatccaggagctgaagttcgacgagaagaacaagaaggcccccgagcactacctgtaccagagaaacagacccgtggactacttcgtgctgctgctgcagggcaaggtggaggtggaggtgggcaaggagggcctgagattcgagaacggcgccttcacctactacggcgtgcccgccatcatgaccaccgcctgcagcgacaacgacgtgagaaaggtgggcagcctggccggcagcagcgtgttcctgaacagaagccccagcagatgcagcggcctgaacagaagcgagagccccaacagagagagaagcgacttcggcggcagcaacacccagctgtacagcagcagcaacaacctgtacatgcccgactacagcgtgcacatcctgagcgacgtgcagttcgtgaagatcaccagacagcagtaccagaacgccctgaccgcctgccacatggacagcagcccccagagccccgacatggaggccttcaccgacggcgacagcaccaaggcccccaccaccagaggcaccccccagacccccaaggacgaccccgccatcaccctgctgaacaacagaaacagcctgccctgcagcagaagcgacggcctgagaagccccagcgaggtggtgtacctgagaatggaggagctggccttcacccaggaggagatgaccgacttcgaggagcacagcacccagcagctgaccctgagccccgccgccgtgcccaccagagccgccagcgacagcgagtgctgcaacatcaacctggacaccgagaccagcccctgcagcagcgacttcgaggagaacgtgggcaagaagctgctgagaaccctgagcggccagaagagaaagagaagccccgagggcgagagaaccagcgaggacaacagcaacctgacccccctgatcacctag

SEQ ID NO: 78018 - DNA, 2493 bp, Artificial Sequence
  Description of Artificial Sequence: Synthetic coding sequence
atggccgccgccgccgccgccgccgccgccgtgggcgtgagactgagagactgctgcagcagaggcgccgtgctgctgctgttcttcagcctgagccccagaccccccgccgccgccgcctggctgctgggcctgagacccgaggacaccgccggcggcagagtgagcctggagggcggcaccctgagagccgccgagggcaccagcttcctgctgagagtgtacttccagcccggcccccccagatgcagagagcagagcgactgggccagcgacgtggaggtgctgggccccctgagacccggcggcgtggccggcagcgccctggtgcagctgttcagcctgtgcgcctgggacggcagagcctggcaccaccacggcgccgccggcggcttcctgctgagagtgagacccagactgtacggccccggcggcgacctgctgccccccgcctggctgagagccctgggcgccctgctgctgctggccctgagcgccctgttcagcggcctgagactgagcctgctgagcctggaccccgtggagctgagagtgctgagaaacagcggcagcgccgccgagcaggagcaggccagaagagtgcaggccgtgagaggcagaggcacccacctgctgtgcaccctgctgctgggccaggccggcgccaacgccgccctggccggctggctgtacaccagcctgccccccggcttcggcggcaccggcgaggactacagcgaggagggcatccacttcccctggctgcccgccctggtgtgcaccggcgccgtgttcctgggcgccgagatctgcccctacagcgtgtgcagcagacacggcctggccatcgccagccacagcgtgtgcctgaccagactgctgatggccgccgccttccccgtgtgctaccccctgggcagactgctggactgggccctgagacaggagatcagcaccttctacaccagagagaagctgctggagaccctgagagccgccgacccctacagcgacctggtgaaggaggagctgaacatcatccagggcgccctggagctgagaaccaaggtggtggaggaggtgctgacccccctgggcgactgcttcatgctgagaagcgacgccgtgctggacttcgccaccgtgagcgagatcctgagaagcggctacaccagaatccccgtgtacgagggcgaccagagacacaacatcgtggacatcctgttcgtgaaggacctggccttcgtggaccccgacgactgcacccccctgctgaccgtgaccagattctacaacagacccctgcactgcgtgttcaacgacaccagactggacaccgtgctggaggagttcaagaagggcaagagccacctggccatcgtgcagagagtgaacaacgagggcgagggcgaccccttctacgaggtgatgggcatcgtgaccctggaggacatcatcgaggagatcatcaagagcgagatcctggacgagaccgacctgtacaccgacaacagaaagaagcagagagtgccccagagagagagaaagagacacgacttcagcctgttcaagctgagcgacaccgagatgagagtgaagatcagcccccagctgctgctggccacccacagattcatggccaccgaggtggagcccttcaagagcctgtacctgagcgagaagatcctgctgagactgctgaagcaccccaacgtgatccaggagctgaagttcgacgagaagaacaagaaggcccccgagcactacctgtaccagagaaacagacccgtggactacttcgtgctgctgctgcagggcaaggtggaggtggaggtgggcaaggagggcctgagattcgagaacggcgccttcacctactacggcgtgcccgccatcatgaccaccgcctgcagcgacaacgacgtgagaaaggtgggcagcctggccggcagcagcgtgttcctgaacagaagccccagcagatgcagcggcctgaacagaagcgagagccccaacagagagagaagcgacttcggcggcagcaacacccagctgtacagcagcagcaacaacctgtacatgcccgactacagcgtgcacatcctgagcgacgtgcagttcgtgaagatcaccagacagcagtaccagaacgccctgaccgcctgccacatggacagcagcccccagagccccgacatggaggccttcaccgacggcgacagcaccaaggcccccaccaccagaggcaccccccagacccccaaggacgaccccgccatcaccctgctgaacaacagaaacagcctgcccagcagcgacagcgagtgctgcaacatcaacctggacaccgagaccagcccctgcagcagcgacttcgaggagaacgtgggcaagaagctgctgagaaccctgagcggccagaagagaaagagaagccccgagggcgagagaaccagcgaggacaacagcaacctgacccccctgatcacctag

SEQ ID NO: 78019 - DNA, 1824 bp, Artificial Sequence
  Description of Artificial Sequence: Synthetic coding sequence
atggccgccgccttccccgtgtgctaccccctgggcagactgctggactgggccctgagacaggagatcagcaccttctacaccagagagaagctgctggagaccctgagagccgccgacccctacagcgacctggtgaaggaggagctgaacatcatccagggcgccctggagctgagaaccaaggtggtggaggaggtgctgacccccctgggcgactgcttcatgctgagaagcgacgccgtgctggacttcgccaccgtgagcgagatcctgagaagcggctacaccagaatccccgtgtacgagggcgaccagagacacaacatcgtggacatcctgttcgtgaaggacctggccttcgtggaccccgacgactgcacccccctgctgaccgtgaccagattctacaacagacccctgcactgcgtgttcaacgacaccagactggacaccgtgctggaggagttcaagaagggcaagagccacctggccatcgtgcagagagtgaacaacgagggcgagggcgaccccttctacgaggtgatgggcatcgtgaccctggaggacatcatcgaggagatcatcaagagcgagatcctggacgagaccgacctgtacaccgacaacagaaagaagcagagagtgccccagagagagagaaagagacacgacttcagcctgttcaagctgagcgacaccgagatgagagtgaagatcagcccccagctgctgctggccacccacagattcatggccaccgaggtggagcccttcaagagcctgtacctgagcgagaagatcctgctgagactgctgaagcaccccaacgtgatccaggagctgaagttcgacgagaagaacaagaaggcccccgagcactacctgtaccagagaaacagacccgtggactacttcgtgctgctgctgcagggcaaggtggaggtggaggtgggcaaggagggcctgagattcgagaacggcgccttcacctactacggcgtgcccgccatcatgaccaccgcctgcagcgacaacgacgtgagaaaggtgggcagcctggccggcagcagcgtgttcctgcccgtgagcgtgagcagaaccttcgccgtgagcagaggcgacagcctggccggcagccccgtgaacagaagccccagcagatgcagcggcctgaacagaagcgagagccccaacagagagagaagcgacttcggcggcagcaacacccagctgtacagcagcagcaacaacctgtacatgcccgactacagcgtgcacatcctgagcgacgtgcagttcgtgaagatcaccagacagcagtaccagaacgccctgaccgcctgccacatggacagcagcccccagagccccgacatggaggccttcaccgacggcgacagcaccaaggcccccaccaccagaggcaccccccagacccccaaggacgaccccgccatcaccctgctgaacaacagaaacagcctgccctgcagcagaagcgacggcctgagaagccccagcgaggtggtgtacctgagaatggaggagctggccttcacccaggaggagatgaccgacttcgaggagcacagcacccagcagctgaccctgagccccgccgccgtgcccaccagagccgccagcgacagcgagtgctgcaacatcaacctggacaccgagaccagcccctgcagcagcgacttcgaggagaacgtgggcaagaagctgctgagaaccctgagcggccagaagagaaagagaagccccgagggcgagagaaccagcgaggacaacagcaacctgacccccctgatcacctag

SEQ ID NO: 78020 - DNA, 2643 bp, Artificial Sequence
  Description of Artificial Sequence: Synthetic coding sequence
atggccgccgccgccgccgccgccgccgccgtgggcgtgagactgagagactgctgcagcagaggcgccgtgctgctgctgttcttcagcctgagccccagaccccccgccgccgccgcctggctgctgggcctgagacccgaggacaccgccggcggcagagtgagcctggagggcggcaccctgagagccgccgagggcaccagcttcctgctgagagtgtacttccagcccggcccccccagatgcagagagcagagcgactgggccagcgacgtggaggtgctgggccccctgagacccggcggcgtggccggcagcgccctggtgcagctgttcagcctgtgcgcctgggacggcagagcctggcaccaccacggcgccgccggcggcttcctgctgagagtgagacccagactgtacggccccggcggcgacctgctgccccccgcctggctgagagccctgggcgccctgctgctgctggccctgagcgccctgttcagcggcctgagactgagcctgctgagcctggaccccgtggagctgagagtgctgagaaacagcggcagcgccgccgagcaggagcaggccagaagagtgcaggccgtgagaggcagaggcacccacctgctgtgcaccctgctgctgggccaggccggcgccaacgccgccctggccggctggctgtacaccagcctgccccccggcttcggcggcaccggcgaggactacagcgaggagggcatccacttcccctggctgcccgccctggtgtgcaccggcgccgtgttcctgggcgccgagatctgcccctacagcgtgtgcagcagacacggcctggccatcgccagccacagcgtgtgcctgaccagactgctgatggccgccgccttccccgtgtgctaccccctgggcagactgctggactgggccctgagacaggagatcagcaccttctacaccagagagaagctgctggagaccctgagagccgccgacccctacagcgacctggtgaaggaggagctgaacatcatccagggcgccctggagctgagaaccaaggtggtggaggaggtgctgacccccctgggcgactgcttcatgctgagaagcgacgccgtgctggacttcgccaccgtgagcgagatcctgagaagcggctacaccagaatccccgtgtacgagggcgaccagagacacaacatcgtggacatcctgttcgtgaaggacctggccttcgtggaccccgacgactgcacccccctgctgaccgtgaccagattctacaacagacccctgcactgcgtgttcaacgacaccagactggacaccgtgctggaggagttcaagaagggcaagagccacctggccatcgtgcagagagtgaacaacgagggcgagggcgaccccttctacgaggtgatgggcatcgtgaccctggaggacatcatcgaggagatcatcaagagcgagatcctggacgagaccgacctgtacaccgacaacagaaagaagcagagagtgccccagagagagagaaagagacacgacttcagcctgttcaagctgagcgacaccgagatgagagtgaagatcagcccccagctgctgctggccacccacagattcatggccaccgaggtggagcccttcaagagcctgtacctgagcgagaagatcctgctgagactgctgaagcaccccaacgtgatccaggagctgaagttcgacgagaagaacaagaaggcccccgagcactacctgtaccagagaaacagacccgtggactacttcgtgctgctgctgcagggcaaggtggaggtggaggtgggcaaggagggcctgagattcgagaacggcgccttcacctactacggcgtgcccgccatcatgaccaccgcctgcagcgacaacgacgtgagaaaggtgggcagcctggccggcagcagcgtgttcctgaacagaagccccagcagatgcagcggcctgaacagaagcgagagccccaacagagagagaagcgacttcggcggcagcaacacccagctgtacagcagcagcaacaacctgtacatgcccgactacagcgtgcacatcctgagcgacgtgcagttcgtgaagatcaccagacagcagtaccagaacgccctgaccgcctgccacatggacagcagcccccagagccccgacatggaggccttcaccgacggcgacagcaccaaggcccccaccaccagaggcaccccccagacccccaaggacgaccccgccatcaccctgctgaacaacagaaacagcctgccctgcagcagaagcgacggcctgagaagccccagcgaggtggtgtacctgagaatggaggagctggccttcacccaggaggagatgaccgacttcgaggagcacagcacccagcagctgaccctgagccccgccgccgtgcccaccagagccgccagcgacagcgagtgctgcaacatcaacctggacaccgagaccagcccctgcagcagcgacttcgaggagaacgtgggcaagaagctgctgagaaccctgagcggccagaagagaaagagaagccccgagggcgagagaaccagcgaggacaacagcaacctgacccccctgatcacctag

SEQ ID NO: 78021 - DNA, 1215 bp, Artificial Sequence
  Description of Artificial Sequence: Synthetic coding sequence
atgggcatcgtgaccctggaggacatcatcgaggagatcatcaagagcgagatcctggacgagaccgacctgtacaccgacaacagaaagaagcagagagtgccccagagagagagaaagagacacgacttcagcctgttcaagctgagcgacaccgagatgagagtgaagatcagcccccagctgctgctggccacccacagattcatggccaccgaggtggagcccttcaagagcctgtacctgagcgagaagatcctgctgagactgctgaagcaccccaacgtgatccaggagctgaagttcgacgagaagaacaagaaggcccccgagcactacctgtaccagagaaacagacccgtggactacttcgtgctgctgctgcagggcaaggtggaggtggaggtgggcaaggagggcctgagattcgagaacggcgccttcacctactacggcgtgcccgccatcatgaccaccgcctgcagcgacaacgacgtgagaaaggtgggcagcctggccggcagcagcgtgttcctgaacagaagccccagcagatgcagcggcctgaacagaagcgagagccccaacagagagagaagcgacttcggcggcagcaacacccagctgtacagcagcagcaacaacctgtacatgcccgactacagcgtgcacatcctgagcgacgtgcagttcgtgaagatcaccagacagcagtaccagaacgccctgaccgcctgccacatggacagcagcccccagagccccgacatggaggccttcaccgacggcgacagcaccaaggcccccaccaccagaggcaccccccagacccccaaggacgaccccgccatcaccctgctgaacaacagaaacagcctgccctgcagcagaagcgacggcctgagaagccccagcgaggtggtgtacctgagaatggaggagctggccttcacccaggaggagatgaccgacttcgaggagcacagcacccagcagctgaccctgagccccgccgccgtgcccaccagagccgccagcgacagcgagtgctgcaacatcaacctggacaccgagaccagcccctgcagcagcgacttcgaggagaacgtgggcaagaagctgctgagaaccctgagcggccagaagagaaagagaagccccgagggcgagagaaccagcgaggacaacagcaacctgacccccctgatcacctag

SEQ ID NO: 78022 - DNA, 2562 bp, Artificial Sequence
  Description of Artificial Sequence: Synthetic coding sequence
atgatcggctgcggcgcctgcgagcccaaggtgaagatggccggcggccaggccgccgccgccctgcccacctggaagatggccgccagaagaagcctgagcgccagaggcagaggcatcctgcaggccgccgccggcagactgctgcccctgctgctgctgagctgctgctgcggcgccggcggctgcgccgccgtgggcgagaacgaggagaccgtgatcatcggcctgagactggaggacaccaacgacgtgagcttcatggagggcggcgccctgagagtgagcgagagaaccagagtgaagctgagagtgtacggccagaacatcaacaacgagacctggagcagaatcgccttcaccgagcacgagagaagaagacacagccccggcgagagaggcctgggcggccccgccccccccgagcccgacagcggcccccagagatgcggcatcagaaccagcgacatcatcatcctgccccacatcatcctgaacagaagaaccagcggcatcatcgagatcgagatcaagcccctgagaaagatggagaagagcaagagctactacctgtgcaccagcctgagcacccccgccctgggcgccggcggcagcggcagcaccggcggcgccgtgggcggcaagggcggcagcggcgtggccggcctgcccccccccccctgggccgagaccacctggatctaccacgacggcgaggacaccaagatgatcgtgggcgaggagaagaagttcctgctgcccttctggctgcaggtgatcttcatcagcctgctgctgtgcctgagcggcatgttcagcggcctgaacctgggcctgatggccctggaccccatggagctgagaatcgtgcagaactgcggcaccgagaaggagaagaactacgccaagagaatcgagcccgtgagaagacagggcaactacctgctgtgcagcctgctgctgggcaacgtgctggtgaacaccaccctgaccatcctgctggacgacatcgccggcagcggcctggtggccgtggtggtgagcaccatcggcatcgtgatcttcggcgagatcgtgccccaggccatctgcagcagacacggcctggccgtgggcgccaacaccatcttcctgaccaagttcttcatgatgatgaccttccccgccagctaccccgtgagcaagctgctggactgcgtgctgggccaggagatcggcaccgtgtacaacagagagaagctgctggagatgctgagagtgaccgacccctacaacgacctggtgaaggaggagctgaacatcatccagggcgccctggagctgagaaccaagaccgtggaggacgtgatgacccccctgagagactgcttcatgatcaccggcgaggccatcctggacttcaacaccatgagcgagatcatggagagcggctacaccagaatccccgtgttcgagggcgagagaagcaacatcgtggacctgctgttcgtgaaggacctggccttcgtggaccccgacgactgcacccccctgaagaccatcaccaagttctacaaccaccccctgcacttcgtgttcaacgacaccaagctggacgccatgctggaggagttcaagaagggcaagagccacctggccatcgtgcagagagtgaacaacgagggcgagggcgaccccttctacgaggtgctgggcatcgtgaccctggaggacgtgatcgaggagatcatcaagagcgagatcctggacgagaccgacctgtacaccgacaacagaaccaagaagaaggtggcccacagagagagaaagcaggacttcagcgccttcaagcagaccgacagcgagatgaaggtgaagatcagcccccagctgctgctggccatgcacagattcctggccaccgaggtggaggccttcagccccagccagatgagcgagaagatcctgctgagactgctgaagcaccccaacgtgatccaggagctgaagtacgacgagaagaacaagaaggcccccgagtactacctgtaccagagaaacaagcccgtggactacttcgtgctgatcctgcagggcaaggtggaggtggaggccggcaaggagggcatgaagttcgaggccagcgccttcagctactacggcgtgatggccctgaccgccagccccggcgagaacaagagcccccccagaccctgcggcctgaaccacagcgacagcctgagcagaagcgacagaatcgacgccgtgacccccaccctgggcagcagcaacaaccagctgaacagcagcctgctgcaggtgtacatccccgactacagcgtgagagccctgagcgacctgcagttcgtgaagatcagcagacagcagtaccagaacgccctgatggccagcagaatggacaagaccccccagagcagcgacagcgagaacaccaagatcgagctgaccctgaccgagctgcacgacggcctgcccgacgagaccgccaacctgctgaacgagcagaactgcgtgacccacagcaaggccaaccacagcctgcacaacgagggcgccatctag

SEQ ID NO: 78023 - DNA, 1659 bp, Artificial Sequence
  Description of Artificial Sequence: Synthetic coding sequence
atgatcggctgcggcgcctgcgagcccaaggtgaagatggccggcggccaggccgccgccgccctgcccacctggaagatggccgccagaagaagcctgagcgccagaggcagaggcatcctgcaggccgccgccggcagactgctgcccctgctgctgctgagctgctgctgcggcgccggcggctgcgccgccgtgggcgagaacgaggagaccgtgatcatcggcctgagactggaggacaccaacgacgtgagcttcatggagggcggcgccctgagagtgagcgagagaaccagagtgaagctgagagtgtacggccagaacatcaacaacgagacctggagcagaatcgccttcaccgagcacgagagaagaagacacagccccggcgagagaggcctgggcggccccgccccccccgagcccgacagcggcccccagagatgcggcatcagaaccagcgacatcatcatcctgccccacatcatcctgaacagaagaaccagcggcatcatcgagatcgagatcaagcccctgagaaagatggagaagagcaagagctactacctgtgcaccagcctgagcacccccgccctgggcgccggcggcagcggcagcaccggcggcgccgtgggcggcaagggcggcagcggcgtggccggcctgcccccccccccctgggccgagaccacctggatctaccacgacggcgaggacaccaagatgatcgtgggcgaggagaagaagttcctgctgcccttctggctgcaggtgatcttcatcagcctgctgctgtgcctgagcggcatgttcagcggcctgaacctgggcctgatggccctggaccccatggagctgagaatcgtgcagaactgcggcaccgagaaggagaagaactacgccaagagaatcgagcccgtgagaagacagggcaactacctgctgtgcagcctgctgctgggcaacgtgctggtgaacaccaccctgaccatcctgctggacgacatcgccggcagcggcctggtggccgtggtggtgagcaccatcggcatcgtgatcttcggcgagatcgtgccccaggccatctgcagcagacacggcctggccgtgggcgccaacaccatcttcctgaccaagttcttcatgatgatgaccttccccgccagctaccccgtgagcaagctgctggactgcgtgctgggccaggagatcggcaccgtgtacaacagagagaagctgctggagatgctgagagtgaccgacccctacaacgacctggtgaaggaggagctgaacatcatccagggcgccctggagctgagaaccaagaccgtggaggacgtgatgacccccctgagagactgcttcatgatcaccggcgaggccatcctggacttcaacaccatgagcgagatcatggagagcggctacaccagaatccccgtgttcgagggcgagagaagcaacatcgtggacctgctgttcgtgaaggacctggccttcgtggaccccgacgactgcacccccctgaagaccatcaccaagttctacaaccaccccctgcacttcgtgttcaacgacaccaagctggacgccatgctggaggagttcaagaaggagcacaccaacaagaagcccaagagctaccagcactag

SEQ ID NO: 78024 - DNA, 2628 bp, Artificial Sequence
  Description of Artificial Sequence: Synthetic coding sequence
atgatcggctgcggcgcctgcgagcccaaggtgaagatggccggcggccaggccgccgccgccctgcccacctggaagatggccgccagaagaagcctgagcgccagaggcagaggcatcctgcaggccgccgccggcagactgctgcccctgctgctgctgagctgctgctgcggcgccggcggctgcgccgccgtgggcgagaacgaggagaccgtgatcatcggcctgagactggaggacaccaacgacgtgagcttcatggagggcggcgccctgagagtgagcgagagaaccagagtgaagctgagagtgtacggccagaacatcaacaacgagacctggagcagaatcgccttcaccgagcacgagagaagaagacacagccccggcgagagaggcctgggcggccccgccccccccgagcccgacagcggcccccagagatgcggcatcagaaccagcgacatcatcatcctgccccacatcatcctgaacagaagaaccagcggcatcatcgagatcgagatcaagcccctgagaaagatggagaagagcaagagctactacctgtgcaccagcctgagcacccccgccctgggcgccggcggcagcggcagcaccggcggcgccgtgggcggcaagggcggcagcggcgtggccggcctgcccccccccccctgggccgagaccacctggatctaccacgacggcgaggacaccaagatgatcgtgggcgaggagaagaagttcctgctgcccttctggctgcaggtgatcttcatcagcctgctgctgtgcctgagcggcatgttcagcggcctgaacctgggcctgatggccctggaccccatggagctgagaatcgtgcagaactgcggcaccgagaaggagaagaactacgccaagagaatcgagcccgtgagaagacagggcaactacctgctgtgcagcctgctgctgggcaacgtgctggtgaacaccaccctgaccatcctgctggacgacatcgccggcagcggcctggtggccgtggtggtgagcaccatcggcatcgtgatcttcggcgagatcgtgccccaggccatctgcagcagacacggcctggccgtgggcgccaacaccatcttcctgaccaagttcttcatgatgatgaccttccccgccagctaccccgtgagcaagctgctggactgcgtgctgggccaggagatcggcaccgtgtacaacagagagaagctgctggagatgctgagagtgaccgacccctacaacgacctggtgaaggaggagctgaacatcatccagggcgccctggagctgagaaccaagaccgtggaggacgtgatgacccccctgagagactgcttcatgatcaccggcgaggccatcctggacttcaacaccatgagcgagatcatggagagcggctacaccagaatccccgtgttcgagggcgagagaagcaacatcgtggacctgctgttcgtgaaggacctggccttcgtggaccccgacgactgcacccccctgaagaccatcaccaagttctacaaccaccccctgcacttcgtgttcaacgacaccaagctggacgccatgctggaggagttcaagaagggcaagagccacctggccatcgtgcagagagtgaacaacgagggcgagggcgaccccttctacgaggtgctgggcatcgtgaccctggaggacgtgatcgaggagatcatcaagagcgagatcctggacgagaccgacctgtacaccgacaacagaaccaagaagaaggtggcccacagagagagaaagcaggacttcagcgccttcaagcagaccgacagcgagatgaaggtgaagatcagcccccagctgctgctggccatgcacagattcctggccaccgaggtggaggccttcagccccagccagatgagcgagaagatcctgctgagactgctgaagcaccccaacgtgatccaggagctgaagtacgacgagaagaacaagaaggcccccgagtactacctgtaccagagaaacaagcccgtggactacttcgtgctgatcctgcagggcaaggtggaggtggaggccggcaaggagggcatgaagttcgaggccagcgccttcagctactacggcgtgatggccctgaccgccagccccgtgcccctgagcctgagcagaaccttcgtggtgagcagaaccgagctgctggccgccggcagccccggcgagaacaagagcccccccagaccctgcggcctgaaccacagcgacagcctgagcagaagcgacagaatcgacgccgtgacccccaccctgggcagcagcaacaaccagctgaacagcagcctgctgcaggtgtacatccccgactacagcgtgagagccctgagcgacctgcagttcgtgaagatcagcagacagcagtaccagaacgccctgatggccagcagaatggacaagaccccccagagcagcgacagcgagaacaccaagatcgagctgaccctgaccgagctgcacgacggcctgcccgacgagaccgccaacctgctgaacgagcagaactgcgtgacccacagcaaggccaaccacagcctgcacaacgagggcgccatctag

SEQ ID NO: 78025 - DNA, 2565 bp, Artificial Sequence
  Description of Artificial Sequence: Synthetic coding sequence
atgatcggctgcggcgcctgcgagcccaaggtgaagatggccggcggccaggccgccgccgccctgcccacctggaagatggccgccagaagaagcctgagcgccagaggcagaggcatcctgcaggccgccgccggcagactgctgcccctgctgctgctgagctgctgctgcggcgccggcggctgcgccgccgtgggcgagaacgaggagaccgtgatcatcggcctgagactggaggacaccaacgacgtgagcttcatggagggcggcgccctgagagtgagcgagagaaccagagtgaagctgagagtgtacggccagaacatcaacaacgagacctggagcagaatcgccttcaccgagcacgagagaagaagacacagccccggcgagagaggcctgggcggccccgccccccccgagcccgacagcggcccccagagatgcggcatcagaaccagcgacatcatcatcctgccccacatcatcctgaacagaagaaccagcggcatcatcgagatcgagatcaagcccctgagaaagatggagaagagcaagagctactacctgtgcaccagcctgagcacccccgccctgggcgccggcggcagcggcagcaccggcggcgccgtgggcggcaagggcggcagcggcgtggccggcctgcccccccccccctgggccgagaccacctggatctaccacgacggcgaggacaccaagatgatcgtgggcgaggagaagaagttcctgctgcccttctggctgcaggtgatcttcatcagcctgctgctgtgcctgagcggcatgttcagcggcctgaacctgggcctgatggccctggaccccatggagctgagaatcgtgcagaactgcggcaccgagaaggagaagaactacgccaagagaatcgagcccgtgagaagacagggcaactacctgctgtgcagcctgctgctgggcaacgtgctggtgaacaccaccctgaccatcctgctggacgacatcgccggcagcggcctggtggccgtggtggtgagcaccatcggcatcgtgatcttcggcgagatcgtgccccaggccatctgcagcagacacggcctggccgtgggcgccaacaccatcttcctgaccaagttcttcatgatgatgaccttccccgccagctaccccgtgagcaagctgctggactgcgtgctgggccaggagatcggcaccgtgtacaacagagagaagctgctggagatgctgagagtgaccgacccctacaacgacctggtgaaggaggagctgaacatcatccagggcgccctggagctgagaaccaagaccgtggaggacgtgatgacccccctgagagactgcttcatgatcaccggcgaggccatcctggacttcaacaccatgagcgagatcatggagagcggctacaccagaatccccgtgttcgagggcgagagaagcaacatcgtggacctgctgttcgtgaaggacctggccttcgtggaccccgacgactgcacccccctgaagaccatcaccaagttctacaaccaccccctgcacttcgtgttcaacgacaccaagctggacgccatgctggaggagttcaagaagggcaagagccacctggccatcgtgcagagagtgaacaacgagggcgagggcgaccccttctacgaggtgctgggcatcgtgaccctggaggacgtgatcgaggagatcatcaagagcgagatcctggacgagaccgacctgtacaccgacaacagaaccaagaagaaggtggcccacagagagagaaagcaggacttcagcgccttcaagcagaccgacagcgagatgaaggtgaagatcagcccccagctgctgctggccatgcacctggtgttcatcagcatcgaggtggaggccttcagccccagccagatgagcgagaagatcctgctgagactgctgaagcaccccaacgtgatccaggagctgaagtacgacgagaagaacaagaaggcccccgagtactacctgtaccagagaaacaagcccgtggactacttcgtgctgatcctgcagggcaaggtggaggtggaggccggcaaggagggcatgaagttcgaggccagcgccttcagctactacggcgtgatggccctgaccgccagccccggcgagaacaagagcccccccagaccctgcggcctgaaccacagcgacagcctgagcagaagcgacagaatcgacgccgtgacccccaccctgggcagcagcaacaaccagctgaacagcagcctgctgcaggtgtacatccccgactacagcgtgagagccctgagcgacctgcagttcgtgaagatcagcagacagcagtaccagaacgccctgatggccagcagaatggacaagaccccccagagcagcgacagcgagaacaccaagatcgagctgaccctgaccgagctgcacgacggcctgcccgacgagaccgccaacctgctgaacgagcagaactgcgtgacccacagcaaggccaaccacagcctgcacaacgagggcgccatctag

SEQ ID NO: 78026 - DNA, 2631 bp, Artificial Sequence
  Description of Artificial Sequence: Synthetic coding sequence
atgatcggctgcggcgcctgcgagcccaaggtgaagatggccggcggccaggccgccgccgccctgcccacctggaagatggccgccagaagaagcctgagcgccagaggcagaggcatcctgcaggccgccgccggcagactgctgcccctgctgctgctgagctgctgctgcggcgccggcggctgcgccgccgtgggcgagaacgaggagaccgtgatcatcggcctgagactggaggacaccaacgacgtgagcttcatggagggcggcgccctgagagtgagcgagagaaccagagtgaagctgagagtgtacggccagaacatcaacaacgagacctggagcagaatcgccttcaccgagcacgagagaagaagacacagccccggcgagagaggcctgggcggccccgccccccccgagcccgacagcggcccccagagatgcggcatcagaaccagcgacatcatcatcctgccccacatcatcctgaacagaagaaccagcggcatcatcgagatcgagatcaagcccctgagaaagatggagaagagcaagagctactacctgtgcaccagcctgagcacccccgccctgggcgccggcggcagcggcagcaccggcggcgccgtgggcggcaagggcggcagcggcgtggccggcctgcccccccccccctgggccgagaccacctggatctaccacgacggcgaggacaccaagatgatcgtgggcgaggagaagaagttcctgctgcccttctggctgcaggtgatcttcatcagcctgctgctgtgcctgagcggcatgttcagcggcctgaacctgggcctgatggccctggaccccatggagctgagaatcgtgcagaactgcggcaccgagaaggagaagaactacgccaagagaatcgagcccgtgagaagacagggcaactacctgctgtgcagcctgctgctgggcaacgtgctggtgaacaccaccctgaccatcctgctggacgacatcgccggcagcggcctggtggccgtggtggtgagcaccatcggcatcgtgatcttcggcgagatcgtgccccaggccatctgcagcagacacggcctggccgtgggcgccaacaccatcttcctgaccaagttcttcatgatgatgaccttccccgccagctaccccgtgagcaagctgctggactgcgtgctgggccaggagatcggcaccgtgtacaacagagagaagctgctggagatgctgagagtgaccgacccctacaacgacctggtgaaggaggagctgaacatcatccagggcgccctggagctgagaaccaagaccgtggaggacgtgatgacccccctgagagactgcttcatgatcaccggcgaggccatcctggacttcaacaccatgagcgagatcatggagagcggctacaccagaatccccgtgttcgagggcgagagaagcaacatcgtggacctgctgttcgtgaaggacctggccttcgtggaccccgacgactgcacccccctgaagaccatcaccaagttctacaaccaccccctgcacttcgtgttcaacgacaccaagctggacgccatgctggaggagttcaagaagggcaagagccacctggccatcgtgcagagagtgaacaacgagggcgagggcgaccccttctacgaggtgctgggcatcgtgaccctggaggacgtgatcgaggagatcatcaagagcgagatcctggacgagaccgacctgtacaccgacaacagaaccaagaagaaggtggcccacagagagagaaagcaggacttcagcgccttcaagcagaccgacagcgagatgaaggtgaagatcagcccccagctgctgctggccatgcacctggtgttcatcagcatcgaggtggaggccttcagccccagccagatgagcgagaagatcctgctgagactgctgaagcaccccaacgtgatccaggagctgaagtacgacgagaagaacaagaaggcccccgagtactacctgtaccagagaaacaagcccgtggactacttcgtgctgatcctgcagggcaaggtggaggtggaggccggcaaggagggcatgaagttcgaggccagcgccttcagctactacggcgtgatggccctgaccgccagccccgtgcccctgagcctgagcagaaccttcgtggtgagcagaaccgagctgctggccgccggcagccccggcgagaacaagagcccccccagaccctgcggcctgaaccacagcgacagcctgagcagaagcgacagaatcgacgccgtgacccccaccctgggcagcagcaacaaccagctgaacagcagcctgctgcaggtgtacatccccgactacagcgtgagagccctgagcgacctgcagttcgtgaagatcagcagacagcagtaccagaacgccctgatggccagcagaatggacaagaccccccagagcagcgacagcgagaacaccaagatcgagctgaccctgaccgagctgcacgacggcctgcccgacgagaccgccaacctgctgaacgagcagaactgcgtgacccacagcaaggccaaccacagcctgcacaacgagggcgccatctag

SEQ ID NO: 78027 - DNA, 1725 bp, Artificial Sequence
  Description of Artificial Sequence: Synthetic coding sequence
atgatcggctgcggcgcctgcgagcccaaggtgaagatggccggcggccaggccgccgccgccctgcccacctggaagatggccgccagaagaagcctgagcgccagaggcagaggcatcctgcaggccgccgccggcagactgctgcccctgctgctgctgagctgctgctgcggcgccggcggctgcgccgccgtgggcgagaacgaggagaccgtgatcatcggcctgagactggaggacaccaacgacgtgagcttcatggagggcggcgccctgagagtgagcgagagaaccagagtgaagctgagagtgtacggccagaacatcaacaacgagacctggagcagaatcgccttcaccgagcacgagagaagaagacacagccccggcgagagaggcctgggcggccccgccccccccgagcccgacagcggcccccagagatgcggcatcagaaccagcgacatcatcatcctgccccacatcatcctgaacagaagaaccagcggcatcatcgagatcgagatcaagcccctgagaaagatggagaagagcaagagctactacctgtgcaccagcctgagcacccccgccctgggcgccggcggcagcggcagcaccggcggcgccgtgggcggcaagggcggcagcggcgtggccggcctgcccccccccccctgggccgagaccacctggatctaccacgacggcgaggacaccaagatgatcgtgggcgaggagaagaagttcctgctgcccttctggctgcaggtgatcttcatcagcctgctgctgtgcctgagcggcatgttcagcggcctgaacctgggcctgatggccctggaccccatggagctgagaatcgtgcagaactgcggcaccgagaaggagaagaactacgccaagagaatcgagcccgtgagaagacagggcaactacctgctgtgcagcctgctgctgggcaacgtgctggtgaacaccaccctgaccatcctgctggacgacatcgccggcagcggcctggtggccgtggtggtgagcaccatcggcatcgtgatcttcggcgagatcgtgccccaggccatctgcagcagacacggcctggccgtgggcgccaacaccatcttcctgaccaagttcttcatgatgatgaccttccccgccagctaccccgtgagcaagctgctggactgcgtgctgggccaggagatcggcaccgtgtacaacagagagaagctgctggagatgctgagagtgaccgacccctacaacgacctggtgaaggaggagctgaacatcatccagggcgccctggagctgagaaccaagaccgtggaggacgtgatgacccccctgagagactgcttcatgatcaccggcgaggccatcctggacttcaacaccatgagcgagatcatggagagcggctacaccagaatccccgtgttcgagggcgagagaagcaacatcgtggacctgctgttcgtgaaggacctggccttcgtggaccccgacgactgcacccccctgaagaccatcaccaagttctacaaccaccccctgcacttcgtgttcaacgacaccaagctggacgccatgctggaggagttcaagaaggagcacaccaacaagaagcccaagagctaccagcactgcaacgagcagaactgcgtgacccacagcaaggccaaccacagcctgcacaacgagggcgccatctag

SEQ ID NO: 78028 - DNA, 2124 bp, Artificial Sequence
  Description of Artificial Sequence: Synthetic coding sequence
atggccgccgccgtggccgccgccggcagactgggctggctgttcgccgccctgtgcctgggcaacgccgccggcgaggccgcccccggccccagagtgctgggcttctgcctggaggaggacggcgccgccggcgccggctgggtgagaggcggcgccgccagagacacccccgacgccaccttcctgctgagactgttcggccccggcttcgccaacagcagctggagctgggtggcccccgagggcgccggctgcagagaggaggccgccagccccgccggcgagtggagagccctgctgagactgagactgagagccgaggccgtgagaccccacagcgccctgctggccgtgagagtggagcccggcggcggcgccgccgaggaggccgcccccccctgggccctgggcctgggcgccgccggcctgctggccctggccgccctggccagaggcctgcagctgagcgccctggccctggcccccgccgaggtgcaggtgctgagagagagcggcagcgaggccgagagagccgccgccagaagactggagcccgccagaagatgggccggctgcgccctgggcgccctgctgctgctggccagcctggcccaggccgccctggccgtgctgctgtacagagccgccggccagagagccgtgcccgccgtgctgggcagcgccggcctggtgttcctggtgggcgaggtggtgcccgccgccgtgagcggcagatggaccctggccctggcccccagagccctgggcctgagcagactggccgtgctgctgaccctgcccgtggccctgcccgtgggccagctgctggagctggccgccagacccggcagactgagagagagagtgctggagctggccagaggcggcggcgacccctacagcgacctgagcaagggcgtgctgagatgcagaaccgtggaggacgtgctgacccccctggaggactgcttcatgctggacgccagcaccgtgctggacttcggcgtgctggccagcatcatgcagagcggccacaccagaatccccgtgtacgaggaggagagaagcaacatcgtggacatgctgtacctgaaggacctggccttcgtggaccccgaggactgcacccccctgagcaccatcaccagattctacaaccaccccctgcacttcgtgttcaacgacaccaagctggacgccgtgctggaggagttcaagagaggcaagagccacctggccatcgtgcagaaggtgaacaacgagggcgagggcgaccccttctacgaggtgctgggcctggtgaccctggaggacgtgatcgaggagatcatcagaagcgagatcctggacgagagcgaggactacagagacaccgtggtgaagagaaagcccgccagcctgatggcccccctgaagagaaaggaggagttcagcctgttcaaggtgagcgacgacgagtacaaggtgaccatcagcccccagctgctgctggccacccagagattcctgagcagagaggtggacgtgttcagccccctgagaatcagcgagaaggtgctgctgcacctgctgaagcaccccagcgtgaaccaggaggtgagattcgacgagagcaacagactggccacccaccactacctgtaccagagaagccagcccgtggactacttcatcctgatcctgcagggcagagtggaggtggagatcggcaaggagggcctgaagttcgagaacggcgccttcacctactacggcgtgagcgccctgaccgtgcccagcagcgtgcaccagagccccgtgagcagcctgcagcccatcagacacgacctgcagcccgaccccggcgacggcacccacagcagcgcctactgccccgactacaccgtgagagccctgagcgacctgcagctgatcaaggtgaccagactgcagtacctgaacgccctgctggccaccagagcccagaacctgccccagagccccgagaacaccgacctgcaggtgatccccggcagccagaccagactgctgggcgagaagaccaccaccgccgccggcagcagccacagcagacccggcgtgcccgtggagggcagccccggcagaaaccccggcgtgtag

SEQ ID NO: 78029 - DNA, 1980 bp, Artificial Sequence
  Description of Artificial Sequence: Synthetic coding sequence
atggccgccgccgtggccgccgccggcagactgggctggctgttcgccgccctgtgcctgggcaacgccgccggcgaggccgcccccggccccagagtgctgggcttctgcctggaggaggacggcgccgccggcgccggctgggtgagaggcggcgccgccagagacacccccgacgccaccttcctgctgagactgttcggccccggcttcgccaacagcagctggagctgggtggcccccgagggcgccggctgcagagaggaggccgccagccccgccggcgagtggagagccctgctgagactgagactgagagccgaggccgtgagaccccacagcgccctgctggccgtgagagtggagcccggcggcggcgccgccgaggaggccgcccccccctgggccctgggcctgggcgccgccggcctgctggccctggccgccctggccagaggcctgcagctgagcgccctggccctggcccccgccgaggtgcaggtgctgagagagagcggcagcgaggccgagagagccgccgccagaagactggagcccgccagaagatgggccggctgcgccctgggcgccctgctgctgctggccagcctggcccaggccgccctggccgtgctgctgtacagagccgccggccagagagccgtgcccgccgtgctgggcagcgccggcctggtgttcctggtgggcgaggtggtgcccgccgccgtgagcggcagatggaccctggccctggcccccagagccctgggcctgagcagactggccgtgctgctgaccctgcccgtggccctgcccgtgggccagctgctggagctggccgccagacccggcagactgagagagagagtgctggagctggccagaggcggcggcgacccctacagcgacctgagcaagggcgtgctgagatgcagaaccgtggaggacgtgctgacccccctggaggactgcttcatgctggacgccagcaccgtgctggacttcggcgtgctggccagcatcatgcagagcggccacaccagaatccccgtgtacgaggaggagagaagcaacatcgtggacatgctgtacctgaaggacctggccttcgtggaccccgaggactgcacccccctgagcaccatcaccagattctacaaccaccccctgcacttcgtgttcaacgacaccaagctggacgccgtgctggaggagttcaagagaggcgacaccgtggtgaagagaaagcccgccagcctgatggcccccctgaagagaaaggaggagttcagcctgttcaaggtgagcgacgacgagtacaaggtgaccatcagcccccagctgctgctggccacccagagattcctgagcagagaggtggacgtgttcagccccctgagaatcagcgagaaggtgctgctgcacctgctgaagcaccccagcgtgaaccaggaggtgagattcgacgagagcaacagactggccacccaccactacctgtaccagagaagccagcccgtggactacttcatcctgatcctgcagggcagagtggaggtggagatcggcaaggagggcctgaagttcgagaacggcgccttcacctactacggcgtgagcgccctgaccgtgcccagcagcgtgcaccagagccccgtgagcagcctgcagcccatcagacacgacctgcagcccgaccccggcgacggcacccacagcagcgcctactgccccgactacaccgtgagagccctgagcgacctgcagctgatcaaggtgaccagactgcagtacctgaacgccctgctggccaccagagcccagaacctgccccagagccccgagaacaccgacctgcaggtgatccccggcagccagaccagactgctgggcgagaagaccaccaccgccgccggcagcagccacagcagacccggcgtgcccgtggagggcagccccggcagaaaccccggcgtgtag

SEQ ID NO: 78030 - DNA, 2043 bp, Artificial Sequence
  Description of Artificial Sequence: Synthetic coding sequence
atggccgccgccgtggccgccgccggcagactgggctggctgttcgccgccctgtgcctgggcaacgccgccggcgaggccgcccccggccccagagtgctgggcttctgcctggaggaggacggcgccgccggcgccggctgggtgagaggcggcgccgccagagacacccccgacgccaccttcctgctgagactgttcggccccggcttcgccaacagcagctggagctgggtggcccccgagggcgccggctgcagagaggaggccgccagccccgccggcgagtggagagccctgctgagactgagactgagagccgaggccgtgagaccccacagcgccctgctggccgtgagagtggagcccggcggcggcgccgccgaggaggccgcccccccctgggccctgggcctgggcgccgccggcctgctggccctggccgccctggccagaggcctgcagctgagcgccctggccctggcccccgccgaggtgcaggtgctgagagagagcggcagcgaggccgagagagccgccgccagaagactggagcccgccagaagatgggccggctgcgccctgggcgccctgctgctgctggccagcctggcccaggccgccctggccgtgctgctgtacagagccgccggccagagagccgtgcccgccgtgctgggcagcgccggcctggtgttcctggtgggcgaggtggtgcccgccgccgtgagcggcagatggaccctggccctggcccccagagccctgggcctgagcagactggccgtgctgctgaccctgcccgtggccctgcccgtgggccagctgctggagctggccgccagacccggcagactgagagagagagtgctggagctggccagaggcggcggcgacccctacagcgacctgagcaagggcgtgctgagatgcagaaccgtggaggacgtgctgacccccctggaggactgcttcatgctggacgccagcaccgtgctggacttcggcgtgctggccagcatcatgcagagcggccacaccagaatccccgtgtacgaggaggagagaagcaacatcgtggacatgctgtacctgaaggacctggccttcgtggaccccgaggactgcacccccctgagcaccatcaccagattctacaaccaccccctgcacttcgtgttcaacgacaccaagctggacgccgtgctggaggagttcaagagaggcgacaccgtggtgaagagaaagcccgccagcctgatggcccccctgaagagaaaggaggagttcagcctgttcaaggtgagcgacgacgagtacaaggtgaccatcagcccccagctgctgctggccacccagagattcctgagcagagaggtggacgtgttcagccccctgagaatcagcgagaaggtgctgctgcacctgctgaagcaccccagcgtgaaccaggaggtgagattcgacgagagcaacagactggccacccaccactacctgtaccagagaagccagcccgtggactacttcatcctgatcctgcagggcagagtggaggtggagatcggcaaggagggcctgaagttcgagaacggcgccttcacctactacggcgtgagcgccctgaccgtgcccagcagcgtgcaccagagccccgtgagcagcctgcagcccatcagacacgacctgcagcccgaccccggcgacggcacccacagcagcgcctactgccccgactacaccgtgagagccctgagcgacctgcagctgatcaaggtgaccagactgcagtacctgaacgccctgctggccaccagagcccagaacctgccccagagccccgagaacaccgacctgcaggtgatccccggcagccagaccagactgctgggcgagaagaccaccaccgccgccggcagcagccacagcagacccagcctgcccctgctgcccagaggcagagacagcgccgcctacagcgacagcgacctgttcggcctgagccacctggtgagcgccgtgaccgccttcgtgtggccctag

SEQ ID NO: 78031 - DNA, 2328 bp, Artificial Sequence
  Description of Artificial Sequence: Synthetic coding sequence
atggcccccgtgggcggcggcggcagacccgtgggcggccccgccagaggcagactgctgctggccgcccccgtgctgctggtgctgctgtgggccctgggcgccagaggccagggcagcccccagcagggcaccatcgtgggcatgagactggccagctgcaacaagagctgcggcaccaaccccgacggcatcatcttcgtgagcgagggcagcaccgtgaacctgagactgtacggctacagcctgggcaacatcagcagcaacctgatcagcttcaccgaggtggacgacgccgagaccctgcacaagagcaccagctgcctggagctgaccaaggacctggtggtgcagcagctggtgaacgtgagcagaggcaacaccagcggcgtgctggtggtgctgaccaagttcctgagaagaagcgagagcatgaagctgtacgccctgtgcaccagagcccagcccgacggcccctggctgaagtggaccgacaaggacagcctgctgttcatggtggaggagcccggcagattcctgcccctgtggctgcacatcctgctgatcaccgtgctgctggtgctgagcggcatcttcagcggcctgaacctgggcctgatggccctggaccccatggagctgagaatcgtgcagaactgcggcaccgagaaggagagaagatacgccagaaagatcgagcccatcagaagaaagggcaactacctgctgtgcagcctgctgctgggcaacgtgctggtgaacaccagcctgaccatcctgctggacaacctgatcggcagcggcctgatggccgtggccagcagcaccatcggcatcgtgatcttcggcgagatcctgccccaggccctgtgcagcagacacggcctggccgtgggcgccaacaccatcctgctgaccaagttcttcatgctgctgaccttccccctgagcttccccatcagcaagctgctggacttcttcctgggccaggagatcagaaccgtgtacaacagagagaagctgatggagatgctgaaggtgaccgagccctacaacgacctggtgaaggaggagctgaacatgatccagggcgccctggagctgagaaccaagaccgtggaggacatcatgacccagctgcaggactgcttcatgatcagaagcgacgccatcctggacttcaacaccatgagcgagatcatggagagcggctacaccagaatccccgtgttcgaggacgagcagagcaacatcgtggacatcctgtacgtgaaggacctggccttcgtggaccccgacgactgcacccccctgaagaccatcaccagattctacaaccaccccgtgcacttcgtgttccacgacaccaagctggacgccatgctggaggagttcaagaagggcaagagccacctggccatcgtgcagaaggtgaacaacgagggcgagggcgaccccttctacgaggtgctgggcctggtgaccctggaggacgtgatcgaggagatcatcaagagcgagatcctggacgagagcgacatgtacaccgacaacagaagcagaaagagagtgagcgagaagaacaagagagacttcagcgccttcaaggacgccgacaacgagctgaaggtgaagatcagcccccagctgctgctggccgcccacagattcctggccaccgaggtgagccagttcagccccagcctgatcagcgagaagatcctgctgagactgctgaagtaccccgacgtgatccaggagctgaagttcgacgagcacaacaagtactacgccagacactacctgtacaccagaaacaagcccgccgactacttcatcctgatcctgcagggcaaggtggaggtggaggccggcaaggagaacatgaagttcgagaccggcgccttcagctactacggcaccatggccctgaccagcgtgcccagcgacagaagccccgcccaccccacccccctgagcagaagcgccagcctgagctaccccgacagaaccgacgtgagcaccgccgccaccctggccggcagcagcaaccagttcggcagcagcgtgctgggccagtacatcagcgacttcagcgtgagagccctggtggacctgcagtacatcaagatcaccagacagcagtaccagaacggcctgctggccagcagaatggagaacagcccccagttccccatcgacggctgcaccacccacatggagaacctggccgagaagagcgagctgcccgtggtggacgagaccaccaccctgctgaacgagagaaacagcctgctgcacaaggccagccacgagaacgccatctag

SEQ ID NO: 78032 - DNA, 792 bp, Artificial Sequence
  Description of Artificial Sequence: Synthetic coding sequence
atgtacaccgacaacagaagcagaaagagagtgagcgagaagaacaagagagacttcagcgccttcaaggacgccgacaacgagctgaaggtgaagatcagcccccagctgctgctggccgcccacagattcctggccaccgaggtgagccagttcagccccagcctgatcagcgagaagatcctgctgagactgctgaagtaccccgacgtgatccaggagctgaagttcgacgagcacaacaagtactacgccagacactacctgtacaccagaaacaagcccgccgactacttcatcctgatcctgcagggcaaggtggaggtggaggccggcaaggagaacatgaagttcgagaccggcgccttcagctactacggcaccatggccctgaccagcgtgcccagcgacagaagccccgcccaccccacccccctgagcagaagcgccagcctgagctaccccgacagaaccgacgtgagcaccgccgccaccctggccggcagcagcaaccagttcggcagcagcgtgctgggccagtacatcagcgacttcagcgtgagagccctggtggacctgcagtacatcaagccccagagctggccctgcttcagcagacccggcgacagagtgtgcctgcccgccccccccagcatgaacagcagcctgccccacgccgaccacagcgccgccgtgcccgagagagccgccggcttcagccacggcgagcagcccagcgtgagccacagaagagtgcaccacccccacggcgagctgggcagagaggtgtag

SEQ ID NO: 78033 - DNA, 2193 bp, Artificial Sequence
  Description of Artificial Sequence: Synthetic coding sequence
atggccagcggcagaggcgccagcagcagatggttcttcaccagagagcagctggagaacacccccagcagaagatgcggcgtggaggccgacaaggagctgagctgcagacagcaggccgccaacctgatccaggagatgggccagagactgaacgtgagccagctgaccatcaacaccgccatcgtgtacatgcacagattctacatgcaccacagcttcaccaagttcaacaagaacatcatcagcagcaccgccctgttcctggccgccaaggtggaggagcaggccagaaagctggagcacgtgatcaaggtggcccacgcctgcctgcaccccctggagcccctgctggacaccaagtgcgacgcctacctgcagcagacccaggagctggtgatcctggagaccatcatgctgcagaccctgggcttcgagatcaccatcgagcacccccacaccgacgtggtgaagtgcacccagctggtgagagccagcaaggacctggcccagaccagctacttcatggccaccaacagcctgcacctgaccaccttctgcctgcagtacaagcccaccgtgatcgcctgcgtgtgcatccacctggcctgcaagtggagcaactgggagatccccgtgagcaccgacggcaagcactggtgggagtacgtggaccccaccgtgaccctggagctgctggacgagctgacccacgagttcctgcagatcctggagaagacccccaacagactgaagaagatcagaaactggagagccaaccaggccgccagaaagcccaaggtggacggccaggtgagcgagacccccctgctgggcagcagcctggtgcagaacagcatcctggtggacagcgtgaccggcgtgcccaccaaccccagcttccagaagcccagcaccagcgccttccccgcccccgtgcccctgaacagcggcaacatcagcgtgcaggacagccacaccagcgacaacctgagcatgctggccaccggcatgcccagcaccagctacggcctgagcagccaccaggagtggccccagcaccaggacagcgccagaaccgagcagctgtacagccagaagcaggagaccagcctgagcggcagccagtacaacatcaacttccagcagggccccagcatcagcctgcacagcggcctgcaccacagacccgacaagatcagcgaccacagcagcgtgaagcaggagtacacccacaaggccggcagcagcaagcaccacggccccatcagcaccacccccggcatcatcccccagaagatgagcctggacaagtacagagagaagagaaagctggagaccctggacctggacgtgagagaccactacatcgccgcccaggtggagcagcagcacaagcagggccagagccaggccgccagcagcagcagcgtgaccagccccatcaagatgaagatccccatcgccaacaccgagaagtacatggccgacaagaaggagaagagcggcagcctgaagctgagaatccccatcccccccaccgacaagagcgccagcaaggaggagctgaagatgaagatcaaggtgagcagcagcgagagacacagcagcagcgacgagggcagcggcaagagcaagcacagcagcccccacatcagcagagaccacaaggagaagcacaaggagcaccccagcagcagacaccacaccagcagccacaagcacagccacagccacagcggcagcagcagcggcggcagcaagcacagcgccgacggcatcccccccaccgtgctgagaagccccgtgggcctgagcagcgacggcatcagcagcagcagcagcagcagcagaaagagactgcacgtgaacgacgccagccacaaccaccacagcaagatgagcaagagcagcaagagcagcggcagcagcagcagcagcagcagcagcgtgaagcagtacatcagcagccacaacagcgtgttcaaccaccccctgcccccccccccccccgtgacctaccaggtgggctacggccacctgagcaccctggtgaagctggacaagaagcccgtggagaccaacggccccgacgccaaccacgagtacagcaccagcagccagcacatggactacaaggacaccttcgacatgctggacagcctgctgagcgcccagggcatgaacatgtag

SEQ ID NO: 78034 - DNA, 1992 bp, Artificial Sequence
  Description of Artificial Sequence: Synthetic coding sequence
atggccagcggcagaggcgccagcagcagatggttcttcaccagagagcagctggagaacacccccagcagaagatgcggcgtggaggccgacaaggagctgagctgcagacagcaggccgccaacctgatccaggagatgggccagagactgaacgtgagccagctgaccatcaacaccgccatcgtgtacatgcacagattctacatgcaccacagcttcaccaagttcaacaagaacatcatcagcagcaccgccctgttcctggccgccaaggtggaggagcaggccagaaagctggagcacgtgatcaaggtggcccacgcctgcctgcaccccctggagcccctgctggacaccaagtgcgacgcctacctgcagcagacccaggagctggtgatcctggagaccatcatgctgcagaccctgggcttcgagatcaccatcgagcacccccacaccgacgtggtgaagtgcacccagctggtgagagccagcaaggacctggcccagaccagctacttcatggccaccaacagcctgcacctgaccaccttctgcctgcagtacaagcccaccgtgatcgcctgcgtgtgcatccacctggcctgcaagtggagcaactgggagatccccgtgagcaccgacggcaagcactggtgggagtacgtggaccccaccgtgaccctggagctgctggacgagctgacccacgagttcctgcagatcctggagaagacccccaacagactgaagaagatcagaaactggagagccaaccaggccgccagaaagcccaaggtggacggccaggtgagcgagacccccctgctgggcagcagcctggtgcagaacagcatcctggtggacagcgtgaccggcgtgcccaccaaccccagcttccagaagcccagcaccagcgccttccccgcccccgtgcccctgaacagcggcaacatcagcgtgcaggacagccacaccagcgacaacctgagcatgctggccaccggcatgcccagcaccagctacggcctgagcagccaccaggagtggccccagcaccaggacagcgccagaaccgagcagctgtacagccagaagcaggagaccagcctgagcggcagccagtacaacatcaacttccagcagggccccagcatcagcctgcacagcggcctgcaccacagacccgacaagatcagcgaccacagcagcgtgaagcaggagtacacccacaaggccggcagcagcaagcaccacggccccatcagcaccacccccggcatcatcccccagaagatgagcctggacaagtacagagagaagagaaagctggagaccctggacctggacgtgagagaccactacatcgccgcccaggtggagcagcagcacaagcagggccagagccaggccgccagcagcagcagcgtgaccagccccatcaagatgaagatccccatcgccaacaccgagaagtacatggccgacaagaaggagaagagcggcagcctgaagctgagaatccccatcccccccaccgacaagagcgccagcaaggaggagctgaagatgaagatcaaggtgagcagcagcgagagacacagcagcagcgacgagggcagcggcaagagcaagcacagcagcccccacatcagcagagaccacaaggagaagcacaaggagcaccccagcagcagacaccacaccagcagccacaagcacagccacagccacagcggcagcagcagcggcggcagcaagcacagcgccgacggcatcccccccaccgtgctgagaagccccgtgggcctgagcagcgacggcatcagcagcagcagcagcagcagcagaaagagactgcacgtgaacgacgccagccacaaccaccacagcaagatgagcaagagcagcaagagcagcggcggcctgagaaccagccagcaccccagagagaccggccaggaggccagcggcgaccagagaagctag

SEQ ID NO: 78035 - DNA, 1467 bp, Artificial Sequence
  Description of Artificial Sequence: Synthetic coding sequence
atggccaccaacagcctgcacctgaccaccttctgcctgcagtacaagcccaccgtgatcgcctgcgtgtgcatccacctggcctgcaagtggagcaactgggagatccccgtgagcaccgacggcaagcactggtgggagtacgtggaccccaccgtgaccctggagctgctggacgagctgacccacgagttcctgcagatcctggagaagacccccaacagactgaagaagatcagaaactggagagccaaccaggccgccagaaagcccaaggtggacggccaggtgagcgagacccccctgctgggcagcagcctggtgcagaacagcatcctggtggacagcgtgaccggcgtgcccaccaaccccagcttccagaagcccagcaccagcgccttccccgcccccgtgcccctgaacagcggcaacatcagcgtgcaggacagccacaccagcgacaacctgagcatgctggccaccggcatgcccagcaccagctacggcctgagcagccaccaggagtggccccagcaccaggacagcgccagaaccgagcagctgtacagccagaagcaggagaccagcctgagcggcagccagtacaacatcaacttccagcagggccccagcatcagcctgcacagcggcctgcaccacagacccgacaagatcagcgaccacagcagcgtgaagcaggagtacacccacaaggccggcagcagcaagcaccacggccccatcagcaccacccccggcatcatcccccagaagatgagcctggacaagtacagagagaagagaaagctggagaccctggacctggacgtgagagaccactacatcgccgcccaggtggagcagcagcacaagcagggccagagccaggccgccagcagcagcagcgtgaccagccccatcaagatgaagatccccatcgccaacaccgagaagtacatggccgacaagaaggagaagagcggcagcctgaagctgagaatccccatcccccccaccgacaagagcgccagcaaggaggagctgaagatgaagatcaaggtgagcagcagcgagagacacagcagcagcgacgagggcagcggcaagagcaagcacagcagcccccacatcagcagagaccacaaggagaagcacaaggagcaccccagcagcagacaccacaccagcagccacaagcacagccacagccacagcggcagcagcagcggcggcagcaagcacagcgccgacggcatcccccccaccgtgctgagaagccccgtgggcctgagcagcgacggcatcagcagcagcagcagcagcagcagaaagagactgcacgtgaacgacgccagccacaaccaccacagcaagatgagcaagagcagcaagagcagcggcggcctgagaaccagccagcaccccagagagaccggccaggaggccagcggcgaccagagaagctag

SEQ ID NO: 78036 - DNA, 864 bp, Artificial Sequence
  Description of Artificial Sequence: Synthetic coding sequence
atggagttcaaccccagcgaccaccccagagccagcaccatcttcctgagcaagagccagaccgacgtgagagagaagagaaagagcctgttcatcaaccaccacccccccggccagatcgccagaaagtacagcagctgcagcaccatcttcctggacgacagcaccgtgagccagcccaacctgaagtacaccatcaagtgcgtggccctggccatctactaccacatcaagaacagagaccccgacggcagaatgctgctggacatcttcgacgagaacctgcaccccctgagcaagagcgaggtgccccccgactacgacaagcacaaccccgagcagaagcagatctacagattcgtgagaaccctgttcagcgccgcccagctgaccgccgagtgcgccatcgtgaccctggtgtacctggagagactgctgacctacgccgagatcgacatctgccccgccaactggaagagaatcgtgctgggcgccatcctgctggccagcaaggtgtgggacgaccaggccgtgtggaacgtggactactgccagatcctgaaggacatcaccgtggaggacatgaacgagctggagagacagttcctggagctgctgcagttcaacatcaacgtgcccagcagcgtgtacgccaagtactacttcgacctgagaagcctggccgaggccaacaacctgagcttccccctggagcccctgagcagagagagagcccacaagctggaggccatcagcagactgtgcgaggacaagtacaaggacctgagaagaagcgccagaaagagaagcgccagcgccgacaacctgaccctgcccagatggagccccgccatcatcagctag

SEQ ID NO: 78037 - DNA, 951 bp, Artificial Sequence
  Description of Artificial Sequence: Synthetic coding sequence
atgggcaacaccaccagctgctgcgtgagcagcagccccaagctgagaagaaacgcccacagcagactggagagctacagacccgacaccgacctgagcagagaggacaccggctgcaacctgcagcacatcagcgacagagagaacatcgacgtgagagagaagagaaagagcctgttcatcaaccaccacccccccggccagatcgccagaaagtacagcagctgcagcaccatcttcctggacgacagcaccgtgagccagcccaacctgaagtacaccatcaagtgcgtggccctggccatctactaccacatcaagaacagagaccccgacggcagaatgctgctggacatcttcgacgagaacctgcaccccctgagcaagagcgaggtgccccccgactacgacaagcacaaccccgagcagaagcagatctacagattcgtgagaaccctgttcagcgccgcccagctgaccgccgagtgcgccatcgtgaccctggtgtacctggagagactgctgacctacgccgagatcgacatctgccccgccaactggaagagaatcgtgctgggcgccatcctgctggccagcaaggtgtgggacgaccaggccgtgtggaacgtggactactgccagatcctgaaggacatcaccgtggaggacatgaacgagctggagagacagttcctggagctgctgcagttcaacatcaacgtgcccagcagcgtgtacgccaagtactacttcgacctgagaagcctggccgaggccaacaacctgagcttccccctggagcccctgagcagagagagagcccacaagctggaggccatcagcagactgtgcgaggacaagtacaaggacctgagaagaagcgccagaaagagaagcgccagcgccgacaacctgaccctgcccagatggagccccgccatcatcagctag

SEQ ID NO: 78038 - DNA, 1026 bp, Artificial Sequence
  Description of Artificial Sequence: Synthetic coding sequence
atgggcaacaccaccagctgctgcgtgagcagcagccccaagctgagaagaaacgcccacagcagactggagagctacagacccgacaccgacctgagcagagaggacaccggctgcaacctgcagcacatcagcgacagagagaacatcgacgacctgaacatggagttcaaccccagcgaccaccccagagccagcaccatcttcctgagcaagagccagaccgacgtgagagagaagagaaagagcctgttcatcaaccaccacccccccggccagatcgccagaaagtacagcagctgcagcaccatcttcctggacgacagcaccgtgagccagcccaacctgaagtacaccatcaagtgcgtggccctggccatctactaccacatcaagaacagagaccccgacggcagaatgctgctggacatcttcgacgagaacctgcaccccctgagcaagagcgaggtgccccccgactacgacaagcacaaccccgagcagaagcagatctacagattcgtgagaaccctgttcagcgccgcccagctgaccgccgagtgcgccatcgtgaccctggtgtacctggagagactgctgacctacgccgagatcgacatctgccccgccaactggaagagaatcgtgctgggcgccatcctgctggccagcaaggtgtgggacgaccaggccgtgtggaacgtggactactgccagatcctgaaggacatcaccgtggaggacatgaacgagctggagagacagttcctggagctgctgcagttcaacatcaacgtgcccagcagcgtgtacgccaagtactacttcgacctgagaagcctggccgaggccaacaacctgagcttccccctggagcccctgagcagagagagagcccacaagctggaggccatcagcagactgtgcgaggacaagtacaaggacctgagaagaagcgccagaaagagaagcgccagcgccgacaacctgaccctgcccagatggagccccgccatcatcagctag

SEQ ID NO: 78039 - DNA, 864 bp, Artificial Sequence; identical to SEQ ID NO: 78036
  Description of Artificial Sequence: Synthetic coding sequence

SEQ ID NO: 78040 - DNA, 627 bp, Artificial Sequence
  Description of Artificial Sequence: Synthetic coding sequence
atggaccccgacggcagaatgctgctggacatcttcgacgagaacctgcaccccctgagcaagagcgaggtgccccccgactacgacaagcacaaccccgagcagaagcagatctacagattcgtgagaaccctgttcagcgccgcccagctgaccgccgagtgcgccatcgtgaccctggtgtacctggagagactgctgacctacgccgagatcgacatctgccccgccaactggaagagaatcgtgctgggcgccatcctgctggccagcaaggtgtgggacgaccaggccgtgtggaacgtggactactgccagatcctgaaggacatcaccgtggaggacatgaacgagctggagagacagttcctggagctgctgcagttcaacatcaacgtgcccagcagcgtgtacgccaagtactacttcgacctgagaagcctggccgaggccaacaacctgagcttccccctggagcccctgagcagagagagagcccacaagctggaggccatcagcagactgtgcgaggacaagtacaaggacctgagaagaagcgccagaaagagaagcgccagcgccgacaacctgaccctgcccagatggagccccgccatcatcagctag

SEQ ID NO: 78041 - DNA, 1026 bp, Artificial Sequence; identical to SEQ ID NO: 78038
  Description of Artificial Sequence: Synthetic coding sequence

SEQ ID NO: 78042 - DNA, 942 bp, Artificial Sequence
  Description of Artificial Sequence: Synthetic coding sequence
atggagcccatgtaccaggacagagccagagacacccagaccgacgagatcgtggccctgaagaaggtgagaatggacaaggagaaggacggcatccccatcagcagcctgagagagatcaccctgctgctgagactgagacaccccaacatcgtggagctgaaggaggtggtggtgggcaaccacctggagagcatcttcctggtgatgggctactgcgagcaggacctggccagcctgctggagaacatgcccacccccttcagcgaggcccaggtgaagtgcatcgtgctgcaggtgctgagaggcctgcagtacctgcacagaaacttcatcatccacagagacctgaaggtgagcaacctgctgatgaccgacaagggctgcgtgaagaccgccgacttcggcctggccagagcctacggcgtgcccgtgaagcccatgacccccaaggtggtgaccctgtggtacagagcccccgagctgctgctgggcaccaccacccagaccaccagcatcgacatgtgggccgtgggctgcatcctggccgagctgctggcccacagacccctgctgcccggcaccagcgagatccaccagatcgacctgatcgtgcagctgctgggcacccccagcgagaacatctggcccggcttcagcaagctgcccctggtgggccagtacagcctgagaaagcagccctacaacaacctgaagcacaagttcccctggctgagcgaggccggcctgagactgctgcacttcctgttcatgtacgaccccaagaagagagccaccgccggcgactgcctggagagcagctacttcaaggagaagcccctgccctgcgagcccgagctgatgcccaccttcccccaccacagaaacaagagagccgcccccgccaccagcgagggccagagcaagagatgcaagccctag

SEQ ID NO: 78043 - DNA, 1083 bp, Artificial Sequence
  Description of Artificial Sequence: Synthetic coding sequence
atggccgagcccgacctggagtgcgagcagatcagactgaagtgcatcagaaaggagggcttcttcaccgtgccccccgagcacagactgggcagatgcagaagcgtgaaggagttcgagaagctgaacagaatcggcgagggcacctacggcatcgtgtacagagccagagacacccagaccgacgagatcgtggccctgaagaaggtgagaatggacaaggagaaggacggcatccccatcagcagcctgagagagatcaccctgctgctgagactgagacaccccaacatcgtggagctgaaggaggtggtggtgggcaaccacctggagagcatcttcctggtgatgggctactgcgagcaggacctggccagcctgctggagaacatgcccacccccttcagcgaggcccaggtgaagtgcatcgtgctgcaggtgctgagaggcctgcagtacctgcacagaaacttcatcatccacagagacctgaaggtgagcaacctgctgatgaccgacaagggctgcgtgaagaccgccgacttcggcctggccagagcctacggcgtgcccgtgaagcccatgacccccaaggtggtgaccctgtggtacagagcccccgagctgctgctgggcaccaccacccagaccaccagcatcgacatgtgggccgtgggctgcatcctggccgagctgctggcccacagacccctgctgcccggcaccagcgagatccaccagatcgacctgatcgtgcagctgctgggcacccccagcgagaacatctggcccggcttcagcaagctgcccctggtgggccagtacagcctgagaaagcagccctacaacaacctgaagcacaagttcccctggctgagcgaggccggcctgagactgctgcacttcctgttcatgtacgaccccaagaagagagccaccgccggcgactgcctggagagcagctacttcaaggagaagcccctgccctgcgagcccgagctgatgcccaccttcccccaccacagaaacaagagagccgcccccgccaccagcgagggccagagcaagagatgcaagccctag

SEQ ID NO: 78044 - DNA, 819 bp, Artificial Sequence
  Description of Artificial Sequence: Synthetic coding sequence
atggacaaggagaaggacggcatccccatcagcagcctgagagagatcaccctgctgctgagactgagacaccccaacatcgtggagctgaaggaggtggtggtgggcaaccacctggagagcatcttcctggtgatgggctactgcgagcaggacctggccagcctgctggagaacatgcccacccccttcagcgaggcccaggtgaagtgcatcgtgctgcaggtgctgagaggcctgcagtacctgcacagaaacttcatcatccacagagacctgaaggtgagcaacctgctgatgaccgacaagggctgcgtgaagaccgccgacttcggcctggccagagcctacggcgtgcccgtgaagcccatgacccccaaggtggtgaccctgtggtacagagcccccgagctgctgctgggcaccaccacccagaccaccagcatcgacatgtgggccgtgggctgcatcctggccgagctgctggcccacagacccctgctgcccggcaccagcgagatccaccagatcgacctgatcgtgcagctgctgggcacccccagcgagaacatctggcccggcttcagcaagctgcccctggtgggccagtacagcctgagaaagcagccctacaacaacctgaagcacaagttcccctggctgagcgaggccggcctgagactgctgcacttcctgttcatgtacgaccccaagaagagagccaccgccggcgactgcctggagagcagctacttcaaggagaagcccctgagactgcccatcagcggcgtgtgcgagggctgcagagagcccggctag

SEQ ID NO: 78045 - DNA, 504 bp, Artificial Sequence
  Description of Artificial Sequence: Synthetic coding sequence
atgggcaagaccgaggagaagggcaacggcaagggcgccttccaggagagaaagggccccctgggcgccgtgagaaaggaggccggcgccggcgcccaggacgccggcgccgccgagggcgccgccgtgaagaagatgaccttcagcgagcacccctacaacaacctgagaaagagattcggcgccctgctgagcgaccagggcttcgacctgatgaacaagttcctgacctacttccccggcagaagaatcagcgccgaggacggcctgaagcacgagtacttcagagagacccccctgcccatcgaccccagcatgttccccacctggcccgccaagagcgagcagcagagagtgaagagaggcaccagccccagaccccccgagggcggcctgggctacagccagctgggcgacgacgacctgaaggagaccggcttccacctgaccaccaccaaccagggcgccagcgccgccggccccggcttcagcctgaagttctag

SEQ ID NO: 78046 - DNA, 2241 bp, Artificial Sequence
  Description of Artificial Sequence: Synthetic coding sequence
atgagccagagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtgcagacaccacagccacagcgccgagggcggcaagcacgccagagtgaaggagagagagcacgagagaagaaagagacacagagaggagcaggacaaggccagaagagagtgggagagacagaagagaagagagatggccagagagcacagcagaagagagagagacagactggagcagctggagagaaagagagagagagagagaaagatgagagagcagcagaaggagcagagagagcagaaggagagagagagaagagccgaggagagaagaaaggagagagaggccagaagagaggtgagcgcccaccacagaaccatgagagaggactacagcgacaaggtgaaggccagccactggagcagaagcccccccagaccccccagagagagattcgagctgggcgacggcagaaagcccgtgaaggaggagaagatggaggagagagacctgctgagcgacctgcaggacatcagcgacagcgagagaaagaccagcagcgccgagagcagcagcgccgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgccgaggaggtgagcgaggaggagatgagcgaggacgaggagagagagaacgagaaccacctgctggtggtgcccgagagcagattcgacagagacagcggcgagagcgaggaggccgaggaggaggtgggcgagggcaccccccagagcagcgccctgaccgagggcgactacgtgcccgacagccccgccctgctgcccatcgagctgaagcaggagctgcccaagtacctgcccgccctgcagggctgcagaagcgtggaggagttccagtgcctgaacagaatcgaggagggcacctacggcgtggtgtacagagccaaggacaagaagaccgacgagatcgtggccctgaagagactgaagatggagaaggagaaggagggcttccccatcaccagcctgagagagatcaacaccatcctgaaggcccagcaccccaacatcgtgaccgtgagagagatcgtggtgggcagcaacatggacaagatctacatcgtgatgaactacgtggagcacgacctgaagagcctgatggagaccatgaagcagcccttcctgcccggcgaggtgaagaccctgatgatccagctgctgagaggcgtgaagcacctgcacgacaactggatcctgcacagagacctgaagaccagcaacctgctgctgagccacgccggcatcctgaaggtgggcgacttcggcctggccagagagtacggcagccccctgaaggcctacacccccgtggtggtgacccagtggtacagagcccccgagctgctgctgggcgccaaggagtacagcaccgccgtggacatgtggagcgtgggctgcatcttcggcgagctgctgacccagaagcccctgttccccggcaacagcgagatcgaccagatcaacaaggtgttcaaggagctgggcacccccagcgagaagatctggcccggctacagcgagctgcccgtggtgaagaagatgaccttcagcgagcacccctacaacaacctgagaaagagattcggcgccctgctgagcgaccagggcttcgacctgatgaacaagttcctgacctacttccccggcagaagaatcagcgccgaggacggcctgaagcacgagtacttcagagagacccccctgcccatcgaccccagcatgttccccacctggcccgccaagagcgagcagcagagagtgaagagaggcaccagccccagaccccccgagggcggcctgggctacagccagctgggcgacgacgacctgaaggagaccggcttccacctgaccaccaccaaccagggcgccagcgccgccggccccggcttcagcctgaagttctag

SEQ ID NO: 78047 - DNA, 2340 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaacagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtggaagcacgccagagtgaaggagagagagcacgagagaagaaagagacacagagaggagcaggacaaggccagaagagagtgggagagacagaagagaagagagatggccagagagcacagcagaagagagagaggcaacgacggcgtgtgcctgttcagagacagactggagcagctggagagaaagagagagagagagagaaagatgagagagcagcagaaggagcagagagagcagaaggagagagagagaagagccgaggagagaagaaaggagagagaggccagaagagaggtgagcgcccaccacagaaccatgagagaggactacagcgacaaggtgaaggccagccactggagcagaagcccccccagaccccccagagagagattcgagctgggcgacggcagaaagcccgtgaaggaggagaagatggaggagagagacctgctgagcgacctgcaggacatcagcgacagcgagagaaagaccagcagcgccgagagcagcagcgccgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgccgaggaggtgagcgaggaggagatgagcgaggacgaggagagagagaacgagaaccacctgctggtggtgcccgagagcagattcgacagagacagcggcgagagcgaggaggccgaggaggaggtgggcgagggcaccccccagagcagcgccctgaccgagggcgactacgtgcccgacagccccgccctgctgcccatcgagctgaagcaggagctgcccaagtacctgcccgccctgcagggctgcagaagcgtggaggagttccagtgcctgaacagaatcgaggagggcacctacggcgtggtgtacagagccaaggacaagaagaccgacgagatcgtggccctgaagagactgaagatggagaaggagaaggagggcttccccatcaccagcctgagagagatcaacaccatcctgaaggcccagcaccccaacatcgtgaccgtgagagagatcgtggtgggcagcaacatggacaagatctacatcgtgatgaactacgtggagcacgacctgaagagcctgatggagaccatgaagcagcccttcctgcccggcgaggtgaagaccctgatgatccagctgctgagaggcgtgaagcacctgcacgacaactggatcctgcacagagacctgaagaccagcaacctgctgctgagccacgccggcatcctgaaggtgggcgacttcggcctggccagagagtacggcagccccctgaaggcctacacccccgtggtggtgacccagtggtacagagcccccgagctgctgctgggcgccaaggagtacagcaccgccgtggacatgtggagcgtgggctgcatcttcggcgagctgctgacccagaagcccctgttccccggcaacagcgagatcgaccagatcaacaaggtgttcaaggagctgggcacccccagcgagaagatctggcccggctacagcgagctgcccgtggtgaagaagatgaccttcagcgagcacccctacaacaacctgagaaagagattcggcgccctgctgagcgaccagggcttcgacctgatgaacaagttcctgacctacttccccggcagaagaatcagcgccgaggacggcctgaagcacgagtacttcagagagacccccctgcccatcgaccccagcatgttccccacctggcccgccaagagcgagcagcagagagtgaagagaggcaccagccccagaccccccgagggcggcctgggctacagccagctgggcgacgacgacctgaaggagaccggcttccacctgaccaccaccaaccagggcgccagcgccgccggccccggcttcagcctgaagttctag

SEQ ID NO: 78048 - DNA, 2313 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaacagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtggaagcacgccagagtgaaggagagagagcacgagagaagaaagagacacagagaggagcaggacaaggccagaagagagtgggagagacagaagagaagagagatggccagagagcacagcagaagagagagagacagactggagcagctggagagaaagagagagagagagagaaagatgagagagcagcagaaggagcagagagagcagaaggagagagagagaagagccgaggagagaagaaaggagagagaggccagaagagaggtgagcgcccaccacagaaccatgagagaggactacagcgacaaggtgaaggccagccactggagcagaagcccccccagaccccccagagagagattcgagctgggcgacggcagaaagcccgtgaaggaggagaagatggaggagagagacctgctgagcgacctgcaggacatcagcgacagcgagagaaagaccagcagcgccgagagcagcagcgccgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgccgaggaggtgagcgaggaggagatgagcgaggacgaggagagagagaacgagaaccacctgctggtggtgcccgagagcagattcgacagagacagcggcgagagcgaggaggccgaggaggaggtgggcgagggcaccccccagagcagcgccctgaccgagggcgactacgtgcccgacagccccgccctgctgcccatcgagctgaagcaggagctgcccaagtacctgcccgccctgcagggctgcagaagcgtggaggagttccagtgcctgaacagaatcgaggagggcacctacggcgtggtgtacagagccaaggacaagaagaccgacgagatcgtggccctgaagagactgaagatggagaaggagaaggagggcttccccatcaccagcctgagagagatcaacaccatcctgaaggcccagcaccccaacatcgtgaccgtgagagagatcgtggtgggcagcaacatggacaagatctacatcgtgatgaactacgtggagcacgacctgaagagcctgatggagaccatgaagcagcccttcctgcccggcgaggtgaagaccctgatgatccagctgctgagaggcgtgaagcacctgcacgacaactggatcctgcacagagacctgaagaccagcaacctgctgctgagccacgccggcatcctgaaggtgggcgacttcggcctggccagagagtacggcagccccctgaaggcctacacccccgtggtggtgacccagtggtacagagcccccgagctgctgctgggcgccaaggagtacagcaccgccgtggacatgtggagcgtgggctgcatcttcggcgagctgctgacccagaagcccctgttccccggcaacagcgagatcgaccagatcaacaaggtgttcaaggagctgggcacccccagcgagaagatctggcccggctacagcgagctgcccgtggtgaagaagatgaccttcagcgagcacccctacaacaacctgagaaagagattcggcgccctgctgagcgaccagggcttcgacctgatgaacaagttcctgacctacttccccggcagaagaatcagcgccgaggacggcctgaagcacgagtacttcagagagacccccctgcccatcgaccccagcatgttccccacctggcccgccaagagcgagcagcagagagtgaagagaggcaccagccccagaccccccgagggcggcctgggctacagccagctgggcgacgacgacctgaaggagaccggcttccacctgaccaccaccaaccagggcgccagcgccgccggccccggcttcagcctgaagttctag

SEQ ID NO: 78049 - DNA, 2241 bp, Artificial Sequence; identical to SEQ ID NO: 78046
  Description of Artificial Sequence: Synthetic coding sequence

SEQ ID NO: 78050 - DNA, 2352 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaacagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtggaagcacgccagagtgaaggagagagagcacgagagaagaaagagacacagagaggagcaggacaaggccagaagagagtgggagagacagaagagaagagagatggccagagagcacagcagaagagagagagacagactggagcagctggagagaaagagagagagagagagaaagatgagagagcagcagaaggagcagagagagcagaaggagagagagagaagagccgaggagagaagaaaggagagagaggccagaagagaggtgagcgcccaccacagaaccatgagagaggactacagcgacaaggtgaaggccagccactggagcagaagcccccccagaccccccagagagagattcgagctgggcgacggcagaaagcccggcgaggccagacccgcccccgcccagaagcccgcccagctgaaggaggagaagatggaggagagagacctgctgagcgacctgcaggacatcagcgacagcgagagaaagaccagcagcgccgagagcagcagcgccgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgccgaggaggtgagcgaggaggagatgagcgaggacgaggagagagagaacgagaaccacctgctggtggtgcccgagagcagattcgacagagacagcggcgagagcgaggaggccgaggaggaggtgggcgagggcaccccccagagcagcgccctgaccgagggcgactacgtgcccgacagccccgccctgctgcccatcgagctgaagcaggagctgcccaagtacctgcccgccctgcagggctgcagaagcgtggaggagttccagtgcctgaacagaatcgaggagggcacctacggcgtggtgtacagagccaaggacaagaagaccgacgagatcgtggccctgaagagactgaagatggagaaggagaaggagggcttccccatcaccagcctgagagagatcaacaccatcctgaaggcccagcaccccaacatcgtgaccgtgagagagatcgtggtgggcagcaacatggacaagatctacatcgtgatgaactacgtggagcacgacctgaagagcctgatggagaccatgaagcagcccttcctgcccggcgaggtgaagaccctgatgatccagctgctgagaggcgtgaagcacctgcacgacaactggatcctgcacagagacctgaagaccagcaacctgctgctgagccacgccggcatcctgaaggtgggcgacttcggcctggccagagagtacggcagccccctgaaggcctacacccccgtggtggtgacccagtggtacagagcccccgagctgctgctgggcgccaaggagtacagcaccgccgtggacatgtggagcgtgggctgcatcttcggcgagctgctgacccagaagcccctgttccccggcaacagcgagatcgaccagatcaacaaggtgttcaaggagctgggcacccccagcgagaagatctggcccggctacagcgagctgcccgtggtgaagaagatgaccttcagcgagcacccctacaacaacctgagaaagagattcggcgccctgctgagcgaccagggcttcgacctgatgaacaagttcctgacctacttccccggcagaagaatcagcgccgaggacggcctgaagcacgagtacttcagagagacccccctgcccatcgaccccagcatgttccccacctggcccgccaagagcgagcagcagagagtgaagagaggcaccagccccagaccccccgagggcggcctgggctacagccagctgggcgacgacgacctgaaggagaccggcttccacctgaccaccaccaaccagggcgccagcgccgccggccccggcttcagcctgaagttctag

SEQ ID NO: 78051 - DNA, 699 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaacagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtggaagcacgccagagtgaaggagagagagcacgagagaagaaagagacacagagaggagcaggacaaggccagaagagagtgggagagacagaagagaagagagatggccagagagcacagcagaagagagagcgtgtgcaccagccccaacgacgagagaggcctgcagagacagagcgagagccagcccctggagagccagcccgccagcgccgccgccggcgccgtgagagtgggcagaagacccgaggccagcaagagaagagagaacggcagaaagggccccgccgtgagactgaccggccaccagagacagagagaggaggaccagctgggcagagtgctggtgagcggcatcagactgagattctag

SEQ ID NO: 78052 - DNA, 2241 bp, Artificial Sequence; identical to SEQ ID NO: 78046
  Description of Artificial Sequence: Synthetic coding sequence

SEQ ID NO: 78053 - DNA, 114 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaactag

SEQ ID NO: 78054 - DNA, 2343 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaacagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtgcagacaccacagccacagcgccgagggcggcaagcacgccagagtgaaggagagagagcacgagagaagaaagagacacagagaggagcaggacaaggccagaagagagtgggagagacagaagagaagagagatggccagagagcacagcagaagagagagagacagactggagcagctggagagaaagagagagagagagagaaagatgagagagcagcagaaggagcagagagagcagaaggagagagagagaagagccgaggagagaagaaaggagagagaggccagaagagaggtgagcgcccaccacagaaccatgagagaggactacagcgacaaggtgaaggccagccactggagcagaagcccccccagaccccccagagagagattcgagctgggcgacggcagaaagcccgtgaaggaggagaagatggaggagagagacctgctgagcgacctgcaggacatcagcgacagcgagagaaagaccagcagcgccgagagcagcagcgccgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgccgaggaggtgagcgaggaggagatgagcgaggacgaggagagagagaacgagaaccacctgctggtggtgcccgagagcagattcgacagagacagcggcgagagcgaggaggccgaggaggaggtgggcgagggcaccccccagagcagcgccctgaccgagggcgactacgtgcccgacagccccgccctgctgcccatcgagctgaagcaggagctgcccaagtacctgcccgccctgcagggctgcagaagcgtggaggagttccagtgcctgaacagaatcgaggagggcacctacggcgtggtgtacagagccaaggacaagaagaccgacgagatcgtggccctgaagagactgaagatggagaaggagaaggagggcttccccatcaccagcctgagagagatcaacaccatcctgaaggcccagcaccccaacatcgtgaccgtgagagagatcgtggtgggcagcaacatggacaagatctacatcgtgatgaactacgtggagcacgacctgaagagcctgatggagaccatgaagcagcccttcctgcccggcgaggtgaagaccctgatgatccagctgctgagaggcgtgaagcacctgcacgacaactggatcctgcacagagacctgaagaccagcaacctgctgctgagccacgccggcatcctgaaggtgggcgacttcggcctggccagagagtacggcagccccctgaaggcctacacccccgtggtggtgacccagtggtacagagcccccgagctgctgctgggcgccaaggagtacagcaccgccgtggacatgtggagcgtgggctgcatcttcggcgagctgctgacccagaagcccctgttccccggcaacagcgagatcgaccagatcaacaaggtgttcaaggagctgggcacccccagcgagaagatctggcccggctacagcgagctgcccgtggtgaagaagatgaccttcagcgagcacccctacaacaacctgagaaagagattcggcgccctgctgagcgaccagggcttcgacctgatgaacaagttcctgacctacttccccggcagaagaatcagcgccgaggacggcctgaagcacgagtacttcagagagacccccctgcccatcgaccccagcatgttccccacctggcccgccaagagcgagcagcagagagtgaagagaggcaccagccccagaccccccgagggcggcctgggctacagccagctgggcgacgacgacctgaaggagaccggcttccacctgaccaccaccaaccagggcgccagcgccgccggccccggcttcagcctgaagttctag

SEQ ID NO: 78055 - DNA, 456 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaacagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtggaagcacgccagagtgaaggagagagagcacgagagaagaaagagacacagagaggagcaggacaaggccagaagagagtgggagagacagaagagaagagagatggccagagagcacagcagaagatag

SEQ ID NO: 78056 - DNA, 1263 bp, Artificial Sequence
  Description of Artificial Sequence: Synthetic coding sequence
atgggcgacgagaaggacagctggaaggtgaagaccctggacgagatcctgcaggagaagaagagaagaaaggagcaggaggagaaggccgagatcaagagactgaagaacagcgacgacagagacagcaagagagacagcctggaggagggcgagctgagagaccactgcatggagatcaccatcagaaacagcccctacagaagagaggacagcatggaggacagaggcgaggaggacgacagcctggccatcaagcccccccagcagatgagcagaaaggagaaggtgcaccacagaaaggacgagaagagaaaggagaagtgcagacaccacagccacagcgccgagggcggcaagcacgccagagtgaaggagagagagcacgagagaagaaagagacacagagaggagcaggacaaggccagaagagagtgggagagacagaagagaagagagatggccagagagcacagcagaagagagagagacagactggagcagctggagagaaagagagagagagagagaaagatgagagagcagcagaaggagcagagagagcagaaggagagagagagaagagccgaggagagaagaaaggagagagaggccagaagagaggtgagcgcccaccacagaaccatgagagaggactacagcgacaaggtgaaggccagccactggagcagaagcccccccagaccccccagagagagattcgagctgggcgacggcagaaagcccggcgaggccagacccgcccccgcccagaagcccgcccagctgaaggaggagaagatggaggagagagacctgctgagcgacctgcaggacatcagcgacagcgagagaaagaccagcagcgccgagagcagcagcgccgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgccgaggaggtgagcgaggaggagatgagcgaggacgaggagagagagaacgagaaccacctgctggtggtgcccgagagcagattcgacagagacagcggcgagagcgaggaggccgaggaggaggtgggcctgcccgagagaagaggcgtgcccgtgcccgagcaggacagaggcggccacctgtggagcggcctgcagagcaagagacaggagaacagatag

SEQ ID NO: 78057 - DNA, 1686 bp, Artificial Sequence
  Description of Artificial Sequence: Synthetic coding sequence
atggccatcgccaccagcacccagctggccagagccctgtacgacaacaccgccgagagcccccaggagctgagcttcagaagaggcgacgtgctgagagtgctgcagagagagggcgccggcggcctggacggctggtgcctgtgcagcctgcacggccagcagggcatcgtgcccgccaacagagtgaagctgctgcccgccggccccgcccccaagcccagcctgagccccgccagccccgcccagcccggcagcccctaccccgcccccgaccacagcaacgaggaccaggaggtgtacgtggtgcccccccccgccagaccctgccccaccagcggcccccccgccggcccctgcccccccagccccgacctgatctacaagatccccagagccagcggcacccagctggccgcccccagagacgccctggaggtgtacgacgtgccccccaccgccctgagagtgcccagcagcggcccctacgactgccccgccagcttcagccaccccctgaccagagtggccccccagccccccggcgaggacgacgccccctacgacgtgcccctgacccccaagccccccgccgagctggagcccgacctggagtgggagggcggcagagagcccggcccccccatctacgccgcccccagcaacctgaagagagccagcgccctgctgaacctgtacgaggcccccgaggagctgctggccgacggcgagggcggcggcaccgacgagggcatctacgacgtgcccctgctgggccccgaggccccccccagccccgagccccccggcgccctggccagccacgaccaggacaccctggcccagctgctggccagaagccccccccccccccacagacccagactgcccagcgccgagagcctgagcagaagacccctgcccgccctgcccgtgcccgaggcccccagccccagccccgtgcccagccccgcccccggcagaaagggcagcatccaggacagacccctgcccccccccccccccagactgcccggctacggcggccccaaggtggagggcgaccccgagggcagagagatggaggacgaccccgccggccaccacaacgagtacgagggcatccccatggccgaggagtacgactacgtgcacctgaagggcatggacaaggcccagggcagcagaccccccgaccaggcctgcaccggcgaccccgagctgcccgagagaggcatgcccgccccccaggaggccctgagccccggcgagcccctggtggtgagcaccggcgacctgcagctgctgtacttctacgccggccagtgccagagccactacagcgccctgcaggccgccgtggccgccctgatgagcagcacccaggccaaccagccccccagactgttcgtgccccacagcaagagagtggtggtggccgcccacagactggtgttcgtgggcgacaccctgggcagactggccgccagcgcccccctgagagcccaggtgagagccgccggcaccgccctgggccaggccctgagagccaccgtgctggccgtgaagggcgccgccctgggctaccccagcagccccgccatccaggagatggtgcagtgcgtgaccgagctggccggccaggccctgcagttcaccaccctgctgaccagcctggccccctag

SEQ ID NO: 78058 - DNA, 684 bp, Artificial Sequence
  Description of Artificial Sequence: Synthetic coding sequence
atgaacggcaccatctacgccaacgagtgccagcagatcagacaccccaacagcaagaccctgggcaccgtgacccccagaaagcccgtgctgagcgtgagcgccagaaagatcaaggacaacgccgccgactggcacaacctgatcctgaagtgggagaccctgaacgacgccggcttcaccaccgccaacaacatcgccaacctgaagatcagcctgctgaacaaggacaagatcgagctggacagcagcagccccgccagcaaggagaacgaggagaaggtgtgcctggagtacaacgaggagctggagaagctgtgcgaggagctgcaggccaccctggacggcctgaccaagatccaggtgaagatggagaagctgagcagcaccaccaagggcatctgcgagctggagaactaccactacggcgaggagagcaagagaccccccctgttccacacctggcccaccacccacttctacgaggtgagccacaagctgctggagatgtacagaaaggagctgctgctgaagagaaccgtggccaaggagctggcccacaccggcgaccccgacctgaccctgagctacctgagcatgtggctgcaccagccctacgtggagagcgacagcagactgcacctggagagcatgctgctggagaccggccacagagccctgtag

SEQ ID NO: 78059 - DNA, 357 bp, Artificial Sequence
  Description of Artificial Sequence: Synthetic coding sequence
atggaggccaagaccctgggcaccgtgacccccagaaagcccgtgctgagcgtgagcgccagaaagatcaaggacaacgccgccgactggcacaacctgatcctgaagtgggagaccctgaacgacgccggcttcaccaccgccaacaacatcgccaacctgaagatcagcctgctgaacaaggacaagatcgagctggacagcagcagccccgccagcaaggagaacgaggagaaggtgtgcctggagtacaacgaggagctggagaagctgtgcgaggagctgcaggccaccctggacggcctgatgagattcagaatcagcagctggagatgcaccggcagaagctgcagctag

SEQ ID NO: 78060 - DNA, 639 bp, Artificial Sequence
  Description of Artificial Sequence: Synthetic coding sequence
atggaggccaagaccctgggcaccgtgacccccagaaagcccgtgctgagcgtgagcgccagaaagatcaaggacaacgccgccgactggcacaacctgatcctgaagtgggagaccctgaacgacgccggcttcaccaccgccaacaacatcgccaacctgaagatcagcctgctgaacaaggacaagatcgagctggacagcagcagccccgccagcaaggagaacgaggagaaggtgtgcctggagtacaacgaggagctggagaagctgtgcgaggagctgcaggccaccctggacggcctgaccaagatccaggtgaagatggagaagctgagcagcaccaccaagggcatctgcgagctggagaactaccactacggcgaggagagcaagagaccccccctgttccacacctggcccaccacccacttctacgaggtgagccacaagctgctggagatgtacagaaaggagctgctgctgaagagaaccgtggccaaggagctggcccacaccggcgaccccgacctgaccctgagctacctgagcatgtggctgcaccagccctacgtggagagcgacagcagactgcacctggagagcatgctgctggagaccggccacagagccctgtag

SEQ ID NO: 78061 - DNA, 918 bp, Artificial Sequence
  Description of Artificial Sequence: Synthetic coding sequence
atggacatgttccagaaggtggagaagatcggcgagggcacctacggcgtggtgtacaaggccaagaacagagagaccggccagctggtggccctgaagaagatcagactggacctggagatggagggcgtgcccagcaccgccatcagagagatcagcctgctgaaggagctgaagcaccccaacatcgtgagactgctggacgtggtgcacaacgagagaaagctgtacctggtgttcgagttcctgagccaggacctgaagaagtacatggacagcacccccggcagcgagctgcccctgcacctgatcaagagctacctgttccagctgctgcagggcgtgagcttctgccacagccacagagtgatccacagagacctgaagccccagaacctgctgatcaacgagctgggcgccatcaagctggccgacttcggcctggccagagccttcggcgtgcccctgagaacctacacccacgaggtggtgaccctgtggtacagagcccccgagatcctgctgggcagcaagttctacaccaccgccgtggacatctggagcatcggctgcatcttcgccgagatggtgaccagaaaggccctgttccccggcgacagcgagatcgaccagctgttcagaatcttcagaatgctgggcacccccagcgaggacacctggcccggcgtgacccagctgcccgactacaagggcagcttccccaagtggaccagaaagggcctggaggagatcgtgcccaacctggagcccgagggcagagacctgctgatgcagctgctgcagtacgaccccagccagagaatcaccgccaagaccgccctggcccacccctacttcagcagccccgagcccagccccgccgccagacagtacgtgctgcagagattcagacactag

SEQ ID NO: 78062 - DNA, 918 bp, Artificial Sequence; identical to SEQ ID NO: 78061
  Description of Artificial Sequence: Synthetic coding sequence

SEQ ID NO: 78063 - DNA, 879 bp, Artificial Sequence
  Description of Artificial Sequence: Synthetic coding sequence
atgcagaagtacgagaagctggagaagatcggcgagggcacctacggcaccgtgttcaaggccaagaacagagagacccacgagatcgtggccctgaagagagtgagactggacgacgacgacgagggcgtgcccagcagcgccctgagagagatctgcctgctgaaggagctgaagcacaagaacatcgtgagactgcacgacgtgctgcacagcgacaagaagctgaccctggtgttcgagttctgcgaccaggacctgaagaagtacttcgacagctgcaacggcgacctggaccccgagatcgtgaagagcttcctgttccagctgctgaagggcctgggcttctgccacagcagaaacgtgctgcacagagacctgaagccccagaacctgctgatcaacagaaacggcgagctgaagctggccgacttcggcctggccagagccttcggcatccccgtgagatgctacagcgccgaggtggtgaccctgtggtacagaccccccgacgtgctgttcggcgccaagctgtacagcaccagcatcgacatgtggagcgccggctgcatcttcgccgagctggccaacgccggcagacccctgttccccggcaacgacgtggacgaccagctgaagagaatcttcagactgctgggcacccccaccgaggagcagtggcccagcatgaccaagctgcccgactacaagccctaccccatgtaccccgccaccaccagcctggtgaacgtggtgcccaagctgaacgccaccggcagagacctgctgcagaacctgctgaagtgcaaccccgtgcagagaatcagcgccgaggaggccctgcagcacccctacttcagcgacttctgccccccctag

SEQ ID NO: 78064 - DNA, 783 bp, Artificial Sequence
  Description of Artificial Sequence: Synthetic coding sequence
atgcagaagtacgagaagctggagaagatcggcgagggcacctacggcaccgtgttcaaggccaagaacagagagacccacgagatcgtggccctgaagagagtgagactggacgacgacgacgagggcgtgcccagcagcgccctgagagagatctgcctgctgaaggagctgaagcacaagaacatcgtgagactgcacgacgtgctgcacagcgacaagaagctgaccctggtgttcgagttctgcgaccaggacctgaagaagtacttcgacagctgcaacggcgacctggaccccgagatcgtgaagaacggcgagctgaagctggccgacttcggcctggccagagccttcggcatccccgtgagatgctacagcgccgaggtggtgaccctgtggtacagaccccccgacgtgctgttcggcgccaagctgtacagcaccagcatcgacatgtggagcgccggctgcatcttcgccgagctggccaacgccggcagacccctgttccccggcaacgacgtggacgaccagctgaagagaatcttcagactgctgggcacccccaccgaggagcagtggcccagcatgaccaagctgcccgactacaagccctaccccatgtaccccgccaccaccagcctggtgaacgtggtgcccaagctgaacgccaccggcagagacctgctgcagaacctgctgaagtgcaaccccgtgcagagaatcagcgccgaggaggccctgcagcacccctacttcagcgacttctgccccccctag

SEQ ID NO: 78065 - DNA, 1104 bp, Artificial Sequence
  Description of Artificial Sequence: Synthetic coding sequence
atgggcaccgtgctgagcctgagccccgccagcagcgccaagggcagaagacccggcggcctgcccgaggagaagaagaaggccccccccgccggcgacgaggccctgggcggctacggcgccccccccgtgggcaagggcggcaagggcgagagcagactgaagagacccagcgtgctgatcagcgccctgacctggaagagactggtggccgccagcgccaagaagaagaagggcagcaagaaggtgacccccaagcccgccagcaccggccccgaccccctggtgcagcagagaaacagagagaacctgctgagaaagggcagagacccccccgacggcggcggcaccgccaagcccctggccgtgcccgtgcccaccgtgcccgccgccgccgccacctgcgagccccccagcggcggcagcgccgccgcccagccccccggcagcggcggcggcaagcccccccccccccccccccccgccccccaggtggccccccccgtgcccggcggcagccccagaagagtgatcgtgcaggccagcaccggcgagctgctgagatgcctgggcgacttcgtgtgcagaagatgctacagactgaaggagctgagccccggcgagctggtgggctggttcagaggcgtggacagaagcctgctgctgcagggctggcaggaccaggccttcatcacccccgccaacctggtgttcgtgtacctgctgtgcagagagagcctgagaggcgacgagctggccagcgccgccgagctgcaggccgccttcctgacctgcctgtacctggcctacagctacatgggcaacgagatcagctaccccctgaagcccttcctggtggagcccgacaaggagagattctggcagagatgcctgagactgatccagagactgagcccccagatgctgagactgaacgccgacccccacttcttcacccaggtgttccaggacctgaagaacgagggcgaggccgccgccagcggcggcggcccccccagcggcggcgcccccgccgccagcagcgccgccagagacagctgcgccgccggcaccaagcactggaccatgaacctggacagatag

SEQ ID NO: 78066 - DNA, 1779 bp, Artificial Sequence
  Description of Artificial Sequence: Synthetic coding sequence
atggagatgtacgagaccctgggcaaggtgggcgagggcagctacggcaccgtgatgaagtgcaagcacaagaacaccggccagatcgtggccatcaagatcttctacgagagacccgagcagagcgtgaacaagatcgccatgagagagatcaagttcctgaagcagttccaccacgagaacctggtgaacctgatcgaggtgttcagacagaagaagaagatccacctggtgttcgagttcatcgaccacaccgtgctggacgagctgcagcactactgccacggcctggagagcaagagactgagaaagtacctgttccagatcctgagagccatcgactacctgcacagcaacaacatcatccacagagacatcaagcccgagaacatcctggtgagccagagcggcatcaccaagctgtgcgacttcggcttcgccagaaccctggccgcccccggcgacatctacaccgactacgtggccaccagatggtacagagcccccgagctggtgctgaaggacaccagctacggcaagcccgtggacatctgggccctgggctgcatgatcatcgagatggccaccggcaacccctacctgcccagcagcagcgacctggacctgctgcacaagatcgtgctgaaggtgggcaacctgagcccccacctgcagaacatcttcagcaagagccccatcttcgccggcgtggtgctgccccaggtgcagcaccccaagaacgccagaaagaagtaccccaagctgaacggcctgctggccgacatcgtgcacgcctgcctgcagatcgaccccgccgacagaatcagcagcagcgacctgctgcaccacgagtacttcaccagagacggcttcatcgagaagttcatgcccgagctgaaggccaagctgctgcaggaggccaaggtgaacagcctgatcaagcccaaggagagcagcaaggagaacgagctgagaaaggacgagagaaagaccgtgtacaccaacaccctgctgagcagcagcgtgctgggcaaggagatcgagaaggagaagaagcccaaggagatcaaggtgagagtgatcaaggtgaagggcggcagaggcgacatcagcgagcccaagaagaaggagtacgagggcggcctgggccagcaggacgccaacgagaacgtgcaccccatgagccccgacaccaagctggtgaccatcgagccccccaaccccatcaaccccagcaccaactgcaacggcctgaaggagaacccccactgcggcggcagcgtgaccatgccccccatcaacctgaccaacagcaacctgatggccgccaacctgagcagcaacctgttccaccccagcgtgagactgaccgagagagccaagaagagaagaaccagcagccagagcatcggccaggtgatgcccaacagcagacaggaggaccccggccccatccagagccagatggagaagggcatcttcaacgagagaaccggccacagcgaccagatggccaacgagaacaagagaaagctgaacttcagcagaagcgacagaaaggagttccacttccccgagctgcccgtgaccatccagagcaaggacaccaagggcatggaggtgaagcagatcaagatgctgaagagagagagcaagaagaccgagagcagcaagatccccaccctgctgaacgtggaccagaaccaggagaagcaggagggcggcgacggccactgcgagggcaagaacctgaagagaaacagattcttcttctggtag

SEQ ID NO: 78067 - DNA, 1368 bp, Artificial Sequence
  Description of Artificial Sequence: Synthetic coding sequence
atggagatgtacgagaccctgggcaaggtgggcgagggcagctacggcaccgtgatgaagtgcaagcacaagaacaccggccagatcgtggccatcaagatcttctacgagagacccgagcagagcgtgaacaagatcgccatgagagagatcaagttcctgaagcagttccaccacgagaacctggtgaacctgatcgaggtgttcagacagaagaagaagatccacctggtgttcgagttcatcgaccacaccgtgctggacgagctgcagcactactgccacggcctggagagcaagagactgagaaagtacctgttccagatcctgagagccatcgactacctgcacagcaacaacatcatccacagagacatcaagcccgagaacatcctggtgagccagagcggcatcaccaagctgtgcgacttcggcttcgccagaaccctggccgcccccggcgacatctacaccgactacgtggccaccagatggtacagagcccccgagctggtgctgaaggacaccagctacggcaagcccgtggacatctgggccctgggctgcatgatcatcgagatggccaccggcaacccctacctgcccagcagcagcgacctggacctgctgcacaagatcgtgctgaaggtgggcaacctgagcccccacctgcagaacatcttcagcaagagccccatcttcgccggcgtggtgctgccccaggtgcagcaccccaagaacgccagaaagaagtaccccaagctgaacggcctgctggccgacatcgtgcacgcctgcctgcagatcgaccccgccgacagaatcagcagcagcgacctgctgcaccacgagtacttcaccagagacggcttcatcgagaagttcatgcccgagctgaaggccaagctgctgcaggaggccaaggtgaacagcctgatcaagcccaaggagagcagcaaggagaacgagctgagaaaggacgagagaaagaccgtgtacaccaacaccctgctgagcagcagcgtgctgggcaaggagatcgagaaggagaagaagcccaaggagatcaaggtgagagtgatcaaggtgaagggcggcagaggcgacatcagcgagcccaagaagaaggagtacgagggcggcctgggccagcaggacgccaacgagaacgtgcaccccatgagccccgacaccaagctggtgaccatcgagccccccaaccccatcaaccccagcaccaactgcaacggcctgaaggagaacccccactgcggcggcagcgtgaccatgccccccatcaacctgaccaacagcaacctgatggccgccaacctgagcagcaacctgttccaccccagcgtgagatag

SEQ ID NO: 78068 - DNA, 1092 bp, Artificial Sequence
  Description of Artificial Sequence: Synthetic coding sequence
atgcccgagctgaaggccaagctgctgcaggaggccaaggtgaacagcctgatcaagcccaaggagagcagcaaggagaacgagctgagaaaggacgagagaaagaccgtgtacaccaacaccctgctgagcagcagcgtgctgggcaaggagatcgagaaggagaagaagcccaaggagatcaaggtgagagtgatcaaggtgaagggcggcagaggcgacatcagcgagcccaagaagaaggagtacgagggcggcctgggccagcaggacgccaacgagaacgtgcaccccatgagccccgacaccaagctggtgaccatcgagccccccaaccccatcaaccccagcaccaactgcaacggcctgaaggagaacccccactgcggcggcagcgtgaccatgccccccatcaacctgaccaacagcaacctgatggccgccaacctgagcagcaacctgttccaccccagcgtgagactgaccgagagagccaagaagagaagaaccagcagccagagcatcggccaggtgatgcccaacagcagacaggaggaccccggccccatccagagccagatggagaagggcatcttcaacgagagaaccggccacagcgaccagatggccaacgagaacaagagaaagctgaacttcagcagaagcgacagaaaggagttccacttccccgagctgcccgtgaccatccagagcaaggacaccaagggcatggaggtgaagcagatcaagatgctgaagagagagagcaagaagaccgagagcagcaagatccccaccctgctgaacgtggaccagaaccaggagaagcaggagttcatccccctgagcctgctgagcgcctgctgccccatcttcaccaacatctgcagccagctgaccatcagatacgtgttcatcagcggcatgaagaccgaccagtacagcgagctggtgcccgtggagtggggcatcgccgagaagatccccaagaacgtggaggccaccctggagctgggcaacagacagagattcgagcagttcggcgagctgagaagaagacaggagaacgtgggcaagttcggcaccttctag

SEQ ID NO: 78069 - DNA, 1773 bp, Artificial Sequence
  Description of Artificial Sequence: Synthetic coding sequence
atggagatgtacgagaccctgggcaaggtgggcgagggcagctacggcaccgtgatgaagtgcaagcacaagaacaccggccagatcgtggccatcaagatcttctacgagagacccgagcagagcgtgaacaagatcgccatgagagagatcaagttcctgaagcagttccaccacgagaacctggtgaacctgatcgaggtgttcagacagaagaagaagatccacctggtgttcgagttcatcgaccacaccgtgctggacgagctgcagcactactgccacggcctggagagcaagagactgagaaagtacctgttccagatcctgagagccatcgactacctgcacagcaacaacatcatccacagagacatcaagcccgagaacatcctggtgagccagagcggcatcaccaagctgtgcgacttcggcttcgccagaaccctggccgcccccggcgacatctacaccgactacgtggccaccagatggtacagagcccccgagctggtgctgaaggacaccagctacggcaagcccgtggacatctgggccctgggctgcatgatcatcgagatggccaccggcaacccctacctgcccagcagcagcgacctggacctgctgcacaagatcgtgctgaaggtgggcaacctgagcccccacctgcagaacatcttcagcaagagccccatcttcgccggcgtggtgctgccccaggtgcagcaccccaagaacgccagaaagaagtaccccaagctgaacggcctgctggccgacatcgtgcacgcctgcctgcagatcgaccccgccgacagaatcagcagcagcgacctgctgcaccacgagtacttcaccagagacggcttcatcgagaagttcatgcccgagctgaaggccaagctgctgcaggaggccaaggtgaacagcctgatcaagcccaaggagagcagcaaggagaacgagctgagaaaggacgagagaaagaccgtgtacaccaacaccctgctgagcagcagcgtgctgggcaaggagatcgagaaggagaagaagcccaaggagatcaaggtgagagtgatcaaggtgaagggcggcagaggcgacatcagcgagcccaagaagaaggagtacgagggcggcctgggccagcaggacgccaacgagaacgtgcaccccatgagccccgacaccaagctggtgaccatcgagccccccaaccccatcaaccccagcaccaactgcaacggcctgaaggagaacccccactgcggcggcagcgtgaccatgccccccatcaacctgaccaacagcaacctgatggccgccaacctgagcagcaacctgttccaccccagcgtgagactgaccgagagagccaagaagagaagaaccagcagccagagcatcggccaggtgatgcccaacagcagacaggaggaccccggccccatccagagccagatggagaagggcatcttcaacgagagaaccggccacagcgaccagatggccaacgagaacaagagaaagctgaacttcagcagaagcgacagaaaggagttccacttccccgagctgcccgtgaccatccagagcaaggacaccaagggcatggaggtgaagcagatcaagatgctgaagagagagagcaagaagaccgagagcagcaagatccccaccctgctgaacgtggaccagaaccaggagaagcaggagaacaccggcaacgcccagaccgagagaaagaagaacctgcccgacgtggagtag

SEQ ID NO: 78070 - DNA, 1368 bp, Artificial Sequence; identical to SEQ ID NO: 78067
  Description of Artificial Sequence: Synthetic coding sequence

SEQ ID NO: 78071 - DNA, 876 bp, Artificial Sequence
  Description of Artificial Sequence: Synthetic coding sequence
atgcccgagctgaaggccaagctgctgcaggaggccaaggtgaacagcctgatcaagcccaaggagagcagcaaggagaacgagctgagaaaggacgagagaaagaccgtgtacaccaacaccctgctgagcagcagcgtgctgggcaaggagatcgagaaggagaagaagcccaaggagatcaaggtgagagtgatcaaggtgaagggcggcagaggcgacatcagcgagcccaagaagaaggagtacgagggcggcctgggccagcaggacgccaacgagaacgtgcaccccatgagccccgacaccaagctggtgaccatcgagccccccaaccccatcaaccccagcaccaactgcaacggcctgaaggagaacccccactgcggcggcagcgtgaccatgccccccatcaacctgaccaacagcaacctgatggccgccaacctgagcagcaacctgttccaccccagcgtgagactgaccgagagagccaagaagagaagaaccagcagccagagcatcggccaggtgatgcccaacagcagacaggaggaccccggccccatccagagccagatggagaagggcatcttcaacgagagaaccggccacagcgaccagatggccaacgagaacaagagaaagctgaacttcagcagaagcgacagaaaggagttccacttccccgagctgcccgtgaccatccagagcaaggacaccaagggcatggaggtgaagcagatcaagatgctgaagagagagagcaagaagaccgagagcagcaagatccccaccctgctgaacgtggaccagaaccaggagaagcaggaggtgagactgtaccagagacacgaggacagacccatccagtag

SEQ ID NO: 78072 - DNA, 3093 bp, Artificial Sequence
  Description of Artificial Sequence: Synthetic coding sequence
atgaagatccccaacatcggcaacgtgatgaacaagttcgagatcctgggcgtggtgggcgagggcgcctacggcgtggtgctgaagtgcagacacaaggagacccacgagatcgtggccatcaagaagttcaaggacagcgaggagaacgaggaggtgaaggagaccaccctgagagagctgaagatgctgagaaccctgaagcaggagaacatcgtggagctgaaggaggccttcagaagaagaggcaagctgtacctggtgttcgagtacgtggagaagaacatgctggagctgctggaggagatgcccaacggcgtgccccccgagaaggtgaagagctacatctaccagctgatcaaggccatccactggtgccacaagaacgacatcgtgcacagagacatcaagcccgagaacctgctgatcagccacaacgacgtgctgaagctgtgcgacttcggcttcgccagaaacctgagcgagggcaacaacgccaactacaccgagtacgtggccaccagatggtacagaagccccgagctgctgctgggcgccccctacggcaagagcgtggacatgtggagcgtgggctgcatcctgggcgagctgagcgacggccagcccctgttccccggcgagagcgagatcgaccagctgttcaccatccagaaggtgctgggccccctgcccagcgagcagatgaagctgttctacagcaaccccagattccacggcctgagattccccgccgtgaaccacccccagagcctggagagaagatacctgggcatcctgaacagcgtgctgctggacctgatgaagaacctgctgaagctggaccccgccgacagatacctgaccgagcagtgcctgaaccaccccaccttccagacccagagactgctggacagaagccccagcagaagcgccaagagaaagccctaccacgtggagagcagcaccctgagcaacagaaaccaggccggcaagagcaccgccctgcagagccaccacagaagcaacagcaaggacatccagaacctgagcgtgggcctgcccagagccgacgagggcctgcccgccaacgagagcttcctgaacggcaacctggccggcgccagcctgagccccctgcacaccaagacctaccaggccagcagccagcccggcagcaccagcaaggacctgaccaacaacaacatcccccacctgctgagccccaaggaggccaagagcaagaccgagttcgacttcaacatcgaccccaagcccagcgagggccccggcaccaagtacctgaagagcaacagcagaagccagcagaacagacacagcttcatggagagcagccagagcaaggccggcaccctgcagcccaacgagaagcagagcagacacagctacatcgacaccatcccccagagcagcagaagccccagctacagaaccaaggccaagagccacggcgccctgagcgacagcaagagcgtgagcaacctgagcgaggccagagcccagatcgccgagcccagcaccagcagatacttccccagcagctgcctggacctgaacagccccaccagccccacccccaccagacacagcgacaccagaaccctgctgagccccagcggcagaaacaacagaaacgagggcaccctggacagcagaagaaccaccaccagacacagcaagaccatggaggagctgaagctgcccgagcacatggacagcagccacagccacagcctgagcgccccccacgagagcttcagctacggcctgggctacaccagccccttcagcagccagcagagaccccacagacacagcatgtacgtgaccagagacaaggtgagagccaagggcctggacggcagcctgagcatcggccagggcatggccgccagagccaacagcctgcagctgctgagcccccagcccggcgagcagctgccccccgagatgaccgtggccagaagcagcgtgaaggagaccagcagagagggcaccagcagcttccacaccagacagaagagcgagggcggcgtgtaccacgacccccacagcgacgacggcaccgcccccaaggagaacagacacctgtacaacgaccccgtgcccagaagagtgggcagcttctacagagtgcccagccccagacccgacaacagcttccacgagaacaacgtgagcaccagagtgagcagcctgcccagcgagagcagcagcggcaccaaccacagcaagagacagcccgccttcgacccctggaagagccccgagaacatcagccacagcgagcagctgaaggagaaggagaagcagggcttcttcagaagcatgaagaagaagaagaagaagagccagaccgtgcccaacagcgacagccccgacctgctgaccctgcagaagagcatccacagcgccagcacccccagcagcagacccaaggagtggagacccgagaagatcagcgacctgcagacccagagccagcccctgaagagcctgagaaagctgctgcacctgagcagcgccagcaaccaccccgccagcagcgaccccagattccagcccctgaccgcccagcagaccaagaacagcttcagcgagatcagaatccaccccctgagccaggccagcggcggcagcagcaacatcagacaggagcccgcccccaagggcagacccgccctgcagctgcccgacggcggctgcgacggcagaagacagagacaccacagcggcccccaggacagaagattcatgctgagaaccaccgagcagcagggcgagtacttctgctgcggcgaccccaagaagccccacaccccctgcgtgcccaacagagccctgcacagacccatcagcagccccgccccctaccccgtgctgcaggtgagaggcaccagcatgtgccccaccctgcaggtgagaggcaccgacgccttcagctgccccacccagcagagcggcttcagcttcttcgtgagacacgtgatgagagaggccctgatccacagagcccaggtgaaccaggccgccctgctgacctaccacgagaacgccgccctgaccggcaagtag

SEQ ID NO: 78073 - DNA, 3093 bp, Artificial Sequence; identical to SEQ ID NO: 78072
  Description of Artificial Sequence: Synthetic coding sequence

SEQ ID NO: 78074 - DNA, 1956 bp, Artificial Sequence
  Description of Artificial Sequence: Synthetic coding sequence
atgagcctgcccagactgctgaaggtgaacatcagaacctacgacaacagcatccccatcagcgagagcagcagaaagagctggaaccagaagcacttcgccctgaccttccccaagcccctgcagagaggcaccaacgacaagagcagacccctgaagagccagatcaccgtgaccagacacgacaagagaaagctggaggagggccagaagcccgcccacaagtggatcagacacagcttcagaaagatcctgcagtggccccccatctacaccgccgccagagagcagacccccttcagacacctgtacaccagcaagacccacctgaagaaggccgagtacaagaagagcaaggacgagaagggcggcacccccctgaagaaggacagcaagaagaagggcggcagctacgccaccaaccccgagagcaagcagatcgtggaggagaagaccaagagacagaacgaggccgacaagacccccctgaagagcagccacgagaacgagcagagcaagaagagcaagagcagcagcgagaccaaccccgagagccagaacagcaagaccgtgagcaagaactgcagccagaaggacaagaaggacagcaagaacagcaagaagaccaacaccgagttcctgcacaccaagaacaaccccaagaaggacctgaagagaagcaagaccagcaacgaccccatcagcgagatctgcagcgagaacagcctgaacgtggacttcctgatgctggtgggccagagcgacgacgagagcatcaacttcgacgcctggctgagaaactacagccagaacaacagcaagaactacagcctgaagtacaccaagtacaccaagaaggacaccaagaagaacgccaagaagagcagcgacgccgagagcgaggacagcaaggacgccaagaaggacagcaagaaggtgaagaagaacgtgaagaaggacgacaagaagaaggacgtgaagaaggacaccgagagcaccgacgccgagagcggcgacagcaaggacgagagaaaggacaccaagaaggacaagaagaagctgaagaaggacgacaagaagaaggacaccaagaagtaccccgagagcaccgacaccgagagcggcgacgccaaggacgccagaaacgacagcagaaacctgaagaaggccagcaagaacgacgacaagaagaaggacgccaagaagatcaccttcagcaccgacagcgagagcgagctggagagcaaggagagccagaaggacgagaagaaggacaagaaggacagcaagaccgacaacaagaagagcgtgaagaacgacgaggagagcaccgacgccgacagcgagcccaagggcgacagcaagaagggcaagaaggacgagaagaagggcaagaaggacagcaagaaggacgacaagaagaaggacgccaagaagaacgccgagagcaccgagatggagagcgacctggagctgaagaaggacaagaagcacagcaaggagaagaagggcagcaagaaggacatcaagaaggacgccagaaaggacaccgagagcaccgacgccgagttcgacgagagcagcaagaccggcttcaagaccagcaccaagatcaagggcagcgacaccgagagcgaggagagcctgtacaagcccggcgccaagaagaagatcgacgagagcgacggcaccagcgccaacagcaagatggagggcctggagagcaagagaggcttcagaatgagcagcaagaagaccaccttcaacgagaagggcgagaaggccagcaccggcagagtgccccccagcagagagaagccccccctgcccgcctgcgagcccagcctgcccagccccaaggtgagaagactgtgctggtgcaagatgcccccccccccccccaagcccagatacgcccccctgcccgaggccccctggatccacaagctgctgtag

SEQ ID NO: 78075 - DNA, 1974 bp, Artificial Sequence
  Description of Artificial Sequence: Synthetic coding sequence
atgagcctgcccagactgctgaaggtgaacatcagaacctacgacaacagcatccccatcagcgagagcagcagaaagagctggaaccagaagcacttcgccctgaccttccccaagcccctgcagagaggcaccaacgacaagagcagacccctgaagagccagatcaccgtgaccagacacgacaagagaaagctggaggagggccagaagcccgcccacaagtggatcagacacagcttcagaaagatcctgcagtggccccccatctacaccgccgccagagagcagacccccttcagacacctgtacaccagcaagacccacctgaagaaggccgagtacaagaagagcaaggacgagaagggcggcacccccctgaagaaggacagcaagaagaagggcggcagctacgccaccaaccccgagagcaagcagatcgtggaggagaagaccaagagacagaacgaggccgacaagacccccctgaagagcagccacgagaacgagcagagcaagaagagcaagagcagcagcgagaccaaccccgagagccagaacagcaagaccgtgagcaagaactgcagccagaaggacaagaaggacagcaagaacagcaagaagaccaacaccgagttcctgcacaccaagaacaaccccaagaaggacctgaagagaagcaagaccagcaacgaccccatcagcgagatctgcagcgagaacagcctgaacgtggacttcctgatgctggtgggccagagcgacgacgagagcatcaacttcgacgcctggctgagaaactacagccagaacaacagcaagaactacagcctgaagtacaccaagtacaccaagaaggacaccaagaagaacgccaagaagagcagcgacgccgagagcgaggacagcaaggacgccaagaaggacagcaagaaggtgaagaagaacgtgaagaaggacgacaagaagaaggacgtgaagaaggacaccgagagcaccgacgccgagagcggcgacagcaaggacgagagaaaggacaccaagaaggacaagaagaagctgaagaaggacgacaagaagaaggacaccaagaagtaccccgagagcaccgacaccgagagcggcgacgccaaggacgccagaaacgacagcagaaacctgaagaaggccagcaagaacgacgacaagaagaaggacgccaagaagatcaccttcagcaccgacagcgagagcgagctggagagcaaggagagccagaaggacgagaagaaggacaagaaggacagcaagaccgacaacaagaagagcgtgaagaacgacgaggagagcaccgacgccgacagcgagcccaagggcgacagcaagaagggcaagaaggacgagaagaagggcaagaaggacagcaagaaggacgacaagaagaaggacgccaagaagaacgccgagagcaccgagatggagagcgacctggagctgaagaaggacaagaagcacagcaaggagaagaagggcagcaagaaggacatcaagaaggacgccagaaaggacaccgagagcaccgacgccgagttcgacgagagcagcaagaccggcttcaagaccagcaccaagatcaagggcagcgacaccgagagcgaggagagcctgtacaagcccggcgccaagaagaagatcgacgagagcgacggcaccagcgccaacagcaagatggagggcctggagagcaagagaggcttcagaatgagcagcaagaagaccaccttcaacgagaagggcgagaaggccagcaccggcagagtgccccccagcagagagaagccccccctgcccgcctgcgagcccagcctgcccagccccaaggtgagaagactgtgctggtgcaagatgcccccccccccccccaagcccagatacgcccccctgatccagagaagacagagactgggcgtgagaagatgccagctgctgatgtag

SEQ ID NO: 78076 - DNA, 1086 bp, Artificial Sequence
  Description of Artificial Sequence: Synthetic coding sequence
atgcaggagaaggacgccagcagccagggcttcctgccccacttccagcacttcgccacccaggccatccacgtgggccaggaccccgagcagtggaccagcagagccgtggtgccccccatcagcctgagcaccaccttcaagcagggcgcccccggccagcacagcggcttcgagtacagcagaagcggcaaccccaccagaaactgcctggagaaggccgtggccgccctggacggcgccaagtactgcctggccttcgccagcggcctggccgccaccgtgaccatcacccacctgctgaaggccggcgaccagatcatctgcatggacgacgtgtacggcggcaccaacagatacttcagacaggtggccagcgagttcggcctgaagatcagcttcgtggactgcagcaagatcaagctgctggaggccgccatcacccccgagaccaagagacccctggccctgggcgccgacatcagcatgtacagcgccaccaagtacatgaacggccacagcgacgtggtgatgggcctggtgagcgtgaactgcgagagcctgcacaacagactgagattcctgcagaacagcctgggcgccgtgcccagccccatcgactgctacctgtgcaacagaggcctgaagaccctgcacgtgagaatggagaagcacttcaagaacggcatggccgtggcccagttcctggagagcaacccctgggtggagaaggtgatctaccccggcctgcccagccacccccagcacgagctggtgaagagacagtgcaccggctgcaccggcatggtgaccttctacatcaagggcaccctgcagcacgccgagatcttcctgaagaacctgaagctgttcaccctggccgagagcctgggcggcttcgagagcctggccgagctgcccgccatcatgacccacgccagcgtgctgaagaacgacagagacgtgctgggcatcagcgacaccctgatcagactgagcgtgggcctggaggacgaggaggacctgctggaggacctggaccaggccctgaaggccgcccacccccccagcggcagccacagctag

SEQ ID NO: 78077 - DNA, 1218 bp, Artificial Sequence
  Description of Artificial Sequence: Synthetic coding sequence
atgcaggagaaggacgccagcagccagggcttcctgccccacttccagcacttcgccacccaggccatccacgtgggccaggaccccgagcagtggaccagcagagccgtggtgccccccatcagcctgagcaccaccttcaagcagggcgcccccggccagcacagcggcttcgagtacagcagaagcggcaaccccaccagaaactgcctggagaaggccgtggccgccctggacggcgccaagtactgcctggccttcgccagcggcctggccgccaccgtgaccatcacccacctgctgaaggccggcgaccagatcatctgcatggacgacgtgtacggcggcaccaacagatacttcagacaggtggccagcgagttcggcctgaagatcagcttcgtggactgcagcaagatcaagctgctggaggccgccatcacccccgagaccaagctggtgtggatcgagacccccaccaaccccacccagaaggtgatcgacatcgagggctgcgcccacatcgtgcacaagcacggcgacatcatcctggtggtggacaacaccttcatgagcccctacttccagagacccctggccctgggcgccgacatcagcatgtacagcgccaccaagtacatgaacggccacagcgacgtggtgatgggcctggtgagcgtgaactgcgagagcctgcacaacagactgagattcctgcagaacagcctgggcgccgtgcccagccccatcgactgctacctgtgcaacagaggcctgaagaccctgcacgtgagaatggagaagcacttcaagaacggcatggccgtggcccagttcctggagagcaacccctgggtggagaaggtgatctaccccggcctgcccagccacccccagcacgagctggtgaagagacagtgcaccggctgcaccggcatggtgaccttctacatcaagggcaccctgcagcacgccgagatcttcctgaagaacctgaagctgttcaccctggccgagagcctgggcggcttcgagagcctggccgagctgcccgccatcatgacccacgccagcgtgctgaagaacgacagagacgtgctgggcatcagcgacaccctgatcagactgagcgtgggcctggaggacgaggaggacctgctggaggacctggaccaggccctgaaggccgcccacccccccagcggcagccacagctag

SEQ ID NO: 78078 - DNA, 1122 bp, Artificial Sequence
  Description of Artificial Sequence: Synthetic coding sequence
atgcaggagaaggacgccagcagccagggcttcctgccccacttccagcacttcgccacccaggccatccacgtgggccaggaccccgagcagtggaccagcagagccgtggtgccccccatcagcctgagcaccaccttcaagcagggcgcccccggccagcacagcggcttcgagtacagcagaagcggcaaccccaccagaaactgcctggagaaggccgtggccgccctggacggcgccaagtactgcaccaacagatacttcagacaggtggccagcgagttcggcctgaagatcagcttcgtggactgcagcaagatcaagctgctggaggccgccatcacccccgagaccaagctggtgtggatcgagacccccaccaaccccacccagaaggtgatcgacatcgagggctgcgcccacatcgtgcacaagcacggcgacatcatcctggtggtggacaacaccttcatgagcccctacttccagagacccctggccctgggcgccgacatcagcatgtacagcgccaccaagtacatgaacggccacagcgacgtggtgatgggcctggtgagcgtgaactgcgagagcctgcacaacagactgagattcctgcagaacagcctgggcgccgtgcccagccccatcgactgctacctgtgcaacagaggcctgaagaccctgcacgtgagaatggagaagcacttcaagaacggcatggccgtggcccagttcctggagagcaacccctgggtggagaaggtgatctaccccggcctgcccagccacccccagcacgagctggtgaagagacagtgcaccggctgcaccggcatggtgaccttctacatcaagggcaccctgcagcacgccgagatcttcctgaagaacctgaagctgttcaccctggccgagagcctgggcggcttcgagagcctggccgagctgcccgccatcatgacccacgccagcgtgctgaagaacgacagagacgtgctgggcatcagcgacaccctgatcagactgagcgtgggcctggaggacgaggaggacctgctggaggacctggaccaggccctgaaggccgcccacccccccagcggcagccacagctag

SEQ ID NO: 78079 - DNA, 1656 bp, Artificial Sequence
  Description of Artificial Sequence: Synthetic coding sequence
atgcccagcgagaccccccaggccgaggtgggccccaccggctgcccccacagaagcggcccccacagcgccaagggcagcctggagaagggcagccccgaggacaaggaggccaaggagcccctgtggatcagacccgacgcccccagcagatgcacctggcagctgggcagacccgccagcgagagcccccaccaccacaccgcccccgccaagagccccaagatcctgcccgacatcctgaagaagatcggcgacacccccatggtgagaatcaacaagatcggcaagaagttcggcctgaagtgcgagctgctggccaagtgcgagttcttcaacgccggcggcagcgtgaaggacagaatcagcctgagaatgatcgaggacgccgagagagacggcaccctgaagcccggcgacaccatcatcgagcccaccagcggcaacaccggcatcggcctggccctggccgccgccgtgagaggctacagatgcatcatcgtgatgcccgagaagatgagcagcgagaaggtggacgtgctgagagccctgggcgccgagatcgtgagaacccccaccaacgccagattcgacagccccgagagccacgtgggcgtggcctggagactgaagaacgagatccccaacagccacatcctggaccagtacagaaacgccagcaaccccctggcccactacgacaccaccgccgacgagatcctgcagcagtgcgacggcaagctggacatgctggtggccagcgtgggcaccggcggcaccatcaccggcatcgccagaaagctgaaggagaagtgccccggctgcagaatcatcggcgtggaccccgagggcagcatcctggccgagcccgaggagctgaaccagaccgagcagaccacctacgaggtggagggcatcggctacgacttcatccccaccgtgctggacagaaccgtggtggacaagtggttcaagagcaacgacgaggaggccttcaccttcgccagaatgctgatcgcccaggagggcctgctgtgcggcggcagcgccggcagcaccgtggccgtggccgtgaaggccgcccaggagctgcaggagggccagagatgcgtggtgatcctgcccgacagcgtgagaaactacatgaccaagttcctgagcgacagatggatgctgcagaagggcttcctgaaggaggaggacctgaccgagaagaagccctggtggtggcacctgagagtgcaggagctgggcctgagcgcccccctgaccgtgctgcccaccatcacctgcggccacaccatcgagatcctgagagagaagggcttcgaccaggcccccgtggtggacgaggccggcgtgatcctgggcatggtgaccctgggcaacatgctgagcagcctgctggccggcaaggtgcagcccagcgaccaggtgggcaaggtgatctacaagcagttcaagcagatcagactgaccgacaccctgggcagactgagccacatcctggagatggaccacttcgccctggtggtgcacgagcagatccagtaccacagcaccggcaagagcagccagagacagatggtgttcggcgtggtgaccgccatcgacctgctgaacttcgtggccgcccaggagagagaccagaagtag

SEQ ID NO: 78080 - DNA, 1656 bp, Artificial Sequence; identical to SEQ ID NO: 78079
  Description of Artificial Sequence: Synthetic coding sequence

SEQ ID NO: 78081 - DNA, 1656 bp, Artificial Sequence; identical to SEQ ID NO: 78079
  Description of Artificial Sequence: Synthetic coding sequence

SEQ ID NO: 78082 - DNA, 1656 bp, Artificial Sequence; identical to SEQ ID NO: 78079
  Description of Artificial Sequence: Synthetic coding sequence

SEQ ID NO: 78083 - DNA, 1698 bp, Artificial Sequence
  Description of Artificial Sequence: Synthetic coding sequence
atgcccagcgagaccccccaggccgaggtgggccccaccggctgcccccacagaagcggcccccacagcgccaagggcagcctggagaagggcagccccgaggacaaggaggccaaggagcccctgtggatcagacccgacgcccccagcagatgcacctggcagctgggcagacccgccagcgagagcccccaccaccacaccgcccccgccaagagccccaagatcctgcccgacatcctgaagaagatcggcgacacccccatggtgagaatcaacaagatcggcaagaagttcggcctgaagtgcgagctgctggccaagtgcgagttcttcaacgccggcggcagcgtgaaggacagaatcagcctgagaatgatcgaggacgccgagagagacggcaccctgaagcccggcgacaccatcatcgagcccaccagcggcaacaccggcatcggcctggccctggccgccgccgtgagaggctacagatgcatcatcgtgatgcccgagaagatgagcagcgagaaggtggacgtgctgagagccctgggcgccgagatcgtgagaacccccaccaacgccagattcgacagccccgagagccacgtgggcgtggcctggagactgaagaacgagatccccaacagccacatcctggaccagtacagaaacgccagcaaccccctggcccactacgacaccaccgccgacgagatcctgcagcagtgcgacggcaagctggacatgctggtggccagcgtgggcaccggcggcaccatcaccggcatcgccagaaagctgaaggagaagtgccccggctgcagaatcatcggcgtggaccccgagggcagcatcctggccgagcccgaggagctgaaccagaccgagcagaccacctacgaggtggagggcatcggctacgacttcatccccaccgtgctggacagaaccgtggtggacaagtggttcaagagcaacgacgaggaggccttcaccttcgccagaatgctgatcgcccaggagggcctgctgtgcggcggcagcgccggcagcaccgtggccgtggccgtgaaggccgcccaggagctgcaggagggccagagatgcgtggtgatcctgcccgacagcgtgagaaactacatgaccaagttcctgagcgacagatggatgctgcagaagggcttcctgaaggaggaggacctgaccgagaagaagccctggtggtggcacctgagagtgcaggagctgggcctgagcgcccccctgaccgtgctgcccaccatcacctgcggccacaccatcgagatcctgagagagaagggcttcgaccaggcccccgtggtggacgaggccggcgtgatcctgggcatggtgaccctgggcaacatgctgagcagcctgctggccggcaaggtgcagcccagcgaccaggtgggcaaggtgatctacaagcagttcaagcagatcagactgaccgacaccctgggcagactgagccacatcctggagatggaccacttcgccctggtggtgcacgagcagatccagagccaggaccaggcctgggccggcgtggtgggcggccccgccgaccacagcaccggcaagagcagccagagacagatggtgttcggcgtggtgaccgccatcgacctgctgaacttcgtggccgcccaggagagagaccagaagtag

SEQ ID NO: 78084 - DNA, 534 bp, Artificial Sequence
  Description of Artificial Sequence: Synthetic coding sequence
atgcccagcgagaccccccaggccgaggtgggccccaccggctgcccccacagaagcggcccccacagcgccaagggcagcctggagaagggcagccccgaggacaaggaggccaaggagcccctgtggatcagacccgacgcccccagcagatgcacctggcagctgggcagacccgccagcgagagcccccaccaccacaccgcccccgccaagagccccaagatcctgcccgacatcctgaagaagatcggcgacacccccatggtgagaatcaacaagatcggcaagaagttcggcctgaagtgcgagctgctggccaagtgcgagttcttcaacgccggcggcagcgtgaaggacagaatcagcctgagaatgatcgaggacgccgagagagacggcaccctgaagcccggcgacaccatcatcgagcccaccagcggcaacaccggcatcggcctggccctggccgccgccgtgagaggctacagatgcatcatcgtgatgcccgagaagatgagcagcgagaagtag

SEQ ID NO: 78085 - DNA, 1527 bp, Artificial Sequence
  Description of Artificial Sequence: Synthetic coding sequence
atgcccagcgagaccccccaggccgaggtgggccccaccggctgcccccacagaagcggcccccaccaccacaccgcccccgccaagagccccaagatcctgcccgacatcctgaagaagatcggcgacacccccatggtgagaatcaacaagatcggcaagaagttcggcctgaagtgcgagctgctggccaagtgcgagttcttcaacgccggcggcagcgtgaaggacagaatcagcctgagaatgatcgaggacgccgagagagacggcaccctgaagcccggcgacaccatcatcgagcccaccagcggcaacaccggcatcggcctggccctggccgccgccgtgagaggctacagatgcatcatcgtgatgcccgagaagatgagcagcgagaaggtggacgtgctgagagccctgggcgccgagatcgtgagaacccccaccaacgccagattcgacagccccgagagccacgtgggcgtggcctggagactgaagaacgagatccccaacagccacatcctggaccagtacagaaacgccagcaaccccctggcccactacgacaccaccgccgacgagatcctgcagcagtgcgacggcaagctggacatgctggtggccagcgtgggcaccggcggcaccatcaccggcatcgccagaaagctgaaggagaagtgccccggctgcagaatcatcggcgtggaccccgagggcagcatcctggccgagcccgaggagctgaaccagaccgagcagaccacctacgaggtggagggcatcggctacgacttcatccccaccgtgctggacagaaccgtggtggacaagtggttcaagagcaacgacgaggaggccttcaccttcgccagaatgctgatcgcccaggagggcctgctgtgcggcggcagcgccggcagcaccgtggccgtggccgtgaaggccgcccaggagctgcaggagggccagagatgcgtggtgatcctgcccgacagcgtgagaaactacatgaccaagttcctgagcgacagatggatgctgcagaagggcttcctgaaggaggaggacctgaccgagaagaagccctggtggtggcacctgagagtgcaggagctgggcctgagcgcccccctgaccgtgctgcccaccatcacctgcggccacaccatcgagatcctgagagagaagggcttcgaccaggcccccgtggtggacgaggccggcgtgatcctgggcatggtgaccctgggcaacatgctgagcagcctgctggccggcaaggtgcagcccagcgaccaggtgggcaaggtgatctacaagcagttcaagcagatcagactgaccgacaccctgggcagactgagccacatcctggagatggaccacttcgccctggtggtgcacgagcagatccagtaccacagcaccggcaagagcagccagagacagatggtgttcggcgtggtgaccgccatcgacctgctgaacttcgtggccgcccaggagagagaccagaagtag

SEQ ID NO: 78086 - DNA, 1392 bp, Artificial Sequence
  Description of Artificial Sequence: Synthetic coding sequence
atggtgagaatcaacaagatcggcaagaagttcggcctgaagtgcgagctgctggccaagtgcgagttcttcaacgccggcggcagcgtgaaggacagaatcagcctgagaatgatcgaggacgccgagagagacggcaccctgaagcccggcgacaccatcatcgagcccaccagcggcaacaccggcatcggcctggccctggccgccgccgtgagaggctacagatgcatcatcgtgatgcccgagaagatgagcagcgagaaggtggacgtgctgagagccctgggcgccgagatcgtgagaacccccaccaacgccagattcgacagccccgagagccacgtgggcgtggcctggagactgaagaacgagatccccaacagccacatcctggaccagtacagaaacgccagcaaccccctggcccactacgacaccaccgccgacgagatcctgcagcagtgcgacggcaagctggacatgctggtggccagcgtgggcaccggcggcaccatcaccggcatcgccagaaagctgaaggagaagtgccccggctgcagaatcatcggcgtggaccccgagggcagcatcctggccgagcccgaggagctgaaccagaccgagcagaccacctacgaggtggagggcatcggctacgacttcatccccaccgtgctggacagaaccgtggtggacaagtggttcaagagcaacgacgaggaggccttcaccttcgccagaatgctgatcgcccaggagggcctgctgtgcggcggcagcgccggcagcaccgtggccgtggccgtgaaggccgcccaggagctgcaggagggccagagatgcgtggtgatcctgcccgacagcgtgagaaactacatgaccaagttcctgagcgacagatggatgctgcagaagggcttcctgaaggaggaggacctgaccgagaagaagccctggtggtggcacctgagagtgcaggagctgggcctgagcgcccccctgaccgtgctgcccaccatcacctgcggccacaccatcgagatcctgagagagaagggcttcgaccaggcccccgtggtggacgaggccggcgtgatcctgggcatggtgaccctgggcaacatgctgagcagcctgctggccggcaaggtgcagcccagcgaccaggtgggcaaggtgatctacaagcagttcaagcagatcagactgaccgacaccctgggcagactgagccacatcctggagatggaccacttcgccctggtggtgcacgagcagatccagtaccacagcaccggcaagagcagccagagacagatggtgttcggcgtggtgaccgccatcgacctgctgaacttcgtggccgcccaggagagagaccagaagtag

SEQ ID NO: 78087 - DNA, 312 bp, Artificial Sequence
  Description of Artificial Sequence: Synthetic coding sequence
atgatggccgagccctggcaggccctgcagctgctgctggccatcctgctgaccctgatggccctgccctaccaggccagaaagaagaccttcctgagcgtgcacgaggtgatggccgtggagaactacgccaaggacagcctgcagtggatcaccgaccagtacaacaaggagagcgacgacaagtaccacttcagaatcttcagagtgctgaaggtgcagagacagcaggtgaactgcttcttcagcgtgttcgccgtgccctggttcgagcagtacaagatcctgaacaagagctgcagcagcgactag

SEQ ID NO: 78088 - DNA, 417 bp, Artificial Sequence
  Description of Artificial Sequence: Synthetic coding sequence
atgatggccgagccctggcaggccctgcagctgctgctggccatcctgctgaccctgatggccctgccctaccaggccagaaagaagaccttcctgagcgtgcacgaggtgatggccgtggagaactacgccaaggacagcctgcagtggatcaccgaccagtacaacaaggagagcgacgacaagtaccacttcagaatcttcagagtgctgaaggtgcagagacaggtgaccgaccacctggagtaccacctgaacgtggagatgcagtggaccacctgccagaagcccgagaccaccaactgcgtgccccaggagagagagctgcacaagcaggtgaactgcttcttcagcgtgttcgccgtgccctggttcgagcagtacaagatcctgaacaagagctgcagcagcgactag

SEQ ID NO: 78089 - DNA, 297 bp, Artificial Sequence
  Description of Artificial Sequence: Synthetic coding sequence
atgatccccggcggcctgagcgaggccaagcccgccacccccgagatccaggagatcgtggacaaggtgaagccccagctggaggagaagaccaacgagacctacggcaagctggaggccgtgcagtacaagacccaggtggtggccggcaccaactactacatcaaggtgagagccggcgacaacaagtacatgcacctgaaggtgttcaagagcctgcccggccagaacgaggacctggtgctgaccggctaccaggtggacaagaacaaggacgacgagctgaccggcttctag

SEQ ID NO: 78090 - DNA, 297 bp, Artificial Sequence
  Description of Artificial Sequence: Synthetic coding sequence
atgatgtgcggcgcccccagcgccacccagcccgccaccgccgagacccagcacatcgccgaccaggtgagaagccagctggaggagaaggagaacaagaagttccccgtgttcaaggccgtgagcttcaagagccaggtggtggccggcaccaactacttcatcaaggtgcacgtgggcgacgaggacttcgtgcacctgagagtgttccagagcctgccccacgagaacaagcccctgaccctgagcaactaccagaccaacaaggccaagcacgacgagctgacctacttctag

SEQ ID NO: 78091 - DNA, 441 bp, Artificial Sequence
  Description of Artificial Sequence: Synthetic coding sequence
atggccggccccctgagagcccccctgctgctgctggccatcctggccgtggccctggccgtgagccccgccgccggcagcagccccggcaagccccccagactggtgggcggccccatggacgccagcgtggaggaggagggcgtgagaagagccctggacttcgccgtgggcgagtacaacaaggccagcaacgacatgtaccacagcagagccctgcaggtggtgagagccagaaagcagatcgtggccggcgtgaactacttcctggacgtggagctgggcagaaccacctgcaccaagacccagcccaacctggacaactgccccttccacgaccagccccacctgaagagaaaggccttctgcagcttccagatctacgccgtgccctggcagggcaccatgaccctgagcaagagcacctgccaggacgcctag

SEQ ID NO: 78092 - DNA, 441 bp, Artificial Sequence; identical to SEQ ID NO: 78091
  Description of Artificial Sequence: Synthetic coding sequence

SEQ ID NO: 78093 - DNA, 441 bp, Artificial Sequence; identical to SEQ ID NO: 78091
  Description of Artificial Sequence: Synthetic coding sequence

SEQ ID NO: 78094 - DNA, 429 bp, Artificial Sequence
  Description of Artificial Sequence: Synthetic coding sequence
atgatgtggcccatgcacacccccctgctgctgctgaccgccctgatggtggccgtggccggcagcgccagcgcccagagcagaaccctggccggcggcatccacgccaccgacctgaacgacaagagcgtgcagtgcgccctggacttcgccatcagcgagtacaacaaggtgatcaacaaggacgagtactacagcagacccctgcaggtgatggccgcctaccagcagatcgtgggcggcgtgaactactacttcaacgtgaagttcggcagaaccacctgcaccaagagccagcccaacctggacaactgccccttcaacgaccagcccaagctgaaggaggaggagttctgcagcttccagatcaacgaggtgccctgggaggacaagatcagcatcctgaactacaagtgcagaaaggtgtag

SEQ ID NO: 78095 - DNA, 1578 bp, Artificial Sequence
  Description of Artificial Sequence: Synthetic coding sequence
atggccaccctgctgagaagcaagctgagcaacgtggccaccagcgtgagcaacaagagccaggccaagatgagcggcatgttcgccagaatgggcttccaggccgccaccgacgaggaggccgtgggcttcgcccactgcgacgacctggacttcgagcacagacagggcctgcagatggacatcctgaaggccgagggcgagccctgcggcgacgagggcgccgaggcccccgtggagggcgacatccactaccagagaggcagcggcgcccccctgccccccagcggcagcaaggaccaggtgggcggcggcggcgagttcggcggccacgacaagcccaagatcaccgcctgggaggccggctggaacgtgaccaacgccatccagggcatgttcgtgctgggcctgccctacgccatcctgcacggcggctacctgggcctgttcctgatcatcttcgccgccgtggtgtgctgctacaccggcaagatcctgatcgcctgcctgtacgaggagaacgaggacggcgaggtggtgagagtgagagacagctacgtggccatcgccaacgcctgctgcgcccccagattccccaccctgggcggcagagtggtgaacgtggcccagatcatcgagctggtgatgacctgcatcctgtacgtggtggtgagcggcaacctgatgtacaacagcttccccggcctgcccgtgagccagaagagctggagcatcatcgccaccgccgtgctgctgccctgcgccttcctgaagaacctgaaggccgtgagcaagttcagcctgctgtgcaccctggcccacttcgtgatcaacatcctggtgatcgcctactgcctgagcagagccagagactgggcctgggagaaggtgaagttctacatcgacgtgaagaagttccccatcagcatcggcatcatcgtgttcagctacaccagccagatcttcctgcccagcctggagggcaacatgcagcagcccagcgagttccactgcatgatgaactggacccacatcgccgcctgcgtgctgaagggcctgttcgccctggtggcctacctgacctgggccgacgagaccaaggaggtgatcaccgacaacctgcccggcagcatcagagccgtggtgaacatcttcctggtggccaaggccctgctgagctaccccctgcccttcttcgccgccgtggaggtgctggagaagagcctgttccaggagggcagcagagccttcttccccgcctgctacagcggcgacggcagactgaagagctggggcctgaccctgagatgcgccctggtggtgttcaccctgctgatggccatctacgtgccccacttcgccctgctgatgggcctgaccggcagcctgaccggcgccggcctgtgcttcctgctgcccagcctgttccacctgagactgctgtggagaaagctgctgtggcaccaggtgttcttcgacgtggccatcttcgtgatcggcggcatctgcagcgtgagcggcttcgtgcacagcctggagggcctgatcgaggcctacagaaccaacgccgaggactag

SEQ ID NO: 78096 - DNA, 426 bp, Artificial Sequence
  Description of Artificial Sequence: Synthetic coding sequence
atggcctggcccctgtgcaccctgctgctgctgctggccacccaggccgtggccctggcctggagcccccaggaggaggacagaatcatcgagggcggcatctacgacgccgacctgaacgacgagagagtgcagagagccctgcacttcgtgatcagcgagtacaacaaggccaccgaggacgagtactacagaagactgctgagagtgctgagagccagagagcagatcgtgggcggcgtgaactacttcttcgacatcgaggtgggcagaaccatctgcaccaagagccagcccaacctggacacctgcgccttccacgagcagcccgagctgcagaagaagcagctgtgcagcttccagatctacgaggtgccctgggaggacagaatgagcctggtgaacagcagatgccaggaggcctag

SEQ ID NO: 78097 - DNA, 426 bp, Artificial Sequence
  Description of Artificial Sequence: Synthetic coding sequence
atggcccagtacctgagcaccctgctgctgctgctggccaccctggccgtggccctggcctggagccccaaggaggaggacagaatcatccccggcggcatctacaacgccgacctgaacgacgagtgggtgcagagagccctgcacttcgccatcagcgagtacaacaaggccaccaaggacgactactacagaagacccctgagagtgctgagagccagacagcagaccgtgggcggcgtgaactacttcttcgacgtggaggtgggcagaaccatctgcaccaagagccagcccaacctggacacctgcgccttccacgagcagcccgagctgcagaagaagcagctgtgcagcttcgagatctacgaggtgccctgggagaacagaagaagcctggtgaagagcagatgccaggagagctag

SEQ ID NO: 78098 - DNA, 426 bp, Artificial Sequence; identical to SEQ ID NO: 78097
  Description of Artificial Sequence: Synthetic coding sequence

SEQ ID NO: 78099 - DNA, 582 bp, Artificial Sequence
  Description of Artificial Sequence: Synthetic coding sequence
atgcccaactggggcggcggcaagaagtgcggcgtgtgccagaagaccgtgtacttcgccgaggaggtgcagtgcgagggcaacagcttccacaagagctgcttcctgtgcatggtgtgcaagaagaacctggacagcaccaccgtggccgtgcacggcgaggagatctactgcaagagctgctacggcaagaagtacggccccaagggctacggctacggccagggcgccggcaccctgagcaccgacaagggcgagagcctgggcatcaagcacgaggaggcccccggccacagacccaccaccaaccccaacgccagcaagttcgcccagaagatcggcggcagcgagagatgccccagatgcagccaggccgtgtacgccgccgagaaggtgatcggcgccggcaagagctggcacaaggcctgcttcagatgcgccaagtgcggcaagggcctggagagcaccaccctggccgacaaggacggcgagatctactgcaagggctgctacgccaagaacttcggccccaagggcttcggcttcggccagggcgccggcgccctggtgcacagcgagtag

SEQ ID NO: 78100 - DNA, 582 bp, Artificial Sequence; identical to SEQ ID NO: 78099
  Description of Artificial Sequence: Synthetic coding sequence

SEQ ID NO: 78101 - DNA, 582 bp, Artificial Sequence; identical to SEQ ID NO: 78099
  Description of Artificial Sequence: Synthetic coding sequence

SEQ ID NO: 78102 - DNA, 582 bp, Artificial Sequence; identical to SEQ ID NO: 78099
  Description of Artificial Sequence: Synthetic coding sequence

SEQ ID NO: 78103 - DNA, 513 bp, Artificial Sequence
  Description of Artificial Sequence: Synthetic coding sequence
atgcccaactggggcggcggcaagaagtgcggcgtgtgccagaagaccgtgtacttcgccgaggaggtgcagtgcgagggcaacagcttccacaagagctgcttcctgtgcatggtgtgcaagaagaacctggacagcaccaccgtggccgtgcacggcgaggagatctactgcaagagctgctacggcaagaagtacggccccaagggctacggctacggccagggcgccggcaccaaccccaacgccagcaagttcgcccagaagatcggcggcagcgagagatgccccagatgcagccaggccgtgtacgccgccgagaaggtgatcggcgccggcaagagctggcacaaggcctgcttcagatgcgccaagtgcggcaagggcctggagagcaccaccctggccgacaaggacggcgagatctactgcaagggctgctacgccaagaacttcggccccaagggcttcggcttcggccagggcgccggcgccctggtgcacagcgagtag

SEQ ID NO: 78104 - DNA, 582 bp, Artificial Sequence
  Description of Artificial Sequence: Synthetic coding sequence
atgcccgtgtggggcggcggcaacaagtgcggcgcctgcggcagaaccgtgtaccacgccgaggaggtgcagtgcgacggcagaagcttccacagatgctgcttcctgtgcatggtgtgcagaaagaacctggacagcaccaccgtggccatccacgacgaggagatctactgcaagagctgctacggcaagaagtacggccccaagggctacggctacggccagggcgccggcaccctgaacatggacagaggcgagagactgggcatcaagcccgagagcgtgcagccccacagacccaccaccaaccccaacaccagcaagttcgcccagaagtacggcggcgccgagaagtgcagcagatgcggcgacagcgtgtacgccgccgagaagatcatcggcgccggcaagccctggcacaagaactgcttcagatgcgccaagtgcggcaagagcctggagagcaccaccctgaccgagaaggagggcgagatctactgcaagggctgctacgccaagaacttcggccccaagggcttcggctacggccagggcgccggcgccctggtgcacgcccagtag

SEQ ID NO: 78105 - DNA, 582 bp, Artificial Sequence; identical to SEQ ID NO: 78104
  Description of Artificial Sequence: Synthetic coding sequence

SEQ ID NO: 78106 - DNA, 585 bp, Artificial Sequence
  Description of Artificial Sequence: Synthetic coding sequence
atgcccaactggggcggcggcgccaagtgcggcgcctgcgagaagaccgtgtaccacgccgaggagatccagtgcaacggcagaagcttccacaagacctgcttccactgcatggcctgcagaaaggccctggacagcaccaccgtggccgcccacgagagcgagatctactgcaaggtgtgctacggcagaagatacggccccaagggcatcggctacggccagggcgccggctgcctgagcaccgacaccggcgagcacctgggcctgcagttccagcagagccccaagcccgccagaagcgtgaccaccagcaaccccagcaagttcaccgccaagttcggcgagagcgagaagtgccccagatgcggcaagagcgtgtacgccgccgagaaggtgatgggcggcggcaagccctggcacaagacctgcttcagatgcgccatctgcggcaagagcctggagagcaccaacgtgaccgacaaggacggcgagctgtactgcaaggtgtgctacgccaagaacttcggccccaccggcatcggcttcggcggcctgacccagcaggtggagaagaaggagtag

SEQ ID NO: 78107 - DNA, 585 bp, Artificial Sequence; identical to SEQ ID NO: 78106
  Description of Artificial Sequence: Synthetic coding sequence

SEQ ID NO: 78108 - DNA, 1365 bp, Artificial Sequence
  Description of Artificial Sequence: Synthetic coding sequence
atgttcctggcccagagaagcctgtgcagcctgagcggcagagccaagttcctgaagaccatcagcagcagcaagatcctgggcttcagcaccagcgccaagatgagcctgaagttcaccaacgccaagagaatcgagggcctggacagcaacgtgtggatcgagttcaccaagctggccgccgaccccagcgtggtgaacctgggccagggcttccccgacatcagcccccccacctacgtgaaggaggagctgagcaagatcgccgccatcgacagcctgaaccagtacaccagaggcttcggccaccccagcctggtgaaggccctgagctacctgtacgagaagctgtaccagaagcagatcgacagcaacaaggagatcctggtgaccgtgggcgcctacggcagcctgttcaacaccatccaggccctgatcgacgagggcgacgaggtgatcctgatcgtgcccttctacgactgctacgagcccatggtgagaatggccggcgccacccccgtgttcatccccctgagaagcaagcccgtgtacggcaagagatggagcagcagcgactggaccctggacccccaggagctggagagcaagttcaacagcaagaccaaggccatcatcctgaacaccccccacaaccccctgggcaaggtgtacaacagagaggagctgcaggtgatcgccgacctgtgcatcaagtacgacaccctgtgcatcagcgacgaggtgtacgagtggctggtgtacagcggcaacaagcacctgaagatcgccaccttccccggcatgtgggagagaaccatcaccatcggcagcgccggcaagaccttcagcgtgaccggctggaagctgggctggagcatcggccccaaccacctgatcaagcacctgcagaccgtgcagcagaacaccatctacacctgcgccacccccctgcaggaggccctggcccaggccttctggatcgacatcaagagaatggacgaccccgagtgctacttcaacagcctgcccaaggagctggaggtgaagagagacagaatggtgagactgctggagagcgtgggcctgaagcccatcgtgcccgacggcggctacttcatcatcgccgacgtgagcctgctggaccccgacctgagcgacatgaagaacaacgagccctacgactacaagttcgtgaagtggatgaccaagcacaagaagctgagcgccatccccgtgagcgccttctgcaacagcgagaccaagagccagttcgagaagttcgtgagattctgcttcatcaagaaggacagcaccctggacgccgccgaggagatcatcaaggcctggagcgtgcagaagagctag

SEQ ID NO: 78109 - DNA, 504 bp, Artificial Sequence
  Description of Artificial Sequence: Synthetic coding sequence
atgttcctggcccagagaagcctgtgcagcctgagcggcagagccaagttcctgaagaccatcagcagcagcaagatcctgggcttcagcaccagcgccaagatgagcctgaagttcaccaacgccaagagaatcgagggcctggacagcaacgtgtggatcgagttcaccaagctggccgccgaccccagcgtggtgaacctgggccagggcttccccgacatcagcccccccacctacgtgaaggaggagctgagcaagatcgccgccatcgacagcctgaaccagtacaccagaggcttcggccaccccagcctggtgaaggccctgagctacctgtacgagaagctgtaccagaagcagatcgacagcaacaaggagatcctggtgaccgtgggcgcctacggcagcctgttcaacaccatccaggccctgatcgacgagggcgacgagtacaacgcctgcaccgtgaagttcaccaacctgaagtgcaccgccggctag

SEQ ID NO: 78110 - DNA, 789 bp, Artificial Sequence
  Description of Artificial Sequence: Synthetic coding sequence
atgttcctggcccagagaagcctgtgcagcctgagcggcagagccaagttcctgaagaccatcagcagcagcaagatcctgggcttcagcaccagcgccaagatgagcctgaagttcaccaacgccaagagaatcgagggcctggacagcaacgtgtggatcgagttcaccaagctggccgccgaccccagcgtggtgaacctgggccagggcttccccgacatcagcccccccacctacgtgaaggaggagctgagcaagatcgccgccatcgacagcctgaaccagtacaccagaggcttcggccaccccagcctggtgaaggccctgagctacctgtacgagaagctgtaccagaagcagatcgacagcaacaaggagatcctggtgaccgtgggcgcctacggcagcctgttcaacaccatccaggccctgatcgacgagggcgacgaggtgatcctgatcgtgcccttctacgactgctacgagcccatggtgagaatggccggcgccacccccgtgttcatccccctgagaagcaagcccgtgtacggcaagagatggagcagcagcgactggaccctggacccccaggagctggagagcaagttcaacagcaagaccaaggccatcatcctgaacaccccccacaaccccctgggcaaggtgtacaacagagaggagctgcaggtgatcgccgacctgtgcatcaagtacgacaccctgtgcatcagcgacgaggtgtacgagtggctggtgtacagcggcaacaagcacctgaagatctag

SEQ ID NO: 78111 - DNA, 1263 bp, Artificial Sequence
  Description of Artificial Sequence: Synthetic coding sequence
atgagcctgaagttcaccaacgccaagagaatcgagggcctggacagcaacgtgtggatcgagttcaccaagctggccgccgaccccagcgtggtgaacctgggccagggcttccccgacatcagcccccccacctacgtgaaggaggagctgagcaagatcgccgccatcgacagcctgaaccagtacaccagaggcttcggccaccccagcctggtgaaggccctgagctacctgtacgagaagctgtaccagaagcagatcgacagcaacaaggagatcctggtgaccgtgggcgcctacggcagcctgttcaacaccatccaggccctgatcgacgagggcgacgaggtgatcctgatcgtgcccttctacgactgctacgagcccatggtgagaatggccggcgccacccccgtgttcatccccctgagaagcaagcccgtgtacggcaagagatggagcagcagcgactggaccctggacccccaggagctggagagcaagttcaacagcaagaccaaggccatcatcctgaacaccccccacaaccccctgggcaaggtgtacaacagagaggagctgcaggtgatcgccgacctgtgcatcaagtacgacaccctgtgcatcagcgacgaggtgtacgagtggctggtgtacagcggcaacaagcacctgaagatcgccaccttccccggcatgtgggagagaaccatcaccatcggcagcgccggcaagaccttcagcgtgaccggctggaagctgggctggagcatcggccccaaccacctgatcaagcacctgcagaccgtgcagcagaacaccatctacacctgcgccacccccctgcaggaggccctggcccaggccttctggatcgacatcaagagaatggacgaccccgagtgctacttcaacagcctgcccaaggagctggaggtgaagagagacagaatggtgagactgctggagagcgtgggcctgaagcccatcgtgcccgacggcggctacttcatcatcgccgacgtgagcctgctggaccccgacctgagcgacatgaagaacaacgagccctacgactacaagttcgtgaagtggatgaccaagcacaagaagctgagcgccatccccgtgagcgccttctgcaacagcgagaccaagagccagttcgagaagttcgtgagattctgcttcatcaagaaggacagcaccctggacgccgccgaggagatcatcaaggcctggagcgtgcagaagagctag

SEQ ID NO: 78112 - DNA, 1269 bp, Artificial Sequence
  Description of Artificial Sequence: Synthetic coding sequence
atggccaagcagctgcaggccagaagactggacggcatcgactacaacccctgggtggagttcgtgaagctggccagcgagcacgacgtggtgaacctgggccagggcttccccgacttccccccccccgacttcgccgtggaggccttccagcacgccgtgagcggcgacttcatgctgaaccagtacaccaagaccttcggctacccccccctgaccaagatcctggccagcttcttcggcgagctgctgggccaggagatcgaccccctgagaaacgtgctggtgaccgtgggcggctacggcgccctgttcaccgccttccaggccctggtggacgagggcgacgaggtgatcatcatcgagcccttcttcgactgctacgagcccatgaccatgatggccggcggcagacccgtgttcgtgagcctgaagcccggccccatccagaacggcgagctgggcagcagcagcaactggcagctggaccccatggagctggccggcaagttcaccagcagaaccaaggccctggtgctgaacacccccaacaaccccctgggcaaggtgttcagcagagaggagctggagctggtggccagcctgtgccagcagcacgacgtggtgtgcatcaccgacgaggtgtaccagtggatggtgtacgacggccaccagcacatcagcatcgccagcctgcccggcatgtgggagagaaccctgaccatcggcagcgccggcaagaccttcagcgccaccggctggaaggtgggctgggtgctgggccccgaccacatcatgaagcacctgagaaccgtgcaccagaacagcgtgttccactgccccacccagagccaggccgccgtggccgagagcttcgagagagagcagctgctgttcagacagcccagcagctacttcgtgcagttcccccaggccatgcagagatgcagagaccacatgatcagaagcctgcagagcgtgggcctgaagcccatcatcccccagggcagctacttcctgatcaccgacatcagcgacttcaagagaaagatgcccgacctgcccggcgccgtggacgagccctacgacagaagattcgtgaagtggatgatcaagaacaagggcctggtggccatccccgtgagcatcttctacagcgtgccccaccagaagcacttcgaccactacatcagattctgcttcgtgaaggacgaggccaccctgcaggccatggacgagaagctgagaaagtggaaggtggagctgtag

SEQ ID NO: 78113 - DNA, 1119 bp, Artificial Sequence
  Description of Artificial Sequence: Synthetic coding sequence
atggccaagcagctgcaggccagaagactggacggcatcgactacaacccctgggtggagttcgtgaagctggccagcgagcacgacgtggtgaacctgggccagggcttccccgacttccccccccccgacttcgccgtggaggccttccagcacgccgtgagcggcgacttcatgctgaaccagtacaccaagaccttcgtgatcatcatcgagcccttcttcgactgctacgagcccatgaccatgatggccggcggcagacccgtgttcgtgagcctgaagcccggccccatccagaacggcgagctgggcagcagcagcaactggcagctggaccccatggagctggccggcaagttcaccagcagaaccaaggccctggtgctgaacacccccaacaaccccctgggcaaggtgttcagcagagaggagctggagctggtggccagcctgtgccagcagcacgacgtggtgtgcatcaccgacgaggtgtaccagtggatggtgtacgacggccaccagcacatcagcatcgccagcctgcccggcatgtgggagagaaccctgaccatcggcagcgccggcaagaccttcagcgccaccggctggaaggtgggctgggtgctgggccccgaccacatcatgaagcacctgagaaccgtgcaccagaacagcgtgttccactgccccacccagagccaggccgccgtggccgagagcttcgagagagagcagctgctgttcagacagcccagcagctacttcgtgcagttcccccaggccatgcagagatgcagagaccacatgatcagaagcctgcagagcgtgggcctgaagcccatcatcccccagggcagctacttcctgatcaccgacatcagcgacttcaagagaaagatgcccgacctgcccggcgccgtggacgagccctacgacagaagattcgtgaagtggatgatcaagaacaagggcctggtggccatccccgtgagcatcttctacagcgtgccccaccagaagcacttcgaccactacatcagattctgcttcgtgaaggacgaggccaccctgcaggccatggacgagaagctgagaaagtggaaggtggagctgtag

SEQ ID NO: 78114 - DNA, 480 bp, Artificial Sequence
  Description of Artificial Sequence: Synthetic coding sequence
gccatggccaagcagctgcaggccagaagactggacggcatcgactacaacccctgggtggagttcgtgaagctggccagcgagcacgacgtggtgaacctgggccagggcttccccgacttccccccccccgacttcgccgtggaggccttccagcacgccgtgagcggcgacttcatgctgaaccagtacaccaagaccttcgtgagcctgtgctaccccggctggagcgccatggtgagaagctggagcaccgccgccctgaccctgcccgtgagcagcggcccccccaccagcgccagcggcgtgaccggcaccaccggctggagccagagctggctggagagcagcttcttcgaccccaagaagaagaagatcatctggggctacccccccctgaccaagatcctggccagcttcttcggcgagctgctgggccaggagatcgaccccctgagaaacgtgctggtgaccgtgtag

SEQ ID NO: 78115 - DNA, 555 bp, Artificial Sequence
  Description of Artificial Sequence: Synthetic coding sequence
atggccaagcagctgcaggccagaagactggacggcatcgactacaacccctgggtggagttcgtgaagctggccagcgagcacgacgtggtgaacctgggccagggcttccccgacttccccccccccgacttcgccgtggaggccttccagcacgccgtgagcggcgacttcatgctgaaccagtacaccaagaccttcggctacccccccctgaccaagatcctggccagcttcttcggcgagctgctgggccaggagatcgaccccctgagaaacgtgctggtgaccgtgggcggctacggcgccctgttcaccgccttccaggccctggtggacgagggcgacgaggtgatcatcatcgagcccttcttcgactgctacgagcccatgaccatgatggccggcggcagacccgtgttcgtgagcctgaagcccggccccatccagaacggcgagctgggcagcagcagcaactggcagctggaccccatggagctggccggcaagttcaccagcagaaccaaggccctggtgctgaacacccccaactag

SEQ ID NO: 78116 - DNA, 480 bp, Artificial Sequence; identical to SEQ ID NO: 78114
  Description of Artificial Sequence: Synthetic coding sequence

SEQ ID NO: 78117 - DNA, 1551 bp, Artificial Sequence
  Description of Artificial Sequence: Synthetic coding sequence
atgttcagaaccgccgccgccatcagcgtgcacctggtgggccccctgcagggcagaaaggccggcgcccccctgacctggttcctgcaccagacccaggtggccgagaagaacgtgggcagccccgcccccagacccaccagccacctgggcctggccaacccccaggagagaaaggtgccccagggcccccagagcccctgcgaggtgcccgccgccgagggcatcctgagaaccggcggcgccaagctgcccatccagggccaccccgccaagctggccatggccaagcagctgcaggccagaagactggacggcatcgactacaacccctgggtggagttcgtgaagctggccagcgagcacgacgtggtgaacctgggccagggcttccccgacttccccccccccgacttcgccgtggaggccttccagcacgccgtgagcggcgacttcatgctgaaccagtacaccaagaccttcggctacccccccctgaccaagatcctggccagcttcttcggcgagctgctgggccaggagatcgaccccctgagaaacgtgctggtgaccgtgggcggctacggcgccctgttcaccgccttccaggccctggtggacgagggcgacgaggtgatcatcatcgagcccttcttcgactgctacgagcccatgaccatgatggccggcggcagacccgtgttcgtgagcctgaagcccggccccatccagaacggcgagctgggcagcagcagcaactggcagctggaccccatggagctggccggcaagttcaccagcagaaccaaggccctggtgctgaacacccccaacaaccccctgggcaaggtgttcagcagagaggagctggagctggtggccagcctgtgccagcagcacgacgtggtgtgcatcaccgacgaggtgtaccagtggatggtgtacgacggccaccagcacatcagcatcgccagcctgcccggcatgtgggagagaaccctgaccatcggcagcgccggcaagaccttcagcgccaccggctggaaggtgggctgggtgctgggccccgaccacatcatgaagcacctgagaaccgtgcaccagaacagcgtgttccactgccccacccagagccaggccgccgtggccgagagcttcgagagagagcagctgctgttcagacagcccagcagctacttcgtgcagttcccccaggccatgcagagatgcagagaccacatgatcagaagcctgcagagcgtgggcctgaagcccatcatcccccagggcagctacttcctgatcaccgacatcagcgacttcaagagaaagatgcccgacctgcccggcgccgtggacgagccctacgacagaagattcgtgaagtggatgatcaagaacaagggcctggtggccatccccgtgagcatcttctacagcgtgccccaccagaagcacttcgaccactacatcagattctgcttcgtgaaggacgaggccaccctgcaggccatggacgagaagctgagaaagtggaaggtggagctgtag

SEQ ID NO: 78118 - DNA, 756 bp, Artificial Sequence
  Description of Artificial Sequence: Synthetic coding sequence
atggccaagcagctgcaggccagaagactggacggcatcgactacaacccctgggtggagttcgtgaagctggccagcgagcacgacgtggtgaacctgggccagggcttccccgacttccccccccccgacttcgccgtggaggccttccagcacgccgtgagcggcgacttcatgctgaaccagtacaccaagaccttcggctacccccccctgaccaagatcctggccagcttcttcggcgagctgctgggccaggagatcgaccccctgagaaacgtgctggtgaccgtgggcggctacggcgccctgttcaccgccttccaggccctggtggacgagggcgacgaggtgatcatcatcgagcccttcttcgactgctacgagcccatgaccatgatggccggcggcagacccgtgttcgtgagcctgaagcccggccccatccagaacggcgagctgggcagcagcagcaactggcagctggaccccatggagctggccggcaagttcaccagcagaaccaaggccctggtgctgaacacccccaacaaccccctgggcaaggtgttcagcagagaggagctggagctggtggccagcctgtgccagcagcacgacgtggtgtgcatcaccgacgaggtgtaccagtggatggtgtacgacggccaccagcacatcagcatcgccagcctgcccggcatgtgggagagaaccctgaccatcggcagcgccggcaagaccttcagcgcctag

SEQ ID NO: 78119 - DNA, 603 bp, Artificial Sequence
  Description of Artificial Sequence: Synthetic coding sequence
atggagcagaccgaggtgctgaagcccagaaccctggccgacctgatcagaatcctgcaccagctgttcgccggcgacgaggtgaacgtggaggaggtgcaggccatcatggaggcctacgagagcgaccccaccgagtgggccatgtacgccaagttcgaccagtacagatacaccagaaacctggtggaccagggcaacggcaagttcaacctgatgatcctgtgctggggcgagggccacggcagcagcatccacgaccacaccaacagccactgcttcctgaagatgctgcagggcaacctgaaggagaccctgttcgcctggcccgacaagaagagcaacgagatggtgaagaagagcgagagagtgctgagagagaaccagtgcgcctacatcaacgacagcatcggcctgcacagagtggagaacatcagccacaccgagcccgccgtgagcctgcacctgtacagcccccccttcgacacctgccacgccttcgaccagagaaccggccacaagaacaaggtgaccatgaccttccacagcaagttcggcatcagaacccccaacgccaccagcggcagcctggagaacaactag

SEQ ID NO: 78120 - DNA, 3111 bp, Artificial Sequence
  Description of Artificial Sequence: Synthetic coding sequence
atgtacctggtggccggcgacagaggcctggccggctgcggccacctgctggtgagcctgctgggcctgctgctgctgctggccagaagcggcaccagagccctggtgtgcctgccctgcgacgagagcaagtgcgaggagcccagaaactgccccggcagcatcgtgcagggcgtgtgcggctgctgctacacctgcgccagccagagaaacgagagctgcggcggcaccttcggcatctacggcacctgcgacagaggcctgagatgcgtgatcagaccccccctgaacggcgacagcctgaccgagtacgaggccggcgtgtgcgaggacgagaactggaccgacgaccagctgctgggcttcaagccctgcaacgagaacctgatcgccggctgcaacatcatcaacggcaagtgcgagtgcaacaccatcagaacctgcagcaaccccttcgagttccccagccaggacatgtgcctgagcgccctgaagagaatcgaggaggagaagcccgactgcagcaaggccagatgcgaggtgcagttcagccccagatgccccgaggacagcgtgctgatcgagggctacgccccccccggcgagtgctgccccctgcccagcagatgcgtgtgcaaccccgccggctgcctgagaaaggtgtgccagcccggcaacctgaacatcctggtgagcaaggccagcggcaagcccggcgagtgctgcgacctgtacgagtgcaagcccgtgttcggcgtggactgcagaaccgtggagtgcccccccgtgcagcagaccgcctgcccccccgacagctacgagacccaggtgagactgaccgccgacggctgctgcaccctgcccaccagatgcgagtgcctgagcggcctgtgcggcttccccgtgtgcgaggtgggcagcacccccagaatcgtgagcagaggcgacggcacccccggcaagtgctgcgacgtgttcgagtgcgtgaacgacaccaagcccgcctgcgtgttcaacaacgtggagtactacgacggcgacatgttcagaatggacaactgcagattctgcagatgccagggcggcgtggccatctgcttcaccgcccagtgcggcgagatcaactgcgagagatactacgtgcccgagggcgagtgctgccccgtgtgcgaggaccccgtgtaccccttcaacaaccccgccggctgctacgccaacggcctgatcctggcccacggcgacagatggagagaggacgactgcaccttctgccagtgcgtgaacggcgagagacactgcgtggccaccgtgtgcggccagacctgcaccaaccccgtgaaggtgcccggcgagtgctgccccgtgtgcgaggagcccaccatcatcaccgtggacccccccgcctgcggcgagctgagcaactgcaccctgaccggcaaggactgcatcaacggcttcaagagagaccacaacggctgcagaacctgccagtgcatcaacaccgaggagctgtgcagcgagagaaagcagggctgcaccctgaactgccccttcggcttcctgaccgacgcccagaactgcgagatctgcgagtgcagacccagacccaagaagtgcagacccatcatctgcgacaagtactgccccctgggcctgctgaagaacaagcacggctgcgacatctgcagatgcaagaagtgccccgagctgagctgcagcaagatctgccccctgggcttccagcaggacagccacggctgcctgatctgcaagtgcagagaggccagcgccagcgccggcccccccatcctgagcggcacctgcctgaccgtggacggccaccaccacaagaacgaggagagctggcacgacggctgcagagagtgctactgcctgaacggcagagagatgtgcgccctgatcacctgccccgtgcccgcctgcggcaaccccaccatccaccccggccagtgctgccccagctgcgccgacgacttcgtggtgcagaagcccgagctgagcacccccagcatctgccacgcccccggcggcgagtacttcgtggagggcgagacctggaacatcgacagctgcacccagtgcacctgccacagcggcagagtgctgtgcgagaccgaggtgtgcccccccctgctgtgccagaaccccagcagaacccaggacagctgctgcccccagtgcaccgaccagcccttcagacccagcctgagcagaaacaacagcgtgcccaactactgcaagaacgacgagggcgacatcttcctggccgccgagagctggaagcccgacgtgtgcaccagctgcatctgcatcgacagcgtgatcagctgcttcagcgagagctgccccagcgtgagctgcgagagacccgtgctgagaaagggccagtgctgcccctactgcatcgaggacaccatccccaagaaggtggtgtgccacttcagcggcaaggcctacgccgacgaggagagatgggacctggacagctgcacccactgctactgcctgcagggccagaccctgtgcagcaccgtgagctgcccccccctgccctgcgtggagcccatcaacgtggagggcagctgctgccccatgtgccccgagatgtacgtgcccgagcccaccaacatccccatcgagaagaccaaccacagaggcgaggtggacctggaggtgcccctgtggcccacccccagcgagaacgacatcgtgcacctgcccagagacatgggccacctgcaggtggactacagagacaacagactgcaccccagcgaggacagcagcctggacagcatcgccagcgtggtggtgcccatcatcatctgcctgagcatcatcatcgccttcctgttcatcaaccagaagaagcagtggatccccctgctgtgctggtacagaacccccaccaagcccagcagcctgaacaaccagctggtgagcgtggactgcaagaagggcaccagagtgcaggtggacagcagccagagaatgctgagaatcgccgagcccgacgccagattcagcggcttctacagcatgcagaagcagaaccacctgcaggccgacaacttctaccagaccgtgtag

SEQ ID NO: 78121 - DNA, 498 bp, Artificial Sequence
  Description of Artificial Sequence: Synthetic coding sequence
atggccgacttcgacgagatctacgaggaggaggaggacgaggagagagccctggaggagcagctgctgaagtacagccccgaccccgtggtggtgagaggcagcggccacgtgaccgtgttcggcctgagcaacaagttcgagagcgagttccccagcagcctgaccggcaaggtggcccccgaggagttcaaggccagcatcaacagagtgaacagctgcctgaagaagaacctgcccgtgaacgtgagatggctgctgtgcggctgcctgtgctgctgctgcaccctgggctgcagcatgtggcccgtgatctgcctgagcaagagaaccagaagaagcatcgagaagctgctggagtgggagaacaacagactgtaccacaagctgtgcctgcactggagactgagcaagagaaagtgcgagaccaacaacatgatggagtacgtgatcctgatcgagttcctgcccaagacccccatcttcagacccgactag

SEQ ID NO: 78122 - DNA, 234 bp, Artificial Sequence
  Description of Artificial Sequence: Synthetic coding sequence
atgcccaagtgccccaagtgcaacaaggaggtgtacttcgccgagagagtgaccagcctgggcaaggactggcacagaccctgcctgaagtgcgagaagtgcggcaagaccctgaccagcggcggccacgccgagcacgagggcaagccctactgcaaccacccctgctacgccgccatgttcggccccaagggcttcggcagaggcggcgccgagagccacaccttcaagtag

SEQ ID NO: 78123 - DNA, 234 bp, Artificial Sequence; identical to SEQ ID NO: 78122
  Description of Artificial Sequence: Synthetic coding sequence

SEQ ID NO: 78124 - DNA, 234 bp, Artificial Sequence; identical to SEQ ID NO: 78122
  Description of Artificial Sequence: Synthetic coding sequence

SEQ ID NO: 78125 - DNA, 627 bp, Artificial Sequence
  Description of Artificial Sequence: Synthetic coding sequence
atggccagcaagtgccccaagtgcgacaagaccgtgtacttcgccgagaaggtgagcagcctgggcaaggactggcacaagttctgcctgaagtgcgagagatgcagcaagaccctgacccccggcggccacgccgagcacgacggcaagcccttctgccacaagccctgctacgccaccctgttcggccccaagggcgtgaacatcggcggcgccggcagctacatctacgagaagcccctggccgagggcccccaggtgaccggccccatcgaggtgcccgccgccagagccgaggagagaaaggccagcggcccccccaagggccccagcagagccagcagcgtgaccaccttcaccggcgagcccaacacctgccccagatgcagcaagaaggtgtacttcgccgagaaggtgaccagcctgggcaaggactggcacagaccctgcctgagatgcgagagatgcggcaagaccctgacccccggcggccacgccgagcacgacggccagccctactgccacaagccctgctacggcatcctgttcggccccaagggcgtgaacaccggcgccgtgggcagctacatctacgacagagaccccgagggcaaggtgcagccctag

SEQ ID NO: 78126 - DNA, 849 bp, Artificial Sequence
  Description of Artificial Sequence: Synthetic coding sequence
atgcccccccaccacctgctgccctggctggcccaggtgcccagcgccgagggcgagctggtgagactggtgagcagagccggcggcagaggcgcctgcttctggcccgccgtgaccatggagatggccgtggccgccggctgcgtgtgcaagggcggcggctgctgccacagagagcccagccaggaccaccacgagagccaggagcacagaggccccctggtgggcagccagacctgcctggtgcaccaggccgagggcaccgccgagaaggtgagcagcctgggcaaggactggcacaagttctgcctgaagtgcgagagatgcagcaagaccctgacccccggcggccacgccgagcacgacggcaagcccttctgccacaagccctgctacgccaccctgttcggccccaagggcgtgaacatcggcggcgccggcagctacatctacgagaagcccctggccgagggcccccaggtgaccggccccatcgaggtgcccgccgccagagccgaggagagaaaggccagcggcccccccaagggccccagcagagccagcagcgtgaccaccttcaccggcgagcccaacacctgccccagatgcagcaagaaggtgtacttcgccgagaaggtgaccagcctgggcaaggactggcacagaccctgcctgagatgcgagagatgcggcaagaccctgacccccggcggccacgccgagcacgacggccagccctactgccacaagccctgctacggcatcctgttcggccccaagggcgtgaacaccggcgccgtgggcagctacatctacgacagagaccccgagggcaaggtgcagccctag

SEQ ID NO: 78127 - DNA, 315 bp, Artificial Sequence
  Description of Artificial Sequence: Synthetic coding sequence
tgacccggcggcgagagagccgagggcgccggcagacccggcgcccccaccatggccagcaagtgccccaagtgcgacaagaccgtgtacttcgccgagaaggtgaccagcctgggcaaggactggcacagaccctgcctgagatgcgagagatgcggcaagaccctgacccccggcggccacgccgagcacgacggccagccctactgccacaagccctgctacggcatcctgttcggccccaagggcgtgaacaccggcgccgtgggcagctacatctacgacagagaccccgagggcaaggtgcagccctag

SEQ ID NO: 78128 - DNA, 537 bp, Artificial Sequence
  Description of Artificial Sequence: Synthetic coding sequence
atggagatcaagcacctgctgttcctggtggccgccgcctgcctgctgcccatgctgagcatgaagaagaagagcgccagagaccagttcaacaagctggtgaccgacctgcccaacgtgcaggaggagatcgtgaacatccacaacgccctgagaagaagagtggtgccccccgccagcaacatgctgaagatgagctggagcgaggaggccgcccagaacgccagaatcttcagcaagtactgcgacatgaccgagagcaaccccctggagagaagactgcccaacaccttctgcggcgagaacatgcacatgaccagctaccccgtgagctggagcagcgtgatcggcgtgtggtacagcgagagcaccagcttcaagcacggcgagtggaccaccaccgacgacgacatcaccaccgaccactacacccagatcgtgtgggccaccagctacctgatcggctgcgccatcgccagctgcagacagcagggcagccccagatacctgtacgtgtgccactactgccacgactag

SEQ ID NO: 78129 - DNA, 750 bp, Artificial Sequence
  Description of Artificial Sequence: Synthetic coding sequence
atggagatcaagcacctgctgttcctggtggccgccgcctgcctgctgcccatgctgagcatgaagaagaagagcgccagagaccagttcaacaagctggtgaccgacctgcccaacgtgcaggaggagatcgtgaacatccacaacgccctgagaagaagagtggtgccccccgccagcaacatgctgaagatgagctggagcgaggaggccgcccagaacgccagaatcttcagcaagtactgcgacatgaccgagagcaaccccctggagagaagactgcccaacaccttctgcggcgagaacatgcacatgaccagctaccccgtgagctggagcagcgtgatcggcgtgtggtacagcgagagcaccagcttcaagcacggcgagtggaccaccaccgacgacgacatcaccaccgaccactacacccagatcgtgtgggccaccagctacctgatcggctgcgccatcgccagctgcagacagcagggcagccccagatacctgtacgtgtgccactactgccacgagggcaacgaccccgagaccaagaacgagccctacaagaccggcgtgccctgcgaggcctgccccagcaactgcgaggacaagctgtgcaccaacccctgcatctactacgacgagtacttcgactgcgacatccaggtgcactacctgggctgcaaccacagcaccaccatcctgttctgcaaggccacctgcctgtgcgacaccgagatcaagtag

SEQ ID NO: 78130 - DNA, 750 bp, Artificial Sequence; identical to SEQ ID NO: 78129
  Description of Artificial Sequence: Synthetic coding sequence

SEQ ID NO: 78131 - DNA, 750 bp, Artificial Sequence; identical to SEQ ID NO: 78129
  Description of Artificial Sequence: Synthetic coding sequence

SEQ ID NO: 78132 - DNA, 537 bp, Artificial Sequence; identical to SEQ ID NO: 78128
  Description of Artificial Sequence: Synthetic coding sequence

SEQ ID NO: 78133 - DNA, 537 bp, Artificial Sequence; identical to SEQ ID NO: 78128
  Description of Artificial Sequence: Synthetic coding sequence

SEQ ID NO: 78134 - DNA, 669 bp, Artificial Sequence
  Description of Artificial Sequence: Synthetic coding sequence
atggccggcaagcccaagctgcactacttcaacggcagaggcagaatggagcccatcagatggctgctggccgccgccggcgtggagttcgaggagaagttcatcggcagcgccgaggacctgggcaagctgagaaacgacggcagcctgatgttccagcaggtgcccatggtggagatcgacggcatgaagctggtgcagaccagagccatcctgaactacatcgccagcaagtacaacctgtacggcaaggacatcaaggagagagccctgatcgacatgtacaccgagggcatggccgacctgaacgagatgatcctgctgctgcccctgtgcagacccgaggagaaggacgccaagatcgccctgatcaaggagaagaccaagagcagatacttccccgccttcgagaaggtgctgcagagccacggccaggactacctggtgggcaacaagctgagcagagccgacatcagcctggtggagctgctgtactacgtggaggagctggacagcagcctgatcagcaacttccccctgctgaaggccctgaagaccagaatcagcaacctgcccaccgtgaagaagttcctgcagcccggcagccccagaaagccccccgccgacgccaaggccctggaggaggccagaaagatcttcagattctag

SEQ ID NO: 78135 - DNA, 732 bp, Artificial Sequence
  Description of Artificial Sequence: Synthetic coding sequence
atggccctgctgcccgtgctgttcctggtgaccgtgctgctgcccagcctgcccgccgagggcaaggaccccgccttcaccgccctgctgaccacccagctgcaggtgcagagagagatcgtgaacaagcacaacgagctgagaaaggccgtgagcccccccgccagcaacatgctgaagatggagtggagcagagaggtgaccaccaacgcccagagatgggccaacaagtgcaccctgcagcacagcgaccccgaggacagaaagaccagcaccagatgcggcgagaacctgtacatgagcagcgaccccaccagctggagcagcgccatccagagctggtacgacgagatcctggacttcgtgtacggcgtgggccccaagagccccaacgccgtggtgggccactacacccagctggtgtggtacagcacctaccaggtgggctgcggcatcgcctactgccccaaccaggacagcctgaagtactactacgtgtgccagtactgccccgccggcaacaacatgaacagaaagaacaccccctaccagcagggcaccccctgcgccggctgccccgacgactgcgacaagggcctgtgcaccaacagctgccagtaccaggacctgctgagcaactgcgacagcctgaagaacaccgccggctgcgagcacgagctgctgaaggagaagtgcaaggccacctgcctgtgcgagaacaagatctactag

SEQ ID NO: 78136 - DNA, 1494 bp, Artificial Sequence
  Description of Artificial Sequence: Synthetic coding sequence
atgagctgcgtgctgggcggcgtgatccccctgggcctgctgttcctggtgtgcggcagccagggctacctgctgcccaacgtgaccctgctggaggagctgctgagcaagtaccagcacaacgagagccacagcagagtgagaagagccatccccagagaggacaaggaggagatcctgatgctgcacaacaagctgagaggccaggtgcagccccaggccagcaacatggagtacatgacctgggacgacgagctggagaagagcgccgccgcctgggccagccagtgcatctgggagcacggccccaccagcctgctggtgagcatcggccagaacctgggcgcccactggggcagatacagaagccccggcttccacgtgcagagctggtacgacgaggtgaaggactacacctacccctaccccagcgagtgcaacccctggtgccccgagagatgcagcggccccatgtgcacccactacacccagatcgtgtgggccaccaccaacaagatcggctgcgccgtgaacacctgcagaaagatgaccgtgtggggcgaggtgtgggagaacgccgtgtacttcgtgtgcaactacagccccaagggcaactggatcggcgaggccccctacaagaacggcagaccctgcagcgagtgcccccccagctacggcggcagctgcagaaacaacctgtgctacagagaggagacctacacccccaagcccgagaccgacgagatgaacgaggtggagaccgcccccatccccgaggagaaccacgtgtggctgcagcccagagtgatgagacccaccaagcccaagaagaccagcgccgtgaactacatgacccaggtggtgagatgcgacaccaagatgaaggacagatgcaagggcagcacctgcaacagataccagtgccccgccggctgcctgaaccacaaggccaagatcttcggcaccctgttctacgagagcagcagcagcatctgcagagccgccatccactacggcatcctggacgacaagggcggcctggtggacatcaccagaaacggcaaggtgcccttcttcgtgaagagcgagagacacggcgtgcagagcctgagcaagtacaagcccagcagcagcttcatggtgagcaaggtgaaggtgcaggacctggactgctacaccaccgtggcccagctgtgccccttcgagaagcccgccacccactgccccagaatccactgccccgcccactgcaaggacgagcccagctactgggcccccgtgttcggcaccaacatctacgccgacaccagcagcatctgcaagaccgccgtgcacgccggcgtgatcagcaacgagagcggcggcgacgtggacgtgatgcccgtggacaagaagaagacctacgtgggcagcctgagaaacggcgtgcagagcgagagcctgggcacccccagagacggcaaggccttcagaatcttcgccgtgagacagtag

SEQ ID NO: 78137 - DNA, 1269 bp, Artificial Sequence
  Description of Artificial Sequence: Synthetic coding sequence
atggccccctggccccccaagggcctggtgcccgccatgctgtggggcctgagcctgttcctgaacctgcccggccccatctggctgcagcccagcccccccccccagagcagcccccccccccagccccacccctgccacacctgcagaggcctggtggacagcttcaacaagggcctggagagaaccatcagagacaacttcggcggcggcaacaccgcctgggaggaggagaacctgagcaagtacaaggacagcgagaccagactggtggaggtgctggagggcgtgtgcagcaagagcgacttcgagtgccacagactgctggagctgagcgaggagctggtggagagctggtggttccacaagcagcaggaggcccccgacctgttccagtggctgtgcagcgacagcctgaagctgtgctgccccgccggcaccttcggccccagctgcctgccctgccccggcggcaccgagagaccctgcggcggctacggccagtgcgagggcgagggcaccagaggcggcagcggccactgcgactgccaggccggctacggcggcgaggcctgcggccagtgcggcctgggctacttcgaggccgagagaaacgccagccacctggtgtgcagcgcctgcttcggcccctgcgccagatgcagcggccccgaggagagcaactgcctgcagtgcaagaagggctgggccctgcaccacctgaagtgcgtggacatcgacgagtgcggcaccgagggcgccaactgcggcgccgaccagttctgcgtgaacaccgagggcagctacgagtgcagagactgcgccaaggcctgcctgggctgcatgggcgccggccccggcagatgcaagaagtgcagccccggctaccagcaggtgggcagcaagtgcctggacgtggacgagtgcgagaccgaggtgtgccccggcgagaacaagcagtgcgagaacaccgagggcggctacagatgcatctgcgccgagggctacaagcagatggagggcatctgcgtgaaggagcagatccccggcgccttccccatcctgaccgacctgacccccgagaccaccagaagatggaagctgggcagccacccccacagcacctacgtgaagatgaagatgcagagagacgaggccaccttccccggcctgtacggcaagcaggtggccaagctgggcagccagagcagacagagcgacagaggcaccagactgatccacagccagcaggccagcagccagagatag

SEQ ID NO: 78138 - DNA, 1263 bp, Artificial Sequence
  Description of Artificial Sequence: Synthetic coding sequence
atggccccctggccccccaagggcctggtgcccgccatgctgtggggcctgagcctgttcctgaacctgcccggccccatctggctgcagcccagcccccccccccagagcagcccccccccccagccccacccctgccacacctgcagaggcctggtggacagcttcaacaagggcctggagagaaccatcagagacaacttcggcggcggcaacaccgcctgggaggaggagaacctgagcaagtacaaggacagcgagaccagactggtggaggtgctggagggcgtgtgcagcaagagcgacttcgagtgccacagactgctggagctgagcgaggagctggtggagagctggtggttccacaagcagcaggaggcccccgacctgttccagtggctgtgcagcgacagcctgaagctgtgctgccccgccggcaccttcggccccagctgcctgccctgccccggcggcaccgagagaccctgcggcggctacggccagtgcgagggcgagggcaccagaggcggcagcggccactgcgactgccaggccggctacggcggcgaggcctgcggccagtgcggcctgggctacttcgaggccgagagaaacgccagccacctggtgtgcagcgcctgcttcggcccctgcgccagatgcagcggccccgaggagagcaactgcctgcagtgcaagaagggctgggccctgcaccacctgaagtgcgtggacatcgacgagtgcggcaccgagggcgccaactgcggcgccgaccagttctgcgtgaacaccgagggcagctacgagtgcagagactgcgccaaggcctgcctgggctgcatgggcgccggccccggcagatgcaagaagtgcagccccggctaccagcaggtgggcagcaagtgcctggacgtggacgagtgcgagaccgaggtgtgccccggcgagaacaagcagtgcgagaacaccgagggcggctacagatgcatctgcgccgagggctacaagcagatggagggcatctgcgtgaaggagcagatccccgagagcgccggcttcttcagcgagatgaccgaggacgagctggtggtgctgcagcagatgttcttcggcatcatcatctgcgccctggccaccctggccgccaagggcgacctggtgttcaccgccatcttcatcggcgccgtggccgccatgaccggctactggctgagcgagagaagcgacagagtgctggagggcttcatcaagggcagatag

SEQ ID NO: 78139 - DNA, 1263 bp, Artificial Sequence; identical to SEQ ID NO: 78138
  Description of Artificial Sequence: Synthetic coding sequence

SEQ ID NO: 78140 - DNA, 1263 bp, Artificial Sequence; identical to SEQ ID NO: 78138
  Description of Artificial Sequence: Synthetic coding sequence

SEQ ID NO: 78141 - DNA, 1140 bp, Artificial Sequence
  Description of Artificial Sequence: Synthetic coding sequence
atgagcagcagaatcgccagagccctggccctggtggtgaccctgctgcacctgaccagactggccctgagcacctgccccgccgcctgccactgccccctggaggcccccaagtgcgcccccggcgtgggcctggtgagagacggctgcggctgctgcaaggtgtgcgccaagcagctgaacgaggactgcagcaagacccagccctgcgaccacaccaagggcctggagtgcaacttcggcgccagcagcaccgccctgaagggcatctgcagagcccagagcgagggcagaccctgcgagtacaacagcagaatctaccagaacggcgagagcttccagcccaactgcaagcaccagtgcacctgcatcgacggcgccgtgggctgcatccccctgtgcccccaggagctgagcctgcccaacctgggctgccccaaccccagactggtgaaggtgaccggccagtgctgcgaggagtgggtgtgcgacgaggacagcatcaaggaccccatggaggaccaggacggcctgctgggcaaggagctgggcttcgacgccagcgaggtggagctgaccagaaacaacgagctgatcgccgtgggcaagggcagcagcctgaagagactgcccgtgttcggcatggagcccagaatcctgtacaaccccctgcagggccagaagtgcatcgtgcagaccaccagctggagccagtgcagcaagacctgcggcaccggcatcagcaccagagtgaccaacgacaaccccgagtgcagactggtgaaggagaccagaatctgcgaggtgagaccctgcggccagcccgtgtacagcagcctgaagaagggcaagaagtgcagcaagaccaagaagagccccgagcccgtgagattcacctacgccggctgcctgagcgtgaagaagtacagacccaagtactgcggcagctgcgtggacggcagatgctgcaccccccagctgaccagatgcgaggacgccgtgcccctgagaagatggggcgacatcttccaggagagacacgacgaccccgtgaagtgcaactacaactgcccccacgccaacgaggccgccttccccttctacagactgttcaacgacatccacaagttcagagactag

SEQ ID NO: 78142 - DNA, 1146 bp, Artificial Sequence
  Description of Artificial Sequence: Synthetic coding sequence
atgagcagcagaatcgccagagccctggccctggtggtgaccctgctgcacctgaccagactggccctgagcacctgccccgccgcctgccactgccccctggaggcccccaagtgcgcccccggcgtgggcctggtgagagacggctgcggctgctgcaaggtgtgcgccaagcagctgaacgaggactgcagcaagacccagccctgcgaccacaccaagggcctggagtgcaacttcggcgccagcagcaccgccctgaagggcatctgcagagcccagagcgagggcagaccctgcgagtacaacagcagaatctaccagaacggcgagagcttccagcccaactgcaagcaccagtgcacctgcatcgacggcgccgtgggctgcatccccctgtgcccccaggagctgagcctgcccaacctgggctgccccaaccccagactggtgaaggtgaccggccagtgctgcgaggagtgggtgtgcgacgaggacagcatcaaggaccccatggaggaccaggacggcctgctgggcaaggagctgggcttcgacgccagcgaggtggagctgaccagaaacaacgagctgatcgccgtgggcaagggcagcagcctgaagagactgcccgtgttcggcatggagcccagaatcctgtacaaccccctgcagggccagaagtgcatcgtgcagaccaccagctggagccagtgcagcaagacctgcggcaccggcatcagcaccagagtgaccaacgacaaccccgagtgcagactggtgaaggagaccagaatctgcgaggtgagaccctgcggccagcccgtgtacagcagcctgaagaagggcaagaagtgcagcaagaccaagaagagccccgagcccgtgagattcacctacgccggctgcctgagcgtgaagaagtacagacccaagtactgcggcagctgcgtggacggcagatgctgcaccccccagctgaccagaaccgtgaagatgagattcagatgcgaggacggcgagaccttcagcaagaacgtgatgatgatccagagctgcaagtgcaactacaactgcccccacgccaacgaggccgccttccccttctacagactgttcaacgacatccacaagttcagagactag

SEQ ID NO: 78143 - DNA, 1074 bp, Artificial Sequence
  Description of Artificial Sequence: Synthetic coding sequence
atgagcagcagaatcgccagagccctggccctggtggtgaccctgctgcacctgaccagactggccctgagcacctgcggctgctgcaaggtgtgcgccaagcagctgaacgaggactgcagcaagacccagccctgcgaccacaccaagggcctggagtgcaacttcggcgccagcagcaccgccctgaagggcatctgcagagcccagagcgagggcagaccctgcgagtacaacagcagaatctaccagaacggcgagagcttccagcccaactgcaagcaccagtgcacctgcatcgacggcgccgtgggctgcatccccctgtgcccccaggagctgagcctgcccaacctgggctgccccaaccccagactggtgaaggtgaccggccagtgctgcgaggagtgggtgtgcgacgaggacagcatcaaggaccccatggaggaccaggacggcctgctgggcaaggagctgggcttcgacgccagcgaggtggagctgaccagaaacaacgagctgatcgccgtgggcaagggcagcagcctgaagagactgcccgtgttcggcatggagcccagaatcctgtacaaccccctgcagggccagaagtgcatcgtgcagaccaccagctggagccagtgcagcaagacctgcggcaccggcatcagcaccagagtgaccaacgacaaccccgagtgcagactggtgaaggagaccagaatctgcgaggtgagaccctgcggccagcccgtgtacagcagcctgaagaagggcaagaagtgcagcaagaccaagaagagccccgagcccgtgagattcacctacgccggctgcctgagcgtgaagaagtacagacccaagtactgcggcagctgcgtggacggcagatgctgcaccccccagctgaccagaaccgtgaagatgagattcagatgcgaggacggcgagaccttcagcaagaacgtgatgatgatccagagctgcaagtgcaactacaactgcccccacgccaacgaggccgccttccccttctacagactgttcaacgacatccacaagttcagagactag

SEQ ID NO: 78144 - DNA, 1014 bp, Artificial Sequence
  Description of Artificial Sequence: Synthetic coding sequence
atggacgagaccggcaacctgaccgtgagcagcgccacctgccacgacaccatcgacgacttcagaaaccaggtgtacagcaccctgtacagcatgatcagcgtggtgggcttcttcggcaacggcttcgtgctgtacgtgctgatcaagacctaccacaagaagagcgccttccaggtgtacatgatcaacctggccgtggccgacctgctgtgcgtgtgcaccctgcccctgagagtggtgtactacgtgcacaagggcatctggctgttcggcgacttcctgtgcagactgagcacctacgccctgtacgtgaacctgtactgcagcatcttcttcatgaccgccatgagcttcttcagatgcatcgccatcgtgttccccgtgcagaacatcaacctggtgacccagaagaaggccagattcgtgtgcgtgggcatctggatcttcgtgatcctgaccagcagccccttcctgatggccaagccccagaaggacgagaagaacaacaccaagtgcttcgagcccccccaggacaaccagaccaagaaccacgtgctggtgctgcactacgtgagcctgttcgtgggcttcatcatccccttcgtgatcatcatcgtgtgctacaccatgatcatcctgaccctgctgaagaagagcatgaagaagaacctgagcagccacaagaaggccatcggcatgatcatggtggtgaccgccgccttcctggtgagcttcatgccctaccacatccagagaaccatccacctgcacttcctgcacaacgagaccaagccctgcgacagcgtgctgagaatgcagaagagcgtggtgatcaccctgagcctggccgccagcaactgctgcttcgaccccctgctgtacttcttcagcggcggcaacttcagaaagagactgagcaccttcagaaagcacagcctgagcagcgtgacctacgtgcccagaaagaaggccagcctgcccgagaagggcgaggagatctgcaaggtgtag

SEQ ID NO: 78145 - DNA, 1041 bp, Artificial Sequence
  Description of Artificial Sequence: Synthetic coding sequence
atggagagaaagttcatgagcctgcagcccagcatcagcgtgagcgagatggagcccaacggcaccttcagcaacaacaacagcagaaactgcaccatcgagaacttcaagagagagttcttccccatcgtgtacctgatcatcttcttctggggcgtgctgggcaacggcctgagcatctacgtgttcctgcagccctacaagaagagcaccagcgtgaacgtgttcatgctgaacctggccatcagcgacctgctgttcatcagcaccctgcccttcagagccgactactacctgagaggcagcaactggatcttcggcgacctggcctgcagaatcatgagctacagcctgtacgtgaacatgtacagcagcatctacttcctgaccgtgctgagcgtggtgagattcctggccatggtgcaccccttcagactgctgcacgtgaccagcatcagaagcgcctggatcctgtgcggcatcatctggatcctgatcatggccagcagcatcatgctgctggacagcggcagcgagcagaacggcagcgtgaccagctgcctggagctgaacctgtacaagatcgccaagctgcagaccatgaactacatcgccctggtggtgggctgcctgctgcccttcttcaccctgagcatctgctacctgctgatcatcagagtgctgctgaaggtggaggtgcccgagagcggcctgagagtgagccacagaaaggccctgaccaccatcatcatcaccctgatcatcttcttcctgtgcttcctgccctaccacaccctgagaaccgtgcacctgaccacctggaaggtgggcctgtgcaaggacagactgcacaaggccctggtgatcaccctggccctggccgccgccaacgcctgcttcaaccccctgctgtactacttcgccggcgagaacttcaaggacagactgaagagcgccctgagaaagggccacccccagaaggccaagaccaagtgcgtgttccccgtgagcgtgtggctgagaaaggagaccagagtgtag

SEQ ID NO: 78146 - DNA, 2181 bp, Artificial Sequence
  Description of Artificial Sequence: Synthetic coding sequence
atggccgacagcagcggccagcagggcaagggcagaagagtgcagccccagtggagcccccccgccggcacccagccctgcagactgcacctgtacaacagcctgaccagaaacaaggaggtgttcatcccccaggacggcaagaaggtgacctggtactgctgcggccccaccgtgtacgacgccagccacatgggccacgccagaagctacatcagcttcgacatcctgagaagagtgctgaaggactacttcaagttcgacgtgttctactgcatgaacatcaccgacatcgacgacaagatcatcaagagagccagacagaaccacctgttcgagcagtacagagagaagagacccgaggccgcccagctgctggaggacgtgcaggccgccctgaagcccttcagcgtgaagctgaacgagaccaccgaccccgacaagaagcagatgctggagagaatccagcacgccgtgcagctggccaccgagcccctggagaaggccgtgcagagcagactgaccggcgaggaggtgaacagctgcgtggaggtgctgctggaggaggccaaggacctgctgagcgactggctggacagcaccctgggctgcgacgtgaccgacaacagcatcttcagcaagctgcccaagttctgggagggcgacttccacagagacatggaggccctgaacgtgctgccccccgacgtgctgaccagagtgagcgagtacgtgcccgagatcgtgaacttcgtgcagaagatcgtggacaacggctacggctacgtgagcaacggcagcgtgtacttcgacaccgccaagttcgccagcagcgagaagcacagctacggcaagctggtgcccgaggccgtgggcgaccagaaggccctgcaggagggcgagggcgacctgagcatcagcgccgacagactgagcgagaagagaagccccaacgacttcgccctgtggaaggccagcaagcccggcgagcccagctggccctgcccctggggcaagggcagacccggctggcacatcgagtgcagcgccatggccggcaccctgctgggcgccagcatggacatccacggcggcggcttcgacctgagattcccccaccacgacaacgagctggcccagagcgaggcctacttcgagaacgactgctgggtgagatacttcctgcacaccggccacctgaccatcgccggctgcaagatgagcaagagcctgaagaacttcatcaccatcaaggacgccctgaagaagcacagcgccagacagctgagactggccttcctgatgcacagctggaaggacaccctggactacagcagcaacaccatggagagcgccctgcagtacgagaagttcctgaacgagttcttcctgaacgtgaaggacatcctgagagcccccgtggacatcaccggccagttcgagaagtggggcgaggaggaggccgagctgaacaagaacttctacgacaagaagaccgccatccacaaggccctgtgcgacaacgtggacaccagaaccgtgatggaggagatgagagccctggtgagccagtgcaacctgtacatggccgccagaaaggccgtgagaaagagacccaaccaggccctgctggagaacatcgccctgtacctgacccacatgctgaagatcttcggcgccgtggaggaggacagcagcctgggcttccccgtgggcggccccggcaccagcctgagcctggaggccaccgtgatgccctacctgcaggtgctgagcgagttcagagagggcgtgagaaagatcgccagagagcagaaggtgcccgagatcctgcagctgagcgacgccctgagagacaacatcctgcccgagctgggcgtgagattcgaggaccacgagggcctgcccaccgtggtgaagctggtggacagaaacaccctgctgaaggagagagaggagaagagaagagtggaggaggagaagagaaagaagaaggaggaggccgccagaagaaagcaggagcaggaggccgccaagctggccaagatgaagatcccccccagcgagatgttcctgagcgagaccgacaagtacagcaagttcgacgagaacgtgagcatggtgtgcccccacatgacctggagagccaagagcagcgccaagggcaagcccagaagctag

SEQ ID NO: 78147 - DNA, 2496 bp, Artificial Sequence
  Description of Artificial Sequence: Synthetic coding sequence
atggccgacagcagcggccagcaggcccccgactacagaagcatcctgagcatcagcgacgaggccgccagagcccaggccctgaacgagcacctgagcaccagaagctacgtgcagggctacagcctgagccaggccgacgtggacgccttcagacagctgagcgccccccccgccgacccccagctgttccacgtggccagatggttcagacacatcgaggccctgctgggcagcccctgcggcaagggccagccctgcagactgcaggccagcaagggcagaagagtgcagccccagtggagcccccccgccggcacccagccctgcagactgcacctgtacaacagcctgaccagaaacaaggaggtgttcatcccccaggacggcaagaaggtgacctggtactgctgcggccccaccgtgtacgacgccagccacatgggccacgccagaagctacatcagcttcgacatcctgagaagagtgctgaaggactacttcaagttcgacgtgttctactgcatgaacatcaccgacatcgacgacaagatcatcaagagagccagacagaaccacctgttcgagcagtacagagagaagagacccgaggccgcccagctgctggaggacgtgcaggccgccctgaagcccttcagcgtgaagctgaacgagaccaccgaccccgacaagaagcagatgctggagagaatccagcacgccgtgcagctggccaccgagcccctggagaaggccgtgcagagcagactgaccggcgaggaggtgaacagctgcgtggaggtgctgctggaggaggccaaggacctgctgagcgactggctggacagcaccctgggctgcgacgtgaccgacaacagcatcttcagcaagctgcccaagttctgggagggcgacttccacagagacatggaggccctgaacgtgctgccccccgacgtgctgaccagagtgagcgagtacgtgcccgagatcgtgaacttcgtgcagaagatcgtggacaacggctacggctacgtgagcaacggcagcgtgtacttcgacaccgccaagttcgccagcagcgagaagcacagctacggcaagctggtgcccgaggccgtgggcgaccagaaggccctgcaggagggcgagggcgacctgagcatcagcgccgacagactgagcgagaagagaagccccaacgacttcgccctgtggaaggccagcaagcccggcgagcccagctggccctgcccctggggcaagggcagacccggctggcacatcgagtgcagcgccatggccggcaccctgctgggcgccagcatggacatccacggcggcggcttcgacctgagattcccccaccacgacaacgagctggcccagagcgaggcctacttcgagaacgactgctgggtgagatacttcctgcacaccggccacctgaccatcgccggctgcaagatgagcaagagcctgaagaacttcatcaccatcaaggacgccctgaagaagcacagcgccagacagctgagactggccttcctgatgcacagctggaaggacaccctggactacagcagcaacaccatggagagcgccctgcagtacgagaagttcctgaacgagttcttcctgaacgtgaaggacatcctgagagcccccgtggacatcaccggccagttcgagaagtggggcgaggaggaggccgagctgaacaagaacttctacgacaagaagaccgccatccacaaggccctgtgcgacaacgtggacaccagaaccgtgatggaggagatgagagccctggtgagccagtgcaacctgtacatggccgccagaaaggccgtgagaaagagacccaaccaggccctgctggagaacatcgccctgtacctgacccacatgctgaagatcttcggcgccgtggaggaggacagcagcctgggcttccccgtgggcggccccggcaccagcctgagcctggaggccaccgtgatgccctacctgcaggtgctgagcgagttcagagagggcgtgagaaagatcgccagagagcagaaggtgcccgagatcctgcagctgagcgacgccctgagagacaacatcctgcccgagctgggcgtgagattcgaggaccacgagggcctgcccaccgtggtgaagctggtggacagaaacaccctgctgaaggagagagaggagaagagaagagtggaggaggagaagagaaagaagaaggaggaggccgccagaagaaagcaggagcaggaggccgccaagctggccaagatgaagatcccccccagcgagatgttcctgagcgagaccgacaagtacagcaagttcgacgagaacggcctgcccacccacgacatggagggcaaggagctgagcaagggccaggccaagaagctgaagaagctgttcgaggcccaggagaagctgtacaaggagtacctgcagatggcccagaacggcagcttccagtag

SEQ ID NO: 78148 - DNA, 2247 bp, Artificial Sequence
  Description of Artificial Sequence: Synthetic coding sequence
atggccgacagcagcggccagcagggcaagggcagaagagtgcagccccagtggagcccccccgccggcacccagccctgcagactgcacctgtacaacagcctgaccagaaacaaggaggtgttcatcccccaggacggcaagaaggtgacctggtactgctgcggccccaccgtgtacgacgccagccacatgggccacgccagaagctacatcagcttcgacatcctgagaagagtgctgaaggactacttcaagttcgacgtgttctactgcatgaacatcaccgacatcgacgacaagatcatcaagagagccagacagaaccacctgttcgagcagtacagagagaagagacccgaggccgcccagctgctggaggacgtgcaggccgccctgaagcccttcagcgtgaagctgaacgagaccaccgaccccgacaagaagcagatgctggagagaatccagcacgccgtgcagctggccaccgagcccctggagaaggccgtgcagagcagactgaccggcgaggaggtgaacagctgcgtggaggtgctgctggaggaggccaaggacctgctgagcgactggctggacagcaccctgggctgcgacgtgaccgacaacagcatcttcagcaagctgcccaagttctgggagggcgacttccacagagacatggaggccctgaacgtgctgccccccgacgtgctgaccagagtgagcgagtacgtgcccgagatcgtgaacttcgtgcagaagatcgtggacaacggctacggctacgtgagcaacggcagcgtgtacttcgacaccgccaagttcgccagcagcgagaagcacagctacggcaagctggtgcccgaggccgtgggcgaccagaaggccctgcaggagggcgagggcgacctgagcatcagcgccgacagactgagcgagaagagaagccccaacgacttcgccctgtggaaggccagcaagcccggcgagcccagctggccctgcccctggggcaagggcagacccggctggcacatcgagtgcagcgccatggccggcaccctgctgggcgccagcatggacatccacggcggcggcttcgacctgagattcccccaccacgacaacgagctggcccagagcgaggcctacttcgagaacgactgctgggtgagatacttcctgcacaccggccacctgaccatcgccggctgcaagatgagcaagagcctgaagaacttcatcaccatcaaggacgccctgaagaagcacagcgccagacagctgagactggccttcctgatgcacagctggaaggacaccctggactacagcagcaacaccatggagagcgccctgcagtacgagaagttcctgaacgagttcttcctgaacgtgaaggacatcctgagagcccccgtggacatcaccggccagttcgagaagtggggcgaggaggaggccgagctgaacaagaacttctacgacaagaagaccgccatccacaaggccctgtgcgacaacgtggacaccagaaccgtgatggaggagatgagagccctggtgagccagtgcaacctgtacatggccgccagaaaggccgtgagaaagagacccaaccaggccctgctggagaacatcgccctgtacctgacccacatgctgaagatcttcggcgccgtggaggaggacagcagcctgggcttccccgtgggcggccccggcaccagcctgagcctggaggccaccgtgatgccctacctgcaggtgctgagcgagttcagagagggcgtgagaaagatcgccagagagcagaaggtgcccgagatcctgcagctgagcgacgccctgagagacaacatcctgcccgagctgggcgtgagattcgaggaccacgagggcctgcccaccgtggtgaagctggtggacagaaacaccctgctgaaggagagagaggagaagagaagagtggaggaggagaagagaaagaagaaggaggaggccgccagaagaaagcaggagcaggaggccgccaagctggccaagatgaagatcccccccagcgagatgttcctgagcgagaccgacaagtacagcaagttcgacgagaacggcctgcccacccacgacatggagggcaaggagctgagcaagggccaggccaagaagctgaagaagctgttcgaggcccaggagaagctgtacaaggagtacctgcagatggcccagaacggcagcttccagtag

SEQ ID NO: 78149 - DNA, 2217 bp, Artificial Sequence
  Description of Artificial Sequence: Synthetic coding sequence
atgcagaccccccccctgcagcagccccaccaggagcaggtgttcctggccttcctggtgatcgtgatccccagcttcctgaccaaggaggtgttcatcccccaggacggcaagaaggtgacctggtactgctgcggccccaccgtgtacgacgccagccacatgggccacgccagaagctacatcagcttcgacatcctgagaagagtgctgaaggactacttcaagttcgacgtgttctactgcatgaacatcaccgacatcgacgacaagatcatcaagagagccagacagaaccacctgttcgagcagtacagagagaagagacccgaggccgcccagctgctggaggacgtgcaggccgccctgaagcccttcagcgtgaagctgaacgagaccaccgaccccgacaagaagcagatgctggagagaatccagcacgccgtgcagctggccaccgagcccctggagaaggccgtgcagagcagactgaccggcgaggaggtgaacagctgcgtggaggtgctgctggaggaggccaaggacctgctgagcgactggctggacagcaccctgggctgcgacgtgaccgacaacagcatcttcagcaagctgcccaagttctgggagggcgacttccacagagacatggaggccctgaacgtgctgccccccgacgtgctgaccagagtgagcgagtacgtgcccgagatcgtgaacttcgtgcagaagatcgtggacaacggctacggctacgtgagcaacggcagcgtgtacttcgacaccgccaagttcgccagcagcgagaagcacagctacggcaagctggtgcccgaggccgtgggcgaccagaaggccctgcaggagggcgagggcgacctgagcatcagcgccgacagactgagcgagaagagaagccccaacgacttcgccctgtggaaggccagcaagcccggcgagcccagctggccctgcccctggggcaagggcagacccggctggcacatcgagtgcagcgccatggccggcaccctgctgggcgccagcatggacatccacggcggcggcttcgacctgagattcccccaccacgacaacgagctggcccagagcgaggcctacttcgagaacgactgctgggtgagatacttcctgcacaccggccacctgaccatcgccggctgcaagatgagcaagagcctgaagaacttcatcaccatcaaggacgccctgaagaagcacagcgccagacagctgagactggccttcctgatgcacagctggaaggacaccctggactacagcagcaacaccatggagagcgccctgcagtacgagaagttcctgaacgagttcttcctgaacgtgaaggacatcctgagagcccccgtggacatcaccggccagttcgagaagtggggcgaggaggaggccgagctgaacaagaacttctacgacaagaagaccgccatccacaaggccctgtgcgacaacgtggacaccagaaccgtgatggaggagatgagagccctggtgagccagtgcaacctgtacatggccgccagaaaggccgtgagaaagagacccaaccaggccctgctggagaacatcgccctgtacctgacccacatgctgaagatcttcggcgccgtggaggaggacagcagcctgggcttccccgtgggcggccccggcaccagcctgagcctggaggccaccgtgatgccctacctgcaggtgctgagcgagttcagagagggcgtgagaaagatcgccagagagcagaaggtgcccgagatcctgcagctgagcgacgccctgagagacaacatcctgcccgagctgggcgtgagattcgaggaccacgagggcctgcccaccgtggtgaagctggtggacagaaacaccctgctgaaggagagagaggagaagagaagagtggaggaggagaagagaaagaagaaggaggaggccgccagaagaaagcaggagcaggaggccgccaagctggccaagatgaagatcccccccagcgagatgttcctgagcgagaccgacaagtacagcaagttcgacgagaacggcctgcccacccacgacatggagggcaaggagctgagcaagggccaggccaagaagctgaagaagctgttcgaggcccaggagaagctgtacaaggagtacctgcagatggcccagaacggcagcttccagtag

SEQ ID NO: 78150 - DNA, 2220 bp, Artificial Sequence
  Description of Artificial Sequence: Synthetic coding sequence
atggagcccaccagcggccccttcagaaccgacctgggctaccacctggtgggctgcagcagcggcaagggcagaagagtgcagccccagtggagcccccccgccggcacccagccctgcagactgcacctgtacaacagcctgaccagaaacaaggaggtgttcatcccccaggacggcaagaaggtgacctggtactgctgcggccccaccgtgtacgacgccagccacatgggccacgccagaagctacatcagcttcgacatcctgagaagagtgctgaaggactacttcaagttcgacgtgttctactgcatgaacatcaccgacatcgacgacaagatcatcaagagagccagacagaaccacctgttcgagcagtacagagagaagagacccgaggccgcccagctgctggaggacgtgcaggccgccctgaagcccttcagcgtgaagctgaacgagaccaccgaccccgacaagaagcagatgctggagagaatccagcacgccgtgcagctggccaccgagcccctggagaaggccgtgcagagcagactgaccggcgaggaggtgaacagctgcgtggaggtgctgctggaggaggccaaggacctgctgagcgactggctggacagcaccctgggctgcgacgtgaccgacaacagcatcttcagcaagctgcccaagttctgggagggcgacttccacagagacatggaggccctgaacgtgctgccccccgacgtgctgaccagagtgagcgagtacgtgcccgagatcgtgaacttcgtgcagaagatcgtggacaacggctacggctacgtgagcaacggcagcgtgtacttcgacaccgccaagttcgccagcagcgagaagcacagctacggcaagctggtgcccgaggccgtgggcgaccagaaggccctgcaggagggcgagggcgacctgagcatcagcgccgacagactgagcgagaagagaagccccaacgacttcgccctgtggaaggccagcaagcccggcgagcccagctggccctgcccctggggcaagggcagacccggctggcacatcgagtgcagcgccatggccggcaccctgctgggcgccagcatggacatccacggcggcggcttcgacctgagattcccccaccacgacaacgagctggcccagagcgaggcctacttcgagaacgactgctgggtgagatacttcctgcacaccggccacctgaccatcgccggctgcaagatgagcaagagcctgaagaacttcatcaccatcaaggacgccctgaagaagcacagcgccagacagctgagactggccttcctgatgcacagctggaaggacaccctggactacagcagcaacaccatggagagcgccctgcagtacgagaagttcctgaacgagttcttcctgaacgtgaaggacatcctgagagcccccgtggacatcaccggccagttcgagaagtggggcgaggaggaggccgagctgaacaagaacttctacgacaagaagaccgccatccacaaggccctgtgcgacaacgtggacaccagaaccgtgatggaggagatgagagccctggtgagccagtgcaacctgtacatggccgccagaaaggccgtgagaaagagacccaaccaggccctgctggagaacatcgccctgtacctgacccacatgctgaagatcttcggcgccgtggaggaggacagcagcctgggcttccccgtgggcggccccggcaccagcctgagcctggaggccaccgtgatgccctacctgcaggtgctgagcgagttcagagagggcgtgagaaagatcgccagagagcagaaggtgcccgagatcctgcagctgagcgacgccctgagagacaacatcctgcccgagctgggcgtgagattcgaggaccacgagggcctgcccaccgtggtgaagctggtggacagaaacaccctgctgaaggagagagaggagaagagaagagtggaggaggagaagagaaagaagaaggaggaggccgccagaagaaagcaggagcaggaggccgccaagctggccaagatgaagatcccccccagcgagatgttcctgagcgagaccgacaagtacagcaagttcgacgagaacgtgagcatggtgtgcccccacatgacctggagagccaagagcagcgccaagggcaagcccagaagctag

SEQ ID NO: 78151 - DNA, 1695 bp, Artificial Sequence
  Description of Artificial Sequence: Synthetic coding sequence
atgctgagaaccaccagaggccccggcctgggcccccccctgctgcaggccgccctgggcctgggcagagccggctggcactggcccgccggcagagccgccagcggcggcagaggcagagcctggctgcagcccaccggcagagagaccggcgtgcaggtgtacaacagcctgaccggcagaaaggagcccctgatcgtggcccacgccgaggccgccagctggtacagctgcggccccaccgtgtacgaccacgcccacctgggccacgcctgcagctacgtgagattcgacatcatcagaagaatcctgaccaaggtgttcggctgcagcatcgtgatggtgatgggcatcaccgacgtggacgacaagatcatcaagagagccaacgagatgaacatcagccccgccagcctggccagcctgtacgaggaggacttcaagcaggacatggccgccctgaaggtgctgccccccaccgtgtacctgagagtgaccgagaacatcccccagatcatcagcttcatcgagggcatcatcgccagaggcaacgcctacagcaccgccaagggcaacgtgtacttcgacctgaagagcagaggcgacaagtacggcaagctggtgggcgtggtgcccggccccgtgggcgagcccgccgacagcgacaagagacacgccagcgacttcgccctgtggaaggccgccaagccccaggaggtgttctgggccagcccctggggccccggcagacccggctggcacatcgagtgcagcgccatcgccagcatggtgttcggcagccagctggacatccacagcggcggcatcgacctggccttcccccaccacgagaacgagatcgcccagtgcgaggtgttccaccagtgcgagcagtggggcaactacttcctgcacagcggccacctgcacgccaagggcaaggaggagaagatgagcaagagcctgaagaactacatcaccatcaaggacttcctgaagaccttcagccccgacgtgttcagattcttctgcctgagaagcagctacagaagcgccatcgactacagcgacagcgccatgctgcaggcccagcagctgctgctgggcctgggcagcttcctggaggacgccagagcctacatgaagggccagctggcctgcggcagcgtgagagaggccatgctgtgggagagactgagcagcaccaagagagccgtgaaggccgccctggccgacgacttcgacacccccagagtggtggacgccatcctgggcctggcccaccacggcaacggccagctgagagccagcctgaaggagcccgagggccccagaagccccgccgtgttcggcgccatcatcagctacttcgagcagttcttcgagaccgtgggcatcagcctggccaaccagcagtacgtgagcggcgacggcagcgaggccaccctgcacggcgtggtggacgagctggtgagattcagacagaaggtgagacagttcgccctggccatgcccgaggccaccggcgacgccagaagacagcagctgctggagagacagcccctgctggaggcctgcgacaccctgagaagaggcctgaccgcccacggcatcaacatcaaggacagaagcagcaccaccagcacctgggagctgctggaccagagaaccaaggaccagaagagcgccggctag

SEQ ID NO: 78152 - DNA, 549 bp, Artificial Sequence
  Description of Artificial Sequence: Synthetic coding sequence
atggtgttcggcagccagctggacatccacagcggcggcatcgacctggccttcccccaccacgagaacgagatcgcccagtgcgaggtgttccaccagtgcgagcagtggggcaactacttcctgcacagcggccacctgcacgccaagggcaaggaggagaagatgagcaagagcctgaagaactacatcaccatcaaggacttcctgaagaccttcagccccgacgtgttcagattcttctgcctgagaagcagctacagaagcgccatcgactacagcgacagcgccatgctgcaggcccagcagctgctgctgggcctgggcagcttcctggaggacgccagagcctacatgaagggccagctggcctgcggcagcgtgagagaggccatgctgtgggagagactgagcagcaccaagagagccgtgaaggccgccctggccgacgacttcgacacccccagagtggtggacgccatcctgggcctggcccaccacggcaacggccagctgagagccagcctgaagaagcccggcagcgcctag

SEQ ID NO: 78153 - DNA, 441 bp, Artificial Sequence
  Description of Artificial Sequence: Synthetic coding sequence
atggcccagaagagacccgcctgcaccctgaagcccgagtgcgtgcagcagctgctggtgtgcagccaggaggccaagaagagcgcctactgcccctacagccacttccccgtgggcgccgccctgctgacccaggagggcagaatcttcaagggctgcaacatcgagaacgcctgctaccccctgggcatctgcgccgagagaaccgccatccagaaggccgtgagcgagggctacaaggacttcagagccatcgccatcgccagcgacatgcaggacgacttcatcagcccctgcggcgcctgcagacaggtgatgagagagttcggcaccaactggcccgtgtacatgaccaagcccgacggcacctacatcgtgatgaccgtgcaggagctgctgcccagcagcttcggccccgaggacctgcagaagacccagtag

SEQ ID NO: 78154 - DNA, 687 bp, Artificial Sequence
  Description of Artificial Sequence: Synthetic coding sequence
atgctgagcagatgcagaagcggcctgctgcacgtgctgggcctgagcttcctgctgcagaccagaagacccatcctgctgtgcagccccagactgatgaagcccctggtggtgttcgtgctgggcggccccggcgccggcaagggcacccagtgcgccagaatcgtggagaagtacggctacacccacctgagcgccggcgagctgctgagagacgagagaaagaaccccgacagccagtacggcgagctgatcgagaagtacatcaaggagggcaagatcgtgcccgtggagatcaccatcagcctgctgaagagagagatggaccagaccatggccgccaacgcccagaagaacaagttcctgatcgacggcttccccagaaaccaggacaacctgcagggctggaacaagaccatggacggcaaggccgacgtgagcttcgtgctgttcttcgactgcaacaacgagatctgcatcgagagatgcctggagagaggcaagagcagcggcagaagcgacgacaacagagagagcctggagaagagaatccagacctacctgcagagcaccaagcccatcatcgacctgtacgaggagatgggcaaggtgaagaagatcgacgccagcaagagcgtggacgaggtgttcgacgaggtggtgcagatcttcgacaaggagggctag

SEQ ID NO: 78155 - DNA, 540 bp, Artificial Sequence
  Description of Artificial Sequence: Synthetic coding sequence
atgctgagcagatgcagaagcggcctgctgcacgtgctgggcctgagcttcctgctgcagaccagaagacccatcctgctgtgcagccccagactgatgaagcccctggtggtgttcgtgctgggcggccccggcgccggcaagggcacccagtgcgccagaatcgtggaggagatggaccagaccatggccgccaacgcccagaagaacaagttcctgatcgacggcttccccagaaaccaggacaacctgcagggctggaacaagaccatggacggcaaggccgacgtgagcttcgtgctgttcttcgactgcaacaacgagatctgcatcgagagatgcctggagagaggcaagagcagcggcagaagcgacgacaacagagagagcctggagaagagaatccagacctacctgcagagcaccaagcccatcatcgacctgtacgaggagatgggcaaggtgaagaagatcgacgccagcaagagcgtggacgaggtgttcgacgaggtggtgcagatcttcgacaaggagggctag

SEQ ID NO: 78156 - DNA, 1230 bp, Artificial Sequence
  Description of Artificial Sequence: Synthetic coding sequence
atggccttcgccagaagactgctgagaggccccctgagcggccccctgctgggcagaagaggcgtgtgcgccggcgccatggccccccccagaagattcgtgctggagctgcccgactgcaccctggcccacttcgccctgggcgccgacgcccccggcgacgccgacgcccccgaccccagactggccgccctgctgggcccccccgagagaagctacagcctgtgcgtgcccgtgacccccgacgccggctgcggcgccagagtgagagccgccagactgcaccagagactgctgcaccagctgagaagaggccccttccagagatgccagctgctgagactgctgtgctactgccccggcggccaggccggcggcgcccagcagggcttcctgctgagagaccccctggacgaccccgacaccagacaggccctgctggagctgctgggcgcctgccaggaggcccccagaccccacctgggcgagttcgaggccgaccccagaggccagctgtggcagagactgtgggaggtgcaggacggcagaagactgcaggtgggctgcgcccaggtggtgcccgtgcccgagccccccctgcaccccgtggtgcccgacctgcccagcagcgtggtgttccccgacagagaggccgccagagccgtgctggaggagtgcaccagcttcatccccgaggccagagccgtgctggacctggtggaccagtgccccaagcagatccagaagggcaagttccaggtggtggccatcgagggcctggacgccaccggcaagaccaccgtgacccagagcgtggccgacagcctgaaggccgtgctgctgaagagcccccccagctgcatcggccagtggagaaagatcttcgacgacgagcccaccatcatcagaagagccttctacagcctgggcaactacatcgtggccagcgagatcgccaaggagagcgccaagagccccgtgatcgtggacagatactggcacagcaccgccacctacgccatcgccaccgaggtgagcggcggcctgcagcacctgccccccgcccaccaccccgtgtaccagtggcccgaggacctgctgaagcccgacctgatcctgctgctgaccgtgagccccgaggagagactgcagagactgcagggcagaggcatggagaagaccagagaggaggccgagctggaggccaacagcgtgttcagacagaagtag

SEQ ID NO: 78157 - DNA, 1350 bp, Artificial Sequence
  Description of Artificial Sequence: Synthetic coding sequence
atggccttcgccagaagactgctgagaggccccctgagcggccccctgctgggcagaagaggcgtgtgcgccggcgccatggccccccccagaagattcgtgctggagctgcccgactgcaccctggcccacttcgccctgggcgccgacgcccccggcgacgccgacgcccccgaccccagactggccgccctgctgggcccccccgagagaagctacagcctgtgcgtgcccgtgacccccgacgccggctgcggcgccagagtgagagccgccagactgcaccagagactgctgcaccagctgagaagaggccccttccagagatgccagctgctgagactgctgtgctactgccccggcggccaggccggcggcgcccagcagggcttcctgctgagagaccccctggacgaccccgacaccagacaggccctgctggagctgctgggcgcctgccaggaggcccccagaccccacctgggcgagttcgaggccgaccccagaggccagctgtggcagagactgtgggaggtgcaggacggcagaagactgcaggtgggctgcgcccaggtggtgcccgtgcccgagccccccctgcaccccgtggtgcccgacctgcccagcagcgtggtgttccccgacagagaggccgccagagccgtgctggaggagtgcaccagcttcatccccgaggccagagccgtgctggacctggtggaccagtgccccaagcagatccagaagggcaagttccaggtggtggccatcgagggcctggacgccaccggcaagaccaccgtgacccagagcgtggccgacagcctgaaggccgtgctgctgaagagcccccccagctgcatcggccagtggagaaagatcttcgacgacgagcccaccatcatcagaagagccttctacagcctgggcaactacatcgtggccagcgagatcgccaaggagagcgccaagagccccgtgatcgtggacagatactggcacagcaccgccacctacgccatcgccaccgaggtgagcggcggcctgcagcacctgccccccgcccaccaccccgtgtaccagtggcccgaggacctgctgaagcccgacctgatcctgctgctgaccgtgagccccgaggagagactgcagagactgcagggcagaggcatggagaagaccagagaggaggccgagctggaggccaacagcgtgttcagacagaaggtggagatgagctaccagagaatggagaaccccggctgccacgtggtggacgccagccccagcagagagaaggtgctgcagaccgtgctgagcctgatccagaacagcttcagcgagccctag

SEQ ID NO: 78158 - DNA, 1101 bp, Artificial Sequence
  Description of Artificial Sequence: Synthetic coding sequence
atggccttcgccagaagactgctgagaggccccctgagcggccccctgctgggcagaagaggcgtgtgcgccggcgccatggccccccccagaagattcgtgctggagctgcccgactgcaccctggcccacttcgccctgggcgccgacgcccccggcgacgccgacgcccccgaccccagactggccgccctgctgggcccccccgagagaagctacagcctgtgcgtgcccgtgacccccgacgccggctgcggcgccagagtgagagccgccagactgcaccagagactgctgcaccagctgagaagaggccccttccagagatgccagctgctgagactgctgtgctactgccccggcggccaggccggcggcgcccagcagggcttcctgctgagagaccccctggacgaccccgacaccagacaggccctgctggagctgctgggcgcctgccaggaggcccccagaccccacctgggcgagttcgaggccgaccccagaggccagctgtggcagagactgtgggaggtgcaggacggcagaagactgcaggtgggctgcgcccaggtggtgcccgtgcccgagccccccctgcaccccgtggtgcccgacctgcccagcagcgtggtgttccccgacagagaggccgccagagccgtgctggaggagtgcaccagcttcatccccgaggccagagccgtgctggacctggtggaccagtgccccaagcagatccagaagggcaagttccaggtggtggccatcgagggcctggacgccaccggcaagaccaccgtgacccagagcgtggccgacagcctgaaggccgtgctgctgaagagcccccccagctgcatcggccagtggagaaagatcttcgacgacgagcccaccatcatcagaagagccttctacagcctgggcaactacatcgtggccagcgagatcgccaaggagagcgccaagagccccgtgatcgtggacagaagccagctgggcggcaccctgtaccaccccagcctgcacctgctgggcagcgaggtgtgcggcaccggcatcctggacagcagccacagcagccagggcctggagtag

SEQ ID NO: 78159 - DNA, 813 bp, Artificial Sequence
  Description of Artificial Sequence: Synthetic coding sequence
atgggcaacaccagcagcgagagagccgccctggagagacacggcggccacaagacccccagaagagacagcagcggcggcaccaaggacggcgacagacccaagatcctgatggacagccccgaggacgccgacctgttccacagcgaggagatcaaggcccccgagaaggaggagttcctggcctggcagcacgacctggaggtgaacgacaaggcccccgcccaggccagacccaccgtgttcagatggaccggcggcggcaaggaggtgtacctgagcggcagcttcaacaactggagcaagctgcccctgaccagaagccacaacaacttcgtggccatcctggacctgcccgagggcgagcaccagtacaagttcttcgtggacggccagtggacccacgaccccagcgagcccatcgtgaccagccagctgggcaccgtgaacaacatcatccaggtgaagaagaccgacttcgaggtgttcgacgccctgatggtggacagccagaagtgcagcgacgtgagcgagctgagcagcagcccccccggcccctaccaccaggagccctacgtgtgcaagcccgaggagagattcagagccccccccatcctgcccccccacctgctgcaggtgatcctgaacaaggacaccggcatcagctgcgaccccgccctgctgcccgagcccaaccacgtgatgctgaaccacctgtacgccctgagcatcaaggacggcgtgatggtgctgagcgccacccacagatacaagaagaagtacgtgaccaccctgctgtacaagcccatctag

SEQ ID NO: 78160 - DNA, 588 bp, Artificial Sequence
  Description of Artificial Sequence: Synthetic coding sequence
atgggccagatcgagtgggccatgtgggccaacgagcaggccctggccagcggcctgatcctgatcaccggcggcatcgtggccaccgccggcagattcacccagtggtacttcggcgcctacagcatcgtggccggcgtgttcgtgtgcctgctggagtaccccagaggcaagagaaagaagggcagcaccatggagagatggggccagaagtacatgaccgccgtggtgaagctgttcggccccttcaccagaaactactacgtgagagccgtgctgcacctgctgctgagcgtgcccgccggcttcctgctggccaccatcctgggcaccgcctgcctggccatcgccagcggcatctacctgctggccgccgtgagaggcgagcagtggacccccatcgagcccaagcccagagagagaccccagatcggcggcaccatcaagcagccccccagcaaccccccccccagaccccccgccgaggccagaaagaagcccagcgaggaggaggccgccgtggccgccggcggcccccccggcggcccccaggtgaaccccatccccgtgaccgacgaggtggtgtag

SEQ ID NO: 78161 - DNA, 1713 bp, Artificial Sequence
  Description of Artificial Sequence: Synthetic coding sequence
atgggcaactgggccgtgaacgagggcctgagcatcttcgtgatcctggtgtggctgggcctgaacgtgttcctgttcgtgtggtactacagagtgtacgacatcccccccaagttcttctacaccagaaagctgctgggcagcgccctggccctggccagagcccccgccgcctgcctgaacttcaactgcatgctgatcctgctgcccgtgtgcagaaacctgctgagcttcctgagaggcagcagcgcctgctgcagcaccagagtgagaagacagctggacagaaacctgaccttccacaagatggtggcctggatgatcgccctgcacagcgccatccacaccatcgcccacctgttcaacgtggagtggtgcgtgaacgccagagtgaacaacagcgacccctacagcgtggccctgagcgagctgggcgacagacagaacgagagctacctgaacttcgccagaaagagaatcaagaaccccgagggcggcctgtacctggccgtgaccctgctggccggcatcaccggcgtggtgatcaccctgtgcctgatcctgatcatcaccagcagcaccaagaccatcagaagaagctacttcgaggtgttctggtacacccaccacctgttcgtgatcttcttcatcggcctggccatccacggcgccgagagaatcgtgagaggccagaccgccgagagcctggccgtgcacaacatcaccgtgtgcgagcagaagatcagcgagtggggcaagatcaaggagtgccccatcccccagttcgccggcaacccccccatgacctggaagtggatcgtgggccccatgttcctgtacctgtgcgagagactggtgagattctggagaagccagcagaaggtggtgatcaccaaggtggtgacccaccccttcaagaccatcgagctgcagatgaagaagaagggcttcaagatggaggtgggccagtacatcttcgtgaagtgccccaaggtgagcaagctggagtggcaccccttcaccctgaccagcgcccccgaggaggacttcttcagcatccacatcagaatcgtgggcgactggaccgagggcctgttcaacgcctgcggctgcgacaagcaggagttccaggacgcctggaagctgcccaagatcgccgtggacggccccttcggcaccgccagcgaggacgtgttcagctacgaggtggtgatgctggtgggcgccggcatcggcgtgacccccttcgccagcatcctgaagagcgtgtggtacaagtactgcaacaacgccaccaacctgaagctgaagaagatctacttctactggctgtgcagagacacccacgccttcgagtggttcgccgacctgctgcagctgctggagagccagatgcaggagagaaacaacgccggcttcctgagctacaacatctacctgaccggctgggacgagagccaggccaaccacttcgccgtgcaccacgacgaggagaaggacgtgatcaccggcctgaagcagaagaccctgtacggcagacccaactgggacaacgagttcaagaccatcgccagccagcaccccaacaccagaatcggcgtgttcctgtgcggccccgaggccctggccgagaccctgagcaagcagagcatcagcaacagcgagagcggccccagaggcgtgcacttcatcttcaacaaggagaacttctag

SEQ ID NO: 78162 - DNA, 912 bp, Artificial Sequence
  Description of Artificial Sequence: Synthetic coding sequence
atgacctggaagtggatcgtgggccccatgttcctgtacctgtgcgagagactggtgagattctggagaagccagcagaaggtggtgatcaccaaggtggtgacccaccccttcaagaccatcgagctgcagatgaagaagaagggcttcaagatggaggtgggccagtacatcttcgtgaagtgccccaaggtgagcaagctggagtggcaccccttcaccctgaccagcgcccccgaggaggacttcttcagcatccacatcagaatcgtgggcgactggaccgagggcctgttcaacgcctgcggctgcgacaagcaggagttccaggacgcctggaagctgcccaagatcgccgtggacggccccttcggcaccgccagcgaggacgtgttcagctacgaggtggtgatgctggtgggcgccggcatcggcgtgacccccttcgccagcatcctgaagagcgtgtggtacaagtactgcaacaacgccaccaacctgaagctgaagaagatctacttctactggctgtgcagagacacccacgccttcgagtggttcgccgacctgctgcagctgctggagagccagatgcaggagagaaacaacgccggcttcctgagctacaacatctacctgaccggctgggacgagagccaggccaaccacttcgccgtgcaccacgacgaggagaaggacgtgatcaccggcctgaagcagaagaccctgtacggcagacccaactgggacaacgagttcaagaccatcgccagccagcaccccaacaccagaatcggcgtgttcctgtgcggccccgaggccctggccgagaccctgagcaagcagagcatcagcaacagcgagagcggccccagaggcgtgcacttcatcttcaacaaggagaacttctag

SEQ ID NO: 78163 - DNA, 1617 bp, Artificial Sequence
  Description of Artificial Sequence: Synthetic coding sequence
atgggcaactgggccgtgaacgagggcctgagcatcttcgtgatcagcgccctggccctggccagagcccccgccgcctgcctgaacttcaactgcatgctgatcctgctgcccgtgtgcagaaacctgctgagcttcctgagaggcagcagcgcctgctgcagcaccagagtgagaagacagctggacagaaacctgaccttccacaagatggtggcctggatgatcgccctgcacagcgccatccacaccatcgcccacctgttcaacgtggagtggtgcgtgaacgccagagtgaacaacagcgacccctacagcgtggccctgagcgagctgggcgacagacagaacgagagctacctgaacttcgccagaaagagaatcaagaaccccgagggcggcctgtacctggccgtgaccctgctggccggcatcaccggcgtggtgatcaccctgtgcctgatcctgatcatcaccagcagcaccaagaccatcagaagaagctacttcgaggtgttctggtacacccaccacctgttcgtgatcttcttcatcggcctggccatccacggcgccgagagaatcgtgagaggccagaccgccgagagcctggccgtgcacaacatcaccgtgtgcgagcagaagatcagcgagtggggcaagatcaaggagtgccccatcccccagttcgccggcaacccccccatgacctggaagtggatcgtgggccccatgttcctgtacctgtgcgagagactggtgagattctggagaagccagcagaaggtggtgatcaccaaggtggtgacccaccccttcaagaccatcgagctgcagatgaagaagaagggcttcaagatggaggtgggccagtacatcttcgtgaagtgccccaaggtgagcaagctggagtggcaccccttcaccctgaccagcgcccccgaggaggacttcttcagcatccacatcagaatcgtgggcgactggaccgagggcctgttcaacgcctgcggctgcgacaagcaggagttccaggacgcctggaagctgcccaagatcgccgtggacggccccttcggcaccgccagcgaggacgtgttcagctacgaggtggtgatgctggtgggcgccggcatcggcgtgacccccttcgccagcatcctgaagagcgtgtggtacaagtactgcaacaacgccaccaacctgaagctgaagaagatctacttctactggctgtgcagagacacccacgccttcgagtggttcgccgacctgctgcagctgctggagagccagatgcaggagagaaacaacgccggcttcctgagctacaacatctacctgaccggctgggacgagagccaggccaaccacttcgccgtgcaccacgacgaggagaaggacgtgatcaccggcctgaagcagaagaccctgtacggcagacccaactgggacaacgagttcaagaccatcgccagccagcaccccaacaccagaatcggcgtgttcctgtgcggccccgaggccctggccgagaccctgagcaagcagagcatcagcaacagcgagagcggccccagaggcgtgcacttcatcttcaacaaggagaacttctag

SEQ ID NO: 78164 - DNA, 714 bp, Artificial Sequence
  Description of Artificial Sequence: Synthetic coding sequence
atgaacagcagaagaagagagcccatcaccctgcaggaccccgaggccaagtaccccctgcccctgatcgagaaggagaagatcagccacaacaccagaagattcagattcggcctgcccagccccgaccacgtgctgggcctgcccgtgggcaactacgtgcagctgctggccaagatcgacaacgagctggtggtgagagcctacacccccgtgagcagcgacgacgacagaggcttcgtggacctgatcatcaagatctacttcaagaacgtgcacccccagtaccccgagggcggcaagatgacccagtacctggagaacatgaagatcggcgagaccatcttcttcagaggccccagaggcagactgttctaccacggccccggcaacctgggcatcagacccgaccagaccagcgagcccaagaagaccctggccgaccacctgggcatgatcgccggcggcaccggcatcacccccatgctgcagctgatcagacacatcaccaaggaccccagcgacagaaccagaatgagcctgatcttcgccaaccagaccgaggaggacatcctggtgagaaaggagctggaggagatcgccagaacccaccccgaccagttcaacctgtggtacaccctggacagaccccccatcggcccctggagcgccgagggcgccaccctgctgagcaacagcgcccagttccactag

SEQ ID NO: 78165 - DNA, 831 bp, Artificial Sequence
  Description of Artificial Sequence: Synthetic coding sequence
atgaacagcagaagaagagagcccatcaccctgcaggaccccgaggccaagtaccccctgcccctgatcgagaaggagaagatcagccacaacaccagaagattcagattcggcctgcccagccccgaccacgtgctgggcctgcccgtgggcaactacgtgcagctgctggccaagatcgacaacgagctggtggtgagagcctacacccccgtgagcagcgacgacgacagaggcttcgtggacctgatcatcaagatctacttcaagaacgtgcacccccagtaccccgagggcggcaagatgacccagtacctggagaacatgaagatcggcgagaccatcttcttcagaggccccagaggcagactgttctaccacggccccggcaacctgggcatcagacccgaccagaccagcgagcccaagaagaccctggccgaccacctgggcatgatcgccggcggcaccggcatcacccccatgctgcagctgatcagacacatcaccaaggaccccagcgacagaaccagaatgagcctgatcttcgccaaccagaccgaggaggacatcctggtgagaaaggagctggaggagatcgccagaacccaccccgaccagttcaacctgtggtacaccctggacagaccccccatcggctggaagtacagcagcggcttcgtgaccgccgacatgatcaaggagcacctgcccccccccgccaagagcaccctgatcctggtgtgcggccccccccccctgatccagaccgccgcccaccccaacctggagaagctgggctacacccaggacatgatcttcacctactag

SEQ ID NO: 78166 - DNA, 351 bp, Artificial Sequence
  Description of Artificial Sequence: Synthetic coding sequence
atgaacagcagaagaagagagcccatcaccctgcaggaccccgaggccaagtaccccctgcccctgatcgagaaggagaagatcagccacaacaccagaagattcagattcggcctgcccagccccgaccacgtgctgggcctgcccgtgggcaactacgtgcagctgctggccaagatcgacaacgagctggtggtgagagcctacacccccgtgagcagcgacgacgacagaggcttcgtggacctgatcatcaagatctacttcaagaacgtgcacccccagtaccccgagggcggcaagatgacccagtacctggagaacatgaagatcggcgagaccatcttctag

SEQ ID NO: 78167 - DNA, 714 bp, Artificial Sequence; identical to SEQ ID NO: 78164
  Description of Artificial Sequence: Synthetic coding sequence

SEQ ID NO: 78168 - DNA, 441 bp, Artificial Sequence
  Description of Artificial Sequence: Synthetic coding sequence
atgaacagcagaagaagagagcccatcaccctgcaggaccccgaggccaagtaccccctgcccctgatcgagaaggagaagatcagccacaacaccagaagattcagattcggcctgcccagccccgaccacgtgctgggcctgcccgtgggcaactacgtgcagctgctggccaagatcgacaacgagctggtggtgagagcctacacccccgtgagcagcgacgacgacagaggcttcgtggacctgatcatcaagatctacttcaagaacgtgcacccccagtaccccgagggcggcaagatgacccagtacctggagaacatgaagatcggcgagaccatcttcttcagaggccccagaggcagactgttctaccacggccccggcaacctgggcatcagacccgaccagaccagcgagcccaagaagaccctgtag

SEQ ID NO: 78169 - DNA, 516 bp, Artificial Sequence
  Description of Artificial Sequence: Synthetic coding sequence
atgaacagcagaagaagagagcccatcaccctgcaggaccccgaggccaagtaccccctgcccctgatcgagaaggagaagatcagccacaacaccagaagattcagattcggcctgcccagccccgaccacgtgctgggcctgcccgtgggcaactacgtgcagctgctggccaagatcgacaacgagctggtggtgagagcctacacccccgtgagcagcgacgacgacagaggcttcgtggacctgatcatcaagatctacttcaagaacgtgcacccccagtaccccgagggcggcaagatgacccagtacctggagaacatgaagatcggcgagaccatcttcttcagaggccccagaggcagactgttctaccacggccccggcaacctgggcatcagacccgaccagaccagcgagcccaagaagaccctggccgaccacctgggcatgatcgccggcggcaccggcatcacccccatgctgcagctgatcagacacatcaccaagtag

SEQ ID NO: 78170 - DNA, 831 bp, Artificial Sequence; identical to SEQ ID NO: 78165
  Description of Artificial Sequence: Synthetic coding sequence

SEQ ID NO: 78171 - DNA, 906 bp, Artificial Sequence
  Description of Artificial Sequence: Synthetic coding sequence
atgggcgcccagctgagcaccctgggccacatggtgctgttccccgtgtggttcctgtacagcctgctgatgaagctgttccagagaagcacccccgccatcaccctggagagccccgacatcaagtaccccctgagactgatcgacagagagatcatcagccacgacaccagaagattcagattcgccctgcccagcccccagcacatcctgggcctgcccgtgggccagcacatctacctgagcgccagaatcgacggcaacctggtggtgagaccctacacccccatcagcagcgacgacgacaagggcttcgtggacctggtgatcaaggtgtacttcaaggacacccaccccaagttccccgccggcggcaagatgagccagtacctggagagcatgcagatcggcgacaccatcgagttcagaggccccagcggcctgctggtgtaccagggcaagggcaagttcgccatcagacccgacaagaagagcaaccccatcatcagaaccgtgaagagcgtgggcatgatcgccggcggcaccggcatcacccccatgctgcaggtgatcagagccatcatgaaggaccccgacgaccacaccgtgtgccacctgctgttcgccaaccagaccgagaaggacatcctgctgagacccgagctggaggagctgagaaacaagcacagcgccagattcaagctgtggtacaccctggacagagcccccgaggcctgggactacggccagggcttcgtgaacgaggagatgatcagagaccacctgcccccccccgaggaggagcccctggtgctgatgtgcggccccccccccatgatccagtacgcctgcctgcccaacctggaccacgtgggccaccccaccgagagatgcttcgtgttctag

SEQ ID NO: 78172 - DNA, 1005 bp, Artificial Sequence
  Description of Artificial Sequence: Synthetic coding sequence
atgaacagaagcctgctggtgggctgcatgcagagcaaggacatctggggcagagaggagagcatctgcgagagactgaagcaggacggcctggacgtggagagagccgagagctgggagctgggccacatggtgctgttccccgtgtggttcctgtacagcctgctgatgaagctgttccagagaagcacccccgccatcaccctggagagccccgacatcaagtaccccctgagactgatcgacagagagatcatcagccacgacaccagaagattcagattcgccctgcccagcccccagcacatcctgggcctgcccgtgggccagcacatctacctgagcgccagaatcgacggcaacctggtggtgagaccctacacccccatcagcagcgacgacgacaagggcttcgtggacctggtgatcaaggtgtacttcaaggacacccaccccaagttccccgccggcggcaagatgagccagtacctggagagcatgcagatcggcgacaccatcgagttcagaggccccagcggcctgctggtgtaccagggcaagggcaagttcgccatcagacccgacaagaagagcaaccccatcatcagaaccgtgaagagcgtgggcatgatcgccggcggcaccggcatcacccccatgctgcaggtgatcagagccatcatgaaggaccccgacgaccacaccgtgtgccacctgctgttcgccaaccagaccgagaaggacatcctgctgagacccgagctggaggagctgagaaacaagcacagcgccagattcaagctgtggtacaccctggacagagcccccgaggcctgggactacggccagggcttcgtgaacgaggagatgatcagagaccacctgcccccccccgaggaggagcccctggtgctgatgtgcggccccccccccatgatccagtacgcctgcctgcccaacctggaccacgtgggccaccccaccgagagatgcttcgtgttctag

SEQ ID NO: 78173 - DNA, 837 bp, Artificial Sequence
  Description of Artificial Sequence: Synthetic coding sequence
atgaagctgttccagagaagcacccccgccatcaccctggagagccccgacatcaagtaccccctgagactgatcgacagagagatcatcagccacgacaccagaagattcagattcgccctgcccagcccccagcacatcctgggcctgcccgtgggccagcacatctacctgagcgccagaatcgacggcaacctggtggtgagaccctacacccccatcagcagcgacgacgacaagggcttcgtggacctggtgatcaaggtgtacttcaaggacacccaccccaagttccccgccggcggcaagatgagccagtacctggagagcatgcagatcggcgacaccatcgagttcagaggccccagcggcctgctggtgtaccagggcaagggcaagttcgccatcagacccgacaagaagagcaaccccatcatcagaaccgtgaagagcgtgggcatgatcgccggcggcaccggcatcacccccatgctgcaggtgatcagagccatcatgaaggaccccgacgaccacaccgtgtgccacctgctgttcgccaaccagaccgagaaggacatcctgctgagacccgagctggaggagctgagaaacaagcacagcgccagattcaagctgtggtacaccctggacagagcccccgaggcctgggactacggccagggcttcgtgaacgaggagatgatcagagaccacctgcccccccccgaggaggagcccctggtgctgatgtgcggccccccccccatgatccagtacgcctgcctgcccaacctggaccacgtgggccaccccaccgagagatgcttcgtgttctag

SEQ ID NO: 78174 - DNA, 837 bp, Artificial Sequence; identical to SEQ ID NO: 78173
  Description of Artificial Sequence: Synthetic coding sequence

SEQ ID NO: 78175 - DNA, 837 bp, Artificial Sequence; identical to SEQ ID NO: 78173
  Description of Artificial Sequence: Synthetic coding sequence

SEQ ID NO: 78176 - DNA, 837 bp, Artificial Sequence; identical to SEQ ID NO: 78173
  Description of Artificial Sequence: Synthetic coding sequence

SEQ ID NO: 78177 - DNA, 444 bp, Artificial Sequence
  Description of Artificial Sequence: Synthetic coding sequence
atgaagctgttccagagaagcacccccgccatcaccctggagagccccgacatcaagtaccccctgagactgatcgacagagagatcatcagccacgacaccagaagattcagattcgccctgcccagcccccagcacatcctgggcctgcccgtgggccagcacatctacctgagcgccagaatcgacggcaacctggtggtgagaccctacacccccatcagcagcgacgacgacaagggcttcgtggacctggtgatcaaggtgtacttcaaggacacccaccccaagttccccgccggcggcaagatgagccagtacctggagagcatgcagatcggcgacaccatcgagttcagaggccccagcggcctgctggtgtaccagggcaagggcaagttcgccatcagacccgacaagaagagcaaccccatcatcagatag

SEQ ID NO: 78178 - DNA, 330 bp, Artificial Sequence
  Description of Artificial Sequence: Synthetic coding sequence
atggactggatcagactgaccaagagcggcaaggacctgaccggcctgaagggcagactgatcgaggtgaccgaggaggagctgaagaagcacaacaagaaggacgactgctggatctgcatcagaggcttcgtgtacaacgtgagcccctacatggagtaccaccccggcggcgaggacgagctgatgagagccgccggcagcgacggcaccgagctgttcgaccaggtgcacagatgggtgaactacgagagcatgctgaaggagtgcctggtgggcagaatggccatcaagcccgccgtgctgaagggcaagctgtggcacctgtag

SEQ ID NO: 78179 - DNA, 1566 bp, Artificial Sequence
  Description of Artificial Sequence: Synthetic coding sequence
atgctgaacgtgcccagccagagcttccccgcccccagaagccagcagagagtggccagcggcggcagaagcaaggtgcccctgaagcagggcagaagcctgatggactggatcagactgaccaagagcggcaaggacctgaccggcctgaagggcagactgatcgaggtgaccgaggaggagctgaagaagcacaacaagaaggacgactgctggatctgcatcagaggcttcgtgtacaacgtgagcccctacatggagtaccaccccggcggcgaggacgagctgatgagagccgccggcagcgacggcaccgagctgttcgaccaggtgcacagatgggtgaactacgagagcatgctgaaggagtgcctggtgggcagaatggccatcaagcccgccgtgctgaaggactacagagaggaggagaagaaggtgctgaacggcatgctgcccaagagccaggtgaccgacaccctggccaaggagggccccagctaccccagctacgactggttccagaccgacagcctggtgaccatcgccatctacaccaagcagaaggacatcaacctggacagcatcatcgtggaccaccagaacgacagcttcagagccgagaccatcatcaaggactgcctgtacctgatccacatcggcctgagccacgaggtgcaggaggacttcagcgtgagagtggtggagagcgtgggcaagatcgagatcgtgctgcagaagaaggagaacaccagctgggacttcctgggccaccccctgaagaaccacaacagcctgatccccagaaaggacaccggcctgtactacagaaagtgccagctgatcagcaaggaggacgtgacccacgacaccagactgttctgcctgatgctgccccccagcacccacctgcaggtgcccatcggccagcacgtgtacctgaagctgcccatcaccggcaccgagatcgtgaagccctacacccccgtgagcggcagcctgctgagcgagttcaaggagcccgtgctgcccaacaacaagtacatctacttcctgatcaagatctaccccaccggcctgttcacccccgagctggacagactgcagatcggcgacttcgtgagcgtgagcagccccgagggcaacttcaagatcagcaagttccaggagctggaggacctgttcctgctggccgccggcaccggcttcacccccatggtgaagatcctgaactacgccctgaccgacatccccagcctgagaaaggtgaagctgatgttcttcaacaagaccgaggacgacatcatctggagaagccagctggagaagctggccttcaaggacaagagactggacgtggagttcgtgctgagcgcccccatcagcgagtggaacggcaagcagggccacatcagccccgccctgctgagcgagttcctgaagagaaacctggacaagagcaaggtgctggtgtgcatctgcggccccgtgcccttcaccgagcagggcgtgagactgctgcacgacctgaacttcagcaagaacgagatccacagcttcaccgcctag

SEQ ID NO: 78180 - DNA, 297 bp, Artificial Sequence
  Description of Artificial Sequence: Synthetic coding sequence
atggccgagcagagcgacgaggccgtgaagtactacaccctggaggagatccagaagcacaaccacagcaagagcacctggctgatcctgcaccacaaggtgtacgacctgaccaagttcctggaggagcaccccggcggcgaggaggtgctgagagagcaggccggcggcgacgccaccgagaacttcgaggacgtgggccacagcaccgacgccagagagatgagcaagaccttcatcatcggcgagctgcaccccgacgacagacccaagctgaacaagccccccaagccctag

SEQ ID NO: 78181 - DNA, 405 bp, Artificial Sequence
  Description of Artificial Sequence: Synthetic coding sequence
atggccgagcagagcgacgaggccgtgaagtactacaccctggaggagatccagaagcacaaccacagcaagagcacctggctgatcctgcaccacaaggtgtacgacctgaccaagttcctggaggagcaccccggcggcgaggaggtgctgagagagcaggccggcggcgacgccaccgagaacttcgaggacgtgggccacagcaccgacgccagagagatgagcaagaccttcatcatcggcgagctgcaccccgacgacagacccaagctgaacaagccccccgagaccctgatcaccaccatcgacagcagcagcagctggtggaccaactgggtgatccccgccatcagcgccgtggccgtggccctgatgtacagactgtacatggccgaggactag

SEQ ID NO: 78182 - DNA, 375 bp, Artificial Sequence
  Description of Artificial Sequence: Synthetic coding sequence
atggccgagcagagcgacgaggccgtgaagtactacaccctggaggagatccagaagcacaaccacagcaagagcacctggctgatcctgcaccacaaggtgtacgacctgaccaagttcctggaggagcaccccggcggcgaggaggtgctgagagagcaggccggcggcgacgccaccgagaacttcgaggacgtgggccacagcaccgacgccagagagatgagcaagaccttcatcatcggcgagctgcaccccgagaccctgatcaccaccatcgacagcagcagcagctggtggaccaactgggtgatccccgccatcagcgccgtggccgtggccctgatgtacagactgtacatggccgaggactag

SEQ ID NO: 78183 - DNA, 297 bp, Artificial Sequence
  Description of Artificial Sequence: Synthetic coding sequence
atggccgagcagagcgacgaggccgtgaagtactacaccctggaggagatccagaagcacaaccacagcaagagcacctggctgatcctgcaccacaaggtgtacgacctgaccaagttcctggaggagcaccccggcggcgaggaggtgctgagagagcaggccggcggcgacgccaccgagaacttcgaggacgtgggccacagcaccgacgccagagagatgagcaagaccttcatcatcggcgagctgcaccccgacgacagacccaagctgaacaagccccccgagccctag

SEQ ID NO: 78184 - DNA, 453 bp, Artificial Sequence
  Description of Artificial Sequence: Synthetic coding sequence
atgagcggcagcatggccaccgccgaggccagcggcagcgacggcaagggccaggaggtggagaccagcgtgacctactacagactggaggaggtggccaagagaaacagcctgaaggagctgtggctggtgatccacggcagagtgtacgacgtgaccagattcctgaacgagcaccccggcggcgaggaggtgctgctggagcaggccggcgtggacgccagcgagagcttcgaggacgtgggccacagcagcgacgccagagagatgctgaagcagtactacatcggcgacatccaccccagcgacctgaagcccgagagcggcagcaaggaccccagcaagaacgacacctgcaagagctgctgggcctactggatcctgcccatcatcggcgccgtgctgctgggcttcctgtacagatactacaccagcgagagcaagagcagctag

SEQ ID NO: 78185 - DNA, 441 bp, Artificial Sequence
  Description of Artificial Sequence: Synthetic coding sequence
atggccaccgccgaggccagcggcagcgacggcaagggccaggaggtggagaccagcgtgacctactacagactggaggaggtggccaagagaaacagcctgaaggagctgtggctggtgatccacggcagagtgtacgacgtgaccagattcctgaacgagcaccccggcggcgaggaggtgctgctggagcaggccggcgtggacgccagcgagagcttcgaggacgtgggccacagcagcgacgccagagagatgctgaagcagtactacatcggcgacatccaccccagcgacctgaagcccgagagcggcagcaaggaccccagcaagaacgacacctgcaagagctgctgggcctactggatcctgcccatcatcggcgccgtgctgctgggcttcctgtacagatactacaccagcgagagcaagagcagctag

SEQ ID NO: 78186 - DNA, 756 bp, Artificial Sequence
  Description of Artificial Sequence: Synthetic coding sequence
atggagggcggcgccgccgccgccacccccaccgccctgccctactacgtggccttcagccagctgctgggcctgaccctggtggccatgaccggcgcctggctgggcctgtacagaggcggcatcgcctgggagagcgacctgcagttcaacgcccaccccctgtgcatggtgatcggcctgatcttcctgcagggcaacgccctgctggtgtacagagtgttcagaaacgaggccaagagaaccaccaaggtgctgcacggcctgctgcacatcttcgccctggtgatcgccctggtgggcctggtggccgtgttcgactaccacagaaagaagggctacgccgacctgtacagcctgcacagctggtgcggcatcctggtgttcgtgctgtacttcgtgcagtggctggtgggcttcagcttcttcctgttccccggcgccagcttcagcctgagaagcagatacagaccccagcacatcttcttcggcgccaccatcttcctgctgagcgtgggcaccgccctgctgggcctgaaggaggccctgctgttcaacctgggcggcaagtacagcgccttcgagcccgagggcgtgctggccaacgtgctgggcctgctgctggcctgcttcggcggcgccgtgctgtacatcctgaccagagccgactggaagagacccagccaggccgaggagcaggccctgagcatggacttcaagaccctgaccgagggcgacagccccggcagccagtag

SEQ ID NO: 78187 - DNA, 756 bp, Artificial Sequence; identical to SEQ ID NO: 78186
  Description of Artificial Sequence: Synthetic coding sequence

SEQ ID NO: 78188 - DNA, 756 bp, Artificial Sequence; identical to SEQ ID NO: 78186
  Description of Artificial Sequence: Synthetic coding sequence

SEQ ID NO: 78189 - DNA, 417 bp, Artificial Sequence
  Description of Artificial Sequence: Synthetic coding sequence
atggagggcggcgccgccgccgccacccccaccgccctgccctactacgtggccttcagccagctgctgggcctgaccctggtggccatgaccggcgcctggctgggcctgtacagaggcggcatcgcctgggagagcgacctgcagttcaacgcccaccccctgtgcatggtgatcggcctgatcttcctgcagggcaacgccctgctggtgtacagagtgttcagaaacgaggccaagagaaccaccaaggtgctgcacggcctgctgcacatcttcgccctggtgatcgccctggtgggcctggtggccgtgttcgactaccacagaaagaagggctacgccgacctgtacagcctgcacagctggtgcggcatcctggtgttcgtgctgtacttcgtgcagggccaggtgtag

SEQ ID NO: 78190 - DNA, 957 bp, Artificial Sequence
  Description of Artificial Sequence: Synthetic coding sequence
atgaagcagaagaccaagcccggcaccggccccctgagcagcctggagttcggcgtgagcttcctggcccccagcccccacatggagctgctggccagctgccccagaagcagactgagcccctggggcggctgggcccccccccccagccacagcagagacctgagacccctgccccaggacgacggcgtgtgcctgagcatggagggcggcgccgccgccgccacccccaccgccctgccctactacgtggccttcagccagctgctgggcctgaccctggtggccatgaccggcgcctggctgggcctgtacagaggcggcatcgcctgggagagcgacctgcagttcaacgcccaccccctgtgcatggtgatcggcctgatcttcctgcagggcaacgccctgctggtgtacagagtgttcagaaacgaggccaagagaaccaccaaggtgctgcacggcctgctgcacatcttcgccctggtgatcgccctggtgggcctggtggccgtgttcgactaccacagaaagaagggctacgccgacctgtacagcctgcacagctggtgcggcatcctggtgttcgtgctgtacttcgtgcagtggctggtgggcttcagcttcttcctgttccccggcgccagcttcagcctgagaagcagatacagaccccagcacatcttcttcggcgccaccatcttcctgctgagcgtgggcaccgccctgctgggcctgaaggaggccctgctgttcaacctgggcggcaagtacagcgccttcgagcccgagggcgtgctggccaacgtgctgggcctgctgctggcctgcttcggcggcgccgtgctgtacatcctgaccagagccgactggaagagacccagccaggccgaggagcaggccctgagcatggacttcaagaccctgaccgagggcgacagccccggcagccagtag

SEQ ID NO: 78191 - DNA, 1143 bp, Artificial Sequence
  Description of Artificial Sequence: Synthetic coding sequence
atgggcagcggctgcagaatcgagtgcatcttcttcagcgagttccaccccaccctgggccccaagatcacctaccaggtgcccgaggacttcatcagcagagagctgttcgacaccgtgcaggtgtacatcatcaccaagcccgagctgcagaacaagctgatcaccgtgaccgccatggagaagaagctgatcggctgccccgtgtgcatcgagcacaagaagtacagcagaaacgccctgctgttcaacctgggcttcgtgtgcgacgcccaggccaagacctgcgccctggagcccatcgtgaagaagctggccggctacctgaccaccctggagctggagagcagcttcgtgagcatggaggagagcaagcagaagctggtgcccatcatgaccatcctgctggaggagctgaacgccagcggcagatgcaccctgcccatcgacgagagcaacaccatccacctgaaggtgatcgagcagagacccgacccccccgtggcccaggagtacgacgtgcccgtgttcaccaaggacaaggaggacttcttcaacagccagtgggacctgaccacccagcagatcctgccctacatcgacggcttcagacacatccagaagatcagcgccgaggccgacgtggagctgaacctggtgagaatcgccatccagaacctgctgtactacggcgtggtgaccctggtgagcatcctgcagtacagcaacgtgtactgccccacccccaaggtgcaggacctggtggacgacaagagcctgcaggaggcctgcctgagctacgtgaccaagcagggccacaagagagccagcctgagagacgtgttccagctgtactgcagcctgagccccggcaccaccgtgagagacctgatcggcagacacccccagcagctgcagcacgtggacgagagaaagctgatccagttcggcctgatgaagaacctgatcagaagactgcagaagtaccccgtgagagtgaccagagaggagcagagccaccccgccagactgtacaccggctgccacagctacgacgagatctgctgcaagaccggcatgagctaccacgagctggacgagagactggagaacgaccccaacatcatcatctgctggaagtag

SEQ ID NO: 78192 - DNA, 669 bp, Artificial Sequence
  Description of Artificial Sequence: Synthetic coding sequence
atggccctgagcgccgagaccgagagccacatctacagagccctgagaaccgccagcggcgccgccgcccacctggtggccctgggcttcaccatcttcgtggccgtgctggccagacccggcagcagcctgttcagctggcaccccgtgctgatgagcctggccttcagcttcctgatgaccgaggccctgctggtgttcagccccgagagcagcctgctgcacagcctgagcagaaagggcagagccagatgccactgggtgctgcagctgctggccctgctgtgcgccctgctgggcctgggcctggtgatcctgcacaaggagcagctgggcaaggcccacctggtgaccagacacggccaggccggcctgctggccgtgctgtgggccggcctgcagtgcagcggcggcgtgggcctgctgtaccccaagctgctgcccagatggcccctggccaagctgaagctgtaccacgccaccagcggcctggtgggctacctgctgggcagcgccagcctgctgctgggcatgtgcagcctgtggttcaccgccagcgtgaccggcgccgcctggtacctggccgtgctgtgccccgtgctgaccagcctggtgatcatgaaccaggtgagcaacgcctacctgtacagaaagagaatccagccctag

SEQ ID NO: 78193 - DNA, 669 bp, Artificial Sequence; identical to SEQ ID NO: 78192
  Description of Artificial Sequence: Synthetic coding sequence

SEQ ID NO: 78194 - DNA, 669 bp, Artificial Sequence; identical to SEQ ID NO: 78192
  Description of Artificial Sequence: Synthetic coding sequence

SEQ ID NO: 78195 - DNA, 696 bp, Artificial Sequence
  Description of Artificial Sequence: Synthetic coding sequence
atgggcggcctgtggagacccggctggagatgcgtgcccttctgcggctggagatggatccaccccggcagccccaccagagccgccgagagagtggagcccttcctgagacccgagtggagcggcaccggcggcgccgagagaggcctgagatggctgggcacctggaagagatgcagcctgagagccagacaccccgccctgcagccccccagaagacccaagagcagcaaccccttcaccagagcccaggaggaggagagaagaagacagaacaagaccaccctgacctacgtggccgccgtggccgtgggcatgctgggcgccagctacgccgccgtgcccctgtacagactgtactgccagaccaccggcctgggcggcagcgccgtggccggccacgccagcgacaagatcgagaacatggtgcccgtgaaggacagaatcatcaagatcagcttcaacgccgacgtgcacgccagcctgcagtggaacttcagaccccagcagaccgagatctacgtggtgcccggcgagaccgccctggccttctacagagccaagaaccccaccgacaagcccgtgatcggcatcagcacctacaacatcgtgcccttcgaggccggccagtacttcaacaagatccaggccagcaagctgcacagagtgtacgtgctggagagctggcacctgtag

SEQ ID NO: 78196 - DNA, 510 bp, Artificial Sequence
  Description of Artificial Sequence: Synthetic coding sequence
atgctggccaccagagtgttcagcctggtgggcaagagagccatcagcaccagcgtgtgcgtgagagcccacgagagcgtggtgaagagcgaggacttcagcctgcccgcctacatggacagaagagaccaccccctgcccgaggtggcccacgtgaagcacctgagcgccagccagaaggccctgaaggagaaggagaaggccagctggagcagcctgagcatggacgagaaggtggagctgtacagaatcaagttcaaggagagcttcgccgagatgaacagaggcagcaacgagtggaagaccgtggtgggcggcgccatgttcttcatcggcttcaccgccctggtgatcatgtggcagaagcactacgtgtacggccccctgccccagagcttcgacaaggagtgggtggccaagcagaccaagagaatgctggacatgaaggtgaaccccatccagggcctggccagcaagtgggactacgagaagaacgagtggaagaagtag

SEQ ID NO: 78197 - DNA, 516 bp, Artificial Sequence
  Description of Artificial Sequence: Synthetic coding sequence
atgctgcccagagccgcctggagcctggtgctgagaaagggcggcggcggcagaagaggcatgcacagcagcgagggcaccaccagaggcggcggcaagatgagcccctacaccaactgctacgcccagagatactaccccatgcccgaggagcccttctgcaccgagctgaacgccgaggagcaggccctgaaggagaaggagaagggcagctggacccagctgacccacgccgagaaggtggccctgtacagactgcagttcaacgagaccttcgccgagatgaacagaagaagcaacgagtggaagaccgtgatgggctgcgtgttcttcttcatcggcttcgccgccctggtgatctggtggcagagagtgtacgtgttcccccccaagcccatcaccctgaccgacgagagaaaggcccagcagctgcagagaatgctggacatgaaggtgaaccccgtgcagggcctggccagcagatgggactacgagaagaagcagtggaagaagtag

SEQ ID NO: 78198 - DNA, 390 bp, Artificial Sequence
  Description of Artificial Sequence: Synthetic coding sequence
atggccagcagactgctgagaggcgccggcaccctggccgcccaggccctgagagccagaggccccagcggcgccgccgccatgagaagcatggccagcggcggcggcgtgcccaccgacgaggagcaggccaccggcctggagagagagatcatgctggccgccaagaagggcctggacccctacaacgtgctggcccccaagggcgccagcggcaccagagaggaccccaacctggtgcccagcatcagcaacaagagaatcgtgggctgcatctgcgaggaggacaacaccagcgtggtgtggttctggctgcacaagggcgaggcccagagatgccccagatgcggcgcccactacaagctggtgccccagcagctggcccactag

SEQ ID NO: 78199 - DNA, 606 bp, Artificial Sequence
  Description of Artificial Sequence: Synthetic coding sequence
atggccagagactacgaccacctgttcaagctgctgatcatcggcgacagcggcgtgggcaagagcagcctgctgctgagattcgccgacaacaccttcagcggcagctacatcaccaccatcggcgtggacttcaagatcagaaccgtggagatcaacggcgagaaggtgaagctgcagatctgggacaccgccggccaggagagattcagaaccatcaccagcacctactacagaggcacccacggcgtgatcgtggtgtacgacgtgaccagcgccgagagcttcgtgaacgtgaagagatggctgcacgagatcaaccagaactgcgacgacgtgtgcagaatcctggtgggcaacaagaacgacgaccccgagagaaaggtggtggagaccgaggacgcctacaagttcgccggccagatgggcatccagctgttcgagaccagcgccaaggagaacgtgaacgtggaggagatgttcaactgcatcaccgagctggtgctgagagccaagaaggacaacctggccaagcagcagcagcagcagcagaacgacgtggtgaagctgaccaagaacagcaagagaaagaagagatgctgctag

SEQ ID NO: 78200 - DNA, 261 bp, Artificial Sequence
  Description of Artificial Sequence: Synthetic coding sequence
atggccgaggacatggagaccaagatcaagaactacaagaccgcccccttcgacagcagattccccaaccagaaccagaccagaaactgctggcagaactacctggacttccacagatgccagaaggccatgaccgccaagggcggcgacatcagcgtgtgcgagtggtaccagagagtgtaccagagcctgtgccccaccagctgggtgaccgactgggacgagcagagagccgagggcaccttccccggcaagatctag

SEQ ID NO: 78201 - DNA, 312 bp, Artificial Sequence
  Description of Artificial Sequence: Synthetic coding sequence
atgcacccccacccccagatccccggcagagacctggccggcttcagcaccatggccgaggacatggagaccaagatcaagaactacaagaccgcccccttcgacagcagattccccaaccagaaccagaccagaaactgctggcagaactacctggacttccacagatgccagaaggccatgaccgccaagggcggcgacatcagcgtgtgcgagtggtaccagagagtgtaccagagcctgtgccccaccagctgggtgaccgactgggacgagcagagagccgagggcaccttccccggcaagatctag

SEQ ID NO: 78202 - DNA, 228 bp, Artificial Sequence
  Description of Artificial Sequence: Synthetic coding sequence
atggcccccgaggtgctgcccaagcccagaatgagaggcctgctggccagaagactgagaaaccacatggccgtggccttcgtgctgagcctgggcgtggccgccctgtacaagttcagagtggccgaccagagaaagaaggcctacgccgacttctacagaaactacgacgtgatgaaggacttcgaggagatgagaaaggccggcatcttccagagcgtgaagtag

SEQ ID NO: 78203 - DNA, 228 bp, Artificial Sequence; identical to SEQ ID NO: 78202
  Description of Artificial Sequence: Synthetic coding sequence

SEQ ID NO: 78204 - DNA, 228 bp, Artificial Sequence; identical to SEQ ID NO: 78202
  Description of Artificial Sequence: Synthetic coding sequence

SEQ ID NO: 78205 - DNA, 228 bp, Artificial Sequence; identical to SEQ ID NO: 78202
  Description of Artificial Sequence: Synthetic coding sequence

SEQ ID NO: 78206 - DNA, 228 bp, Artificial Sequence; identical to SEQ ID NO: 78202
  Description of Artificial Sequence: Synthetic coding sequence

SEQ ID NO: 78207 - DNA, 228 bp, Artificial Sequence; identical to SEQ ID NO: 78202
  Description of Artificial Sequence: Synthetic coding sequence

SEQ ID NO: 78208 - DNA, 228 bp, Artificial Sequence; identical to SEQ ID NO: 78202
  Description of Artificial Sequence: Synthetic coding sequence

SEQ ID NO: 78209 - DNA, 228 bp, Artificial Sequence; identical to SEQ ID NO: 78202
  Description of Artificial Sequence: Synthetic coding sequence

SEQ ID NO: 78210 - DNA, 228 bp, Artificial Sequence; identical to SEQ ID NO: 78202
  Description of Artificial Sequence: Synthetic coding sequence

SEQ ID NO: 78211 - DNA, 228 bp, Artificial Sequence; identical to SEQ ID NO: 78202
  Description of Artificial Sequence: Synthetic coding sequence

SEQ ID NO: 78212 - DNA, 240 bp, Artificial Sequence
  Description of Artificial Sequence: Synthetic coding sequence
atgcaggccctgagagtgagccaggccctgatcagaagcttcagcagcaccgccagaaacagattccagaacagagtgagagagaagcagaagctgttccaggaggacaacgacatccccctgtacctgaagggcggcatcgtggacaacatcctgtacagagtgaccatgaccctgtgcctgggcggcaccgtgtacagcctgtacagcctgggctgggccagcttccccagaaactag

SEQ ID NO: 78213 - DNA, 330 bp, Artificial Sequence
  Description of Artificial Sequence: Synthetic coding sequence
tgaagcttctgggtgctgagcctgcccggccccagcagacagcccggccacccccaggccagactgcagggcgagagcccccccaaccccgccggcagcagcagagtgagccaggccctgatcagaagcttcagcagcaccgccagaaacagattccagaacagagtgagagagaagcagaagctgttccaggaggacaacgacatccccctgtacctgaagggcggcatcgtggacaacatcctgtacagagtgaccatgaccctgtgcctgggcggcaccgtgtacagcctgtacagcctgggctgggccagcttccccagaaactag

SEQ ID NO: 78214 - DNA, 2775 bp, Artificial Sequence
  Description of Artificial Sequence: Synthetic coding sequence
atgagcagaagcagacagccccccctggtgaccggcatcagccccaacgagggcatcccctggaccaaggtgaccatcagaggcgagaacctgggcaccggccccaccgacctgatcggcctgaccatctgcggccacaactgcctgctgaccgccgagtggatgagcgccagcaagatcgtgtgcagagtgggccaggccaagaacgacaagggcgacatcatcgtgaccaccaagagcggcggcagaggcaccagcaccgtgagcttcaagctgctgaagcccgagaagatcggcatcctggaccagagcgccgtgtgggtggacgagatgaactactacgacatgagaaccgacagaaacaagggcatcccccccctgagcctgagacccgccaaccccctgggcatcgagatcgagaagagcaagttcagccagaaggacctggagatgctgttccacggcatgagcgccgacttcaccagcgagaacttcagcgccgcctggtacctgatcgagaaccacagcaacaccagcttcgagcagctgaagatggccgtgaccaacctgaagagacaggccaacaagaagagcgagggcagcctggcctacgtgaagggcggcctgagcaccttcttcgaggcccaggacgccctgagcgccatccaccagaagctggaggccgacggcaccgagaaggtggagggcagcatgacccagaagctggagaacgtgctgaacagagccagcaacaccgccgacaccctgttccaggaggtgctgggcagaaaggacaaggccgacagcaccagaaacgccctgaacgtgctgcagagattcaagttcctgttcaacctgcccctgaacatcgagagaaacatccagaagggcgactacgacgtggtgatcaacgactacgagaaggccaagagcctgttcggcaagaccgaggtgcaggtgttcaagaagtactacgccgaggtggagaccagaatcgaggccctgagagagctgctgctggacaagctgctggagacccccagcaccctgcacgaccagaagagatacatcagatacctgagcgacctgcacgccagcggcgaccccgcctggcagtgcatcggcgcccagcacaagtggatcctgcagctgatgcacagctgcaaggagggctacgtgaaggacctgaagggcaaccccggcctgcacagccccatgctggacctggacaacgacaccagacccagcgtgctgggccacctgagccagaccgccagcctgaagagaggcagcagcttccagagcggcagagacgacacctggagatacaagaccccccacagagtggccttcgtggagaagctgaccaagctggtgctgagccagctgcccaacttctggaagctgtggatcagctacgtgaacggcagcctgttcagcgagaccgccgagaagagcggccagatcgagagaagcaagaacgtgagacagagacagaacgacttcaagaagatgatccaggaggtgatgcacagcctggtgaagctgaccagaggcgccctgctgcccctgagcatcagagacggcgaggccaagcagtacggcggctgggaggtgaagtgcgagctgagcggccagtggctggcccacgccatccagaccgtgagactgacccacgagagcctgaccgccctggagatccccaacgacctgctgcagaccatccaggacctgatcctggacctgagagtgagatgcgtgatggccaccctgcagcacaccgccgaggagatcaagagactggccgagaaggaggactggatcgtggacaacgagggcctgaccagcctgccctgccagttcgagcagtgcatcgtgtgcagcctgcagagcctgaagggcgtgctggagtgcaagcccggcgaggccagcgtgttccagcagcccaagacccaggaggaggtgtgccagctgagcatcaacatcatgcaggtgttcatctactgcctggagcagctgagcaccaagcccgacgccgacatcgacaccacccacctgagcgtggacgtgagcagccccgacctgttcggcagcatccacgaggacttcagcctgaccagcgagcagagactgctgatcgtgctgagcaactgctgctacctggagagacacaccttcctgaacatcgccgagcacttcgagaagcacaacttccagggcatcgagaagatcacccaggtgagcatggccagcctgaaggagctggaccagagactgttcgagaactacatcgagctgaaggccgaccccatcgtgggcagcctggagcccggcatctacgccggctacttcgactggaaggactgcctgccccccaccggcgtgagaaactacctgaaggaggccctggtgaacatcatcgccgtgcacgccgaggtgttcaccatcagcaaggagctggtgcccagagtgctgagcaaggtgatcgaggccgtgagcgaggagctgagcagactgatgcagtgcgtgagcagcttcagcaagaacggcgccctgcaggccagactggagatctgcgccctgagagacaccgtggccgtgtacctgacccccgagagcaagagcagcttcaagcaggccctggaggccctgccccagctgagcagcggcgccgacaagaagctgctggaggagctgctgaacaagttcaagagcagcatgcacctgcagctgacctgcttccaggccgccagcagcaccatgatgaagacctag

SEQ ID NO: 78215 - DNA, 348 bp, Artificial Sequence
  Description of Artificial Sequence: Synthetic coding sequence
atgcacacccaggacagcgaggtggtgcccgtgcccgcctggcccttcagcctggtggtgttcagctgcggcggctgctggagcgtgaccgccaagatgctgagaaacctgctggccctgagacagatcggccagagaaccatcagcaccgccagcagaagacacttcaagaacaaggtgcccgagaagcagaagctgttccaggaggacgacgagatccccctgtacctgaagggcggcgtggccgacgccctgctgtacagagccaccatgatcctgaccgtgggcggcaccgcctacgccatctacgagctggccgtggccagcttccccaagaagcaggagtag

SEQ ID NO: 78216 - DNA, 348 bp, Artificial Sequence; identical to SEQ ID NO: 78215
  Description of Artificial Sequence: Synthetic coding sequence

SEQ ID NO: 78217 - DNA, 1734 bp, Artificial Sequence
  Description of Artificial Sequence: Synthetic coding sequence
atgagcaagcccgagctgaaggaggacaagatgctggaggtgcacttcgtgggcgacgacgacgtgctgaaccacatcctggacagagagggcggcgccaagctgaagaaggagagagcccagctgctggtgaaccccaagaagatcatcaagaagcccgagtacgacctggaggaggacgaccaggaggtgctgaaggaccagaactacgtggagatcatgggcagagacgtgcaggagagcctgaagaacggcagcgccaccggcggcggcaacaaggtgtacagcttccagaacagaaagcacagcgagaagatggccaagctggccagcgagctggccaagaccccccagaagagcgtgagcttcagcctgaagaacgaccccgagatcaccatcaacgtgccccagagcagcaagggccacagcgccagcgacaaggtgcagcccaagaacaacgacaagagcgagttcctgagcaccgcccccagaagcctgagaaagagactgatcgtgcccagaagccacagcgacagcgagagcgagtacagcgccagcaacagcgaggacgacgagggcgtggcccaggagcacgaggaggacaccaacgccgtgatcttcagccagaagatccaggcccagaacagagtggtgagcgcccccgtgggcaaggagacccccagcaagagaatgaagagagacaagaccagcgacctggtggaggagtacttcgaggcccacagcagcagcaaggtgctgaccagcgacagaaccctgcagaagctgaagagagccaagctggaccagcagaccctgagaaacctgctgagcaaggtgagccccagcttcagcgccgagctgaagcagctgaaccagcagtacgagaagctgttccacaagtggatgctgcagctgcacctgggcttcaacatcgtgctgtacggcctgggcagcaagagagacctgctggagagattcagaaccaccatgctgcaggacagcatccacgtggtgatcaacggcttcttccccggcatcagcgtgaagagcgtgctgaacagcatcaccgaggaggtgctggaccacatgggcaccttcagaagcatcctggaccagctggactggatcgtgaacaagttcaaggaggacagcagcctggagctgttcctgctgatccacaacctggacagccagatgctgagaggcgagaagagccagcagatcatcggccagctgagcagcctgcacaacatctacctgatcgccagcatcgaccacctgaacgcccccctgatgtgggaccacgccaagcagagcctgttcaactggctgtggtacgagaccaccacctacagcccctacaccgaggagaccagctacgagaacagcctgctggtgaagcagagcggcagcctgcccctgagcagcctgacccacgtgctgagaagcctgacccccaacgccagaggcatcttcagactgctgatcaagtaccagctggacaaccaggacaaccccagctacatcggcctgagcttccaggacttctaccagcagtgcagagaggccttcctggtgaacagcgacctgaccctgagagcccagctgaccgagttcagagaccacaagctgatcagaaccaagaagggcaccgacggcgtggagtacctgctgatccccgtggacaacggcaccctgaccgacttcctggagaaggaggaggaggaggcctag

SEQ ID NO: 78218 - DNA, 345 bp, Artificial Sequence
  Description of Artificial Sequence: Synthetic coding sequence
atgtactacaagttcagcggcttcacccagaagctggccggcgcctgggccagcgaggcctacagcccccagggcctgaagcccgtggtgagcaccgaggccccccccatcatcttcgccacccccaccaagctgaccagcgacagcaccgtgtacgactacgccggcaagaacaaggtgcccgagctgcagaagttcttccagaaggccgacggcgtgcccgtgtacctgaagagaggcctgcccgaccagatgctgtacagaaccaccatggccctgaccgtgggcggcaccatctactgcctgatcgccctgtacatggccagccagcccaagaacaagtag

SEQ ID NO: 78219 - DNA, 246 bp, Artificial Sequence
  Description of Artificial Sequence: Synthetic coding sequence
atgatgttccccctggccagaaacgccctgagcagcctgaagatccagagcatcctgcagagcatggccagacacagccacgtgaagcacagccccgacttccacgacaagtacggcaacgccgtgctggccagcggcaccgccttctgcgtggccacctgggtgttcaccgccacccagatcggcatcgagtggaacctgagccccgtgggcagagtgacccccaaggagtggaagcaccagtag

SEQ ID NO: 78220 - DNA, 246 bp, Artificial Sequence; identical to SEQ ID NO: 78219
  Description of Artificial Sequence: Synthetic coding sequence

SEQ ID NO: 78221 - DNA, 246 bp, Artificial Sequence; identical to SEQ ID NO: 78219
  Description of Artificial Sequence: Synthetic coding sequence

SEQ ID NO: 78222 - DNA, 99 bp, Artificial Sequence
  Description of Artificial Sequence: Synthetic coding sequence
atgatgttccccctggccagaaacgccctgagcagcctgaagatccagagcatcctgcagagcatggccagacacagccacgtgaagcacagcccctag

SEQ ID NO: 78223 - DNA, 243 bp, Artificial Sequence
  Description of Artificial Sequence: Synthetic coding sequence
atgttccccctggccagaaacgccctgagcagcctgaagatccagagcatcctgcagagcatggccagacacagccacgtgaagcacagccccgacttccacgacaagtacggcaacgccgtgctggccagcggcaccgccttctgcgtggccacctgggtgttcaccgccacccagatcggcatcgagtggaacctgagccccgtgggcagagtgacccccaaggagtggaagcaccagtag

SEQ ID NO: 78224 - DNA, 192 bp, Artificial Sequence
  Description of Artificial Sequence: Synthetic coding sequence
atgctgggccagagcatcagaagattcaccaccagcgtggtgagaagaagccactacgaggagggccccggcaagaacctgcccttcagcgtggagaacaagtggagcctgctggccaagatgtgcctgtacttcggcagcgccttcgccacccccttcctggtggtgagacaccagctgctgaagacctag

SEQ ID NO: 78225 - DNA, 192 bp, Artificial Sequence; identical to SEQ ID NO: 78224
  Description of Artificial Sequence: Synthetic coding sequence

SEQ ID NO: 78226 - DNA, 978 bp, Artificial Sequence
  Description of Artificial Sequence: Synthetic coding sequence
atggccgccgccgccgccagcctgagaggcgtggtgctgggccccagaggcgccggcctgcccggcgccagagccagaggcctgctgtgcagcgccagacccggccagctgcccctgagaaccccccaggccgtggccctgagcagcaagagcggcctgagcagaggcagaaaggtgatgctgagcgccctgggcatgctggccgccggcggcgccggcctggccatggccctgcacagcgccgtgagcgccagcgacctggagctgcacccccccagctacccctggagccacagaggcctgctgagcagcctggaccacaccagcatcagaagaggcttccaggtgtacaagcaggtgtgcgccagctgccacagcatggacttcgtggcctacagacacctggtgggcgtgtgctacaccgaggacgaggccaaggagctggccgccgaggtggaggtgcaggacggccccaacgaggacggcgagatgttcatgagacccggcaagctgttcgactacttccccaagccctaccccaacagcgaggccgccagagccgccaacaacggcgccctgccccccgacctgagctacatcgtgagagccagacacggcggcgaggactacgtgttcagcctgctgaccggctactgcgagccccccaccggcgtgagcctgagagagggcctgtacttcaacccctacttccccggccaggccatcgccatggccccccccatctacaccgacgtgctggagttcgacgacggcacccccgccaccatgagccagatcgccaaggacgtgtgcaccttcctgagatgggccagcgagcccgagcacgaccacagaaagagaatgggcctgaagatgctgatgatgatggccctgctggtgcccctggtgtacaccatcaagagacacaagtggagcgtgctgaagagcagaaagctggcctacagaccccccaagtag

SEQ ID NO: 78227 - DNA, 252 bp, Artificial Sequence
  Description of Artificial Sequence: Synthetic coding sequence
atggagcccttcgtggtgctggtgctgtgcctgagcttcatgctgctgttcagcctgtggagacagagctgcagaagaagaaagctgccccccggccccacccccctgcccatcatcggcaacatgctgcagatcgacgtgaaggacatctgcaagagcttcaccaacgtgagcctgccctacgtgccccccgccaactgcaagggcagccagaagagcatggtgctgtgcagcccctgcatcctggcctag

SEQ ID NO: 78228 - DNA, 219 bp, Artificial Sequence
  Description of Artificial Sequence: Synthetic coding sequence
atggagcccttcgtggtgctggtgctgtgcctgagcttcatgctgctgttcagcctgtggagacagagctgcagaagaagaaagctgccccccggccccacccccctgcccatcatcggcaacatgctgcagatcgacgtgaaggacatctgcaagagcttcaccaacgtgagcctgccctacgtgccccccgccaactgcaagggcgtgctgctgtag

SEQ ID NO: 78229 - DNA, 423 bp, Artificial Sequence
  Description of Artificial Sequence: Synthetic coding sequence
atggacctgatccccaacctggccgtggagacctggctgctgctggccgtgagcctggtgctgctgtacctgtacggcaccagaacccacggcctgttcaagagactgggcatccccggccccacccccctgcccctgctgggcaacgtgctgagctacagacagggcctgtggaagttcgacaccgagtgctacaagaagtacggcaagatgtggggcacctacgagggccagctgcccgtgctggccatcaccgaccccgacgtgatcagaaccgtgctggtgaaggagtgctacagcgtgttcaccaacagaagaatctgcgccaccaccagcaccatcaagatgcagacccacagcgtgaccatgtggctgccccccgccgtgctgcagagccagcacggcgtgtgcctgttcctgtag

SEQ ID NO: 78230 - DNA, 1563 bp, Artificial Sequence
  Description of Artificial Sequence: Synthetic coding sequence
atgccccagctgagcctgagcagcctgggcctgtggcccatggccgccagcccctggctgctgctgctgctggtgggcgccagctggctgctggccagaatcctggcctggacctacaccttctacgacaactgctgcagactgagatgcttcccccagccccccaagagaaactggttcctgggccacctgggcctggtgacccccaccgagcagggcatgagagtgctgacccagctggtggccacctacccccagggcttcaaggtgtggatgggccccatcttccccgtgatcagattctgccaccccaacatcatcagaagcgtgatcaacgccagcgccgccatcgtgcccaaggacaaggtgttctacagcttcctgaagccctggctgggcgacggcctgctgctgagcgccggcgagaagtggagcagacacagaagaatgctgacccccgccttccacttcaacatcctgaagccctacatgaagatcttcaacgagagcgtgaacatcatgcacgccaagtggcagctgctggccagcgagggcagcgccagactggacatgttcgagcacatcagcctgatgaccctggacagcctgcagaagtgcgtgttcagcttcgacagccactgccaggagaagcccagcgagtacatcgccgccatcctggagctgagcgccctggtgaccaagagacaccagcagatcctgctgtacatcgacttcctgtactacctgacccccgacggccagagattcagaagagcctgcagactggtgcacgacttcaccgacgccgtgatccaggagagaagaagaaccctgcccagccagggcgtggacgacttcctgcaggccaaggccaagagcaagaccctggacttcatcgacgtgctgctgctgagcaaggacgaggacggcaagaagctgagcgacgaggacatcagagccgaggccgacaccttcatgttcgagggccacgacaccaccgccagcggcctgagctgggtgctgtaccacctggccaagcaccccgagtaccaggagagatgcagacaggaggtgcaggagctgctgaaggacagagagcccaaggagatcgagtgggacgacctggcccagctgcccttcctgaccatgtgcatcaaggagagcctgagactgcacccccccgtgcccgccgtgagcagatgctgcacccaggacatcgtgctgcccgacggcagagtgatccccaagggcatcatctgcctgatcagcgtgttcggcacccaccacaaccccgccgtgtggcccgaccccgaggtgtacgaccccttcagattcgaccccaagaacatcaaggagagaagccccctggccttcatccccttcagcgccggccccagaaactgcatcggccaggccttcgccatggccgagatgaaggtggtgctgggcctgaccctgctgagattcagagtgctgcccgaccacaccgagcccagaagaaagcccgagctggtgctgagagccgagggcggcctgtggctgagagtggagcccctgagctag

SEQ ID NO: 78231 - DNA, 1455 bp, Artificial Sequence
  Description of Artificial Sequence: Synthetic coding sequence
atgctgttccccatcagcatgagcgccaccgagttcctgctggccagcgtgatcttctgcctggtgttctgggtgatcagagccagcagaccccaggtgcccaagggcctgaagaacccccccggcccctggggctggcccctgatcggccacatgctgaccctgggcaagaacccccacctggccctgagcagaatgagccagcagtacggcgacgtgctgcagatcagaatcggcagcacccccgtggtggtgctgagcggcctggacaccatcagacaggccctggtgagacagggcgacgacttcaagggcagacccgacctgtacaccttcaccctgatcagcaacggccagagcatgagcttcagccccgacagcggccccgtgtgggccgccagaagaagactggcccagaacggcctgaagagcttcagcatcgccagcgaccccgccagcagcaccagctgctacctggaggagcacgtgagcaaggaggccgaggtgctgatcagcaccctgcaggagctgatggccggccccggccacttcaacccctacagatacgtggtggtgagcgtgaccaacgtgatctgcgccatctgcttcggcagaagatacgaccacaaccaccaggagctgctgagcctggtgaacctgaacgccttcaaggacctgaacgagaagttctacagcttcatgcagaagatggtgaaggagcactacaagaccttcgagaagggccacatcagagacatcaccgacagcctgatcgagcactgccaggagaagcagctggacgagaacgccaacgtgcagctgagcgacgagaagatcatcaacatcgtgctggacctgttcggcgccggcttcgacaccgtgaccaccgccatcagctggagcctgatgtacctggtgatgaaccccagagtgcagagaaagatccaggaggagctggacaccgtgatcggcagaagcagaagacccagactgagcgacagaagccacctgccctacatggaggccttcatcctggagaccttcagacacagcagcttcgtgcccttcaccatcccccacagcaccaccagagacaccagcctgaagggcttctacatccccaagggcagatgcgtgttcgtgaaccagtggcagatcaaccacgaccagaagctgtgggtgaaccccagcgagttcctgcccgagagattcctgacccccgacggcgccatcgacaaggtgctgagcgagaaggtgatcatcttcggcatgggcaagagaaagtgcatcggcgagaccatcgccagatgggaggtgttcctgttcctggccatcctgctgcagagagtggagttcagcgtgcccctgggcgtgaaggtggacatgacccccatctacggcctgaccatgaagcacgcctgctgcgagcacttccagatgcagctgagaagctag

SEQ ID NO: 78232 - DNA, 1539 bp, Artificial Sequence
  Description of Artificial Sequence: Synthetic coding sequence
atgctgttccccatcagcatgagcgccaccgagttcctgctggccagcgtgatcttctgcctggtgttctgggtgatcagagccagcagaccccaggtgcccaagggcctgaagaacccccccggcccctggggctggcccctgatcggccacatgctgaccctgggcaagaacccccacctggccctgagcagaatgagccagcagtacggcgacgtgctgcagatcagaatcggcagcacccccgtggtggtgctgagcggcctggacaccatcagacaggccctggtgagacagggcgacgacttcaagggcagacccgacctgtacaccttcaccctgatcagcaacggccagagcatgagcttcagccccgacagcggccccgtgtgggccgccagaagaagactggcccagaacggcctgaagagcttcagcatcgccagcgaccccgccagcagcaccagctgctacctggaggagcacgtgagcaaggaggccgaggtgctgatcagcaccctgcaggagctgatggccggccccggccacttcaacccctacagatacgtggtggtgagcgtgaccaacgtgatctgcgccatctgcttcggcagaagatacgaccacaaccaccaggagctgctgagcctggtgaacctgaacaacaacttcggcgaggtggtgggcagcggcaaccccgccgacttcatccccatcctgagatacctgcccaaccccagcctgaacgccttcaaggacctgaacgagaagttctacagcttcatgcagaagatggtgaaggagcactacaagaccttcgagaagggccacatcagagacatcaccgacagcctgatcgagcactgccaggagaagcagctggacgagaacgccaacgtgcagctgagcgacgagaagatcatcaacatcgtgctggacctgttcggcgccggcttcgacaccgtgaccaccgccatcagctggagcctgatgtacctggtgatgaaccccagagtgcagagaaagatccaggaggagctggacaccgtgatcggcagaagcagaagacccagactgagcgacagaagccacctgccctacatggaggccttcatcctggagaccttcagacacagcagcttcgtgcccttcaccatcccccacagcaccaccagagacaccagcctgaagggcttctacatccccaagggcagatgcgtgttcgtgaaccagtggcagatcaaccacgaccagaagctgtgggtgaaccccagcgagttcctgcccgagagattcctgacccccgacggcgccatcgacaaggtgctgagcgagaaggtgatcatcttcggcatgggcaagagaaagtgcatcggcgagaccatcgccagatgggaggtgttcctgttcctggccatcctgctgcagagagtggagttcagcgtgcccctgggcgtgaaggtggacatgacccccatctacggcctgaccatgaagcacgcctgctgcgagcacttccagatgcagctgagaagctag

SEQ ID NO: 78233 - DNA, 1539 bp, Artificial Sequence; identical to SEQ ID NO: 78232
  Description of Artificial Sequence: Synthetic coding sequence

SEQ ID NO: 78234 - DNA, 1452 bp, Artificial Sequence
  Description of Artificial Sequence: Synthetic coding sequence
atgctgttccccatcagcatgagcgccaccgagttcctgctggccagcgtgatcttctgcctggtgttctgggtgatcagagccagcagaccccaggtgcccaagggcctgaagaacccccccggcccctggggctggcccctgatcggccacatgctgaccctgggcaagaacccccacctggccctgagcagaatgagccagcagtacggcgacgtgctgcagatcagaatcggcagcacccccgtggtggtgctgagcggcctggacaccatcagacaggccctggtgagacagggcgacgacttcaagggcagacccgacctgtacaccttcaccctgatcagcaacggccagagcatgagcttcagccccgacagcggccccgtgtgggccgccagaagaagactggcccagaacggcctgaagagcttcagcatcgccagcgaccccgccagcagcaccagctgctacctggaggagcacgtgagcaaggaggccgaggtgctgatcagcaccctgcaggagctgatggccggccccggccacttcaacccctacagatacgtggtggtgagcgtgaccaacgtgatctgcgccatctgcttcggcagaagatacgaccacaaccaccaggagctgctgagcctggtgaacctgaacaacaacttcggcgaggtggtgggcagcggcaaccccgccgacttcatccccatcctgagatacctgcccaaccccagcctgaacgccttcaaggacctgaacgagaagttctacagcttcatgcagaagatggtgaaggagcactacaagaccttcgagaagggccacatcagagacatcaccgacagcctgatcgagcactgccaggagaagcagctggacgagaacgccaacgtgcagctgagcgacgagaagatcatcaacatcgtgctggacctgttcggcgccggcttcgacaccgtgaccaccgccatcagctggagcctgatgtacctggtgatgaaccccagagtgcagagaaagatccaggaggagctggacaccgtgatcggcagaagcagaagacccagactgagcgacagaagccacctgccctacatggaggccttcatcctggagaccttcagacacagcagcttcgtgcccttcaccatcccccacagaaagctgtgggtgaaccccagcgagttcctgcccgagagattcctgacccccgacggcgccatcgacaaggtgctgagcgagaaggtgatcatcttcggcatgggcaagagaaagtgcatcggcgagaccatcgccagatgggaggtgttcctgttcctggccatcctgctgcagagagtggagttcagcgtgcccctgggcgtgaaggtggacatgacccccatctacggcctgaccatgaagcacgcctgctgcgagcacttccagatgcagctgagaagctag

SEQ ID NO: 78235 - DNA, 1551 bp, Artificial Sequence
  Description of Artificial Sequence: Synthetic coding sequence
atggccctgagccagagcgtgcccttcagcgccaccgagctgctgctggccagcgccatcttctgcctggtgttctgggtgctgaagggcctgagacccagagtgcccaagggcctgaagagcccccccgagccctggggctggcccctgctgggccacgtgctgaccctgggcaagaacccccacctggccctgagcagaatgagccagagatacggcgacgtgctgcagatcagaatcggcagcacccccgtgctggtgctgagcagactggacaccatcagacaggccctggtgagacagggcgacgacttcaagggcagacccgacctgtacaccagcaccctgatcaccgacggccagagcctgaccttcagcaccgacagcggccccgtgtgggccgccagaagaagactggcccagaacgccctgaacaccttcagcatcgccagcgaccccgccagcagcagcagctgctacctggaggagcacgtgagcaaggaggccaaggccctgatcagcagactgcaggagctgatggccggccccggccacttcgacccctacaaccaggtggtggtgagcgtggccaacgtgatcggcgccatgtgcttcggccagcacttccccgagagcagcgacgagatgctgagcctggtgaagaacacccacgagttcgtggagaccgccagcagcggcaaccccctggacttcttccccatcctgagatacctgcccaaccccgccctgcagagattcaaggccttcaaccagagattcctgtggttcctgcagaagaccgtgcaggagcactaccaggacttcgacaagaacagcgtgagagacatcaccggcgccctgttcaagcacagcaagaagggccccagagccagcggcaacctgatcccccaggagaagatcgtgaacctggtgaacgacatcttcggcgccggcttcgacaccgtgaccaccgccatcagctggagcctgatgtacctggtgaccaagcccgagatccagagaaagatccagaaggagctggacaccgtgatcggcagagagagaagacccagactgagcgacagaccccagctgccctacctggaggccttcatcctggagaccttcagacacagcagcttcctgcccttcaccatcccccacagcaccaccagagacaccaccctgaacggcttctacatccccaagaagtgctgcgtgttcgtgaaccagtggcaggtgaaccacgaccccgagctgtgggaggaccccagcgagttcagacccgagagattcctgaccgccgacggcaccgccatcaacaagcccctgagcgagaagatgatgctgttcggcatgggcaagagaagatgcatcggcgaggtgctggccaagtgggagatcttcctgttcctggccatcctgctgcagcagctggagttcagcgtgccccccggcgtgaaggtggacctgacccccatctacggcctgaccatgaagcacgccagatgcgagcacgtgcaggccagactgagattcagcatcaactag

SEQ ID NO: 78236 - DNA, 1512 bp, Artificial Sequence
  Description of Artificial Sequence: Synthetic coding sequence
atggccctgagagccaaggccgaggtgtgcatggccgtgccctggctgagcctgcagagagcccaggccctgggcaccagagccgccagagtgcccagaaccgtgctgcccttcgaggccatgcccagaagacccggcaacagatggctgagactgctgcagatctggagagagcagggctacgaggacctgcacctggaggtgcaccagaccttccaggagctgggccccatcttcagatacgacctgggcggcgccggcatggtgtgcgtgatgctgcccgaggacgtggagaagctgcagcaggtggacagcctgcacccccacagaatgagcctggagccctgggtggcctacagacagcacagaggccacaagtgcggcgtgttcctgctgaacggccccgagtggagattcaacagactgagactgaaccccgaggtgctgagccccaacgccgtgcagagattcctgcccatggtggacgccgtggccagagacttcagccaggccctgaagaagaaggtgctgcagaacgccagaggcagcctgaccctggacgtgcagcccagcatcttccactacaccatcgaggccagcaacctggccctgttcggcgagagactgggcctggtgggccacagccccagcagcgccagcctgaacttcctgcacgccctggaggtgatgttcaagagcaccgtgcagctgatgttcatgcccagaagcctgagcagatggaccagccccaaggtgtggaaggagcacttcgaggcctgggactgcatcttccagtacggcgacaactgcatccagaagatctaccaggagctggccttcagcagaccccagcagtacaccagcatcgtggccgagctgctgctgaacgccgagctgagccccgacgccatcaaggccaacagcatggagctgaccgccggcagcgtggacaccaccgtgttccccctgctgatgaccctgttcgagctggccagaaaccccaacgtgcagcaggccctgagacaggagagcctggccgccgccgccagcatcagcgagcacccccagaaggccaccaccgagctgcccctgctgagagccgccctgaaggagaccctgagactgtaccccgtgggcctgttcctggagagagtggccagcagcgacctggtgctgcagaactaccacatccccgccggcaccctggtgagagtgttcctgtacagcctgggcagaaaccccgccctgttccccagacccgagagatacaacccccagagatggctggacatcagaggcagcggcagaaacttctaccacgtgcccttcggcttcggcatgagacagtgcctgggcagaagactggccgaggccgagatgctgctgctgctgcaccacgtgctgaagcacctgcaggtggagaccctgacccaggaggacatcaagatggtgtacagcttcatcctgagacccagcatgttccccctgctgaccttcagagccatcaactag

SEQ ID NO: 78237 - DNA, 1314 bp, Artificial Sequence
  Description of Artificial Sequence: Synthetic coding sequence
atggccctgagagccaaggccgaggtgtgcatggccgtgccctggctgagcctgcagagagcccaggccctgggcaccagagccgccagagtgcccagaaccgtgctgcccttcgaggccatgcccagaagacccggcaacagatggctgagactgctgcagatctggagagagcagggctacgaggacctgcacctggaggtgcaccagaccttccaggagctgggccccatcttcagatacgacctgggcggcgccggcatggtgtgcgtgatgctgcccgaggacgtggagaagctgcagcaggtggacagcctgcacccccacagaatgagcctggagccctgggtggcctacagacagcacagaggccacaagtgcggcgtgttcctgctgaacggccccgagtggagattcaacagactgagactgaaccccgaggtgctgagccccaacgccgtgcagagattcctgcccatggtggacgccgtggccagagacttcagccaggccctgaagaagaaggtgctgcagaacgccagaggcagcctgaccctggacgtgcagcccagcatcttccactacaccatcgaggccagcaacctggccctgttcggcgagagactgggcctggtgggccacagccccagcagcgccagcctgaacttcctgcacgccctggaggtgatgttcaagagcaccgtgcagctgatgttcatgcccagaagcctgagcagatggaccagccccaaggtgtggaaggagcacttcgaggcctgggactgcatcttccagtacggcgacaactgcatccagaagatctaccaggagctggccttcagcagaccccagcagtacaccagcatcgtggccgagctgctgctgaacgccgagctgagccccgacgccatcaaggccaacagcatggagctgaccgccggcagcgtggacaccaccgtgttccccctgctgatgaccctgttcgagctggccagaaaccccaacgtgcagcaggccctgagacaggagagcctggccgccgccgccagcatcagcgagcacccccagaaggccaccaccgagctgcccctgctgagagccgccctgaaggagaccctgagactgtaccccgtgggcctgttcctggagagagtggccagcagcgacctggtgctgcagaactaccacatccccgccggcgtgctgaagcacctgcaggtggagaccctgacccaggaggacatcaagatggtgtacagcttcatcctgagacccagcatgttccccctgctgaccttcagagccatcaactag

SEQ ID NO: 78238 - DNA, 1512 bp, Artificial Sequence
  Description of Artificial Sequence: Synthetic coding sequence
atggccctgagagccaaggccgaggtgtgcgtggccgccccctggctgagcctgcagagagccagagccctgggcaccagagccgccagagcccccagaaccgtgctgcccttcgaggccatgccccagcaccccggcaacagatggctgagactgctgcagatctggagagagcagggctacgagcacctgcacctggagatgcaccagaccttccaggagctgggccccatcttcagatacaacctgggcggccccagaatggtgtgcgtgatgctgcccgaggacgtggagaagctgcagcaggtggacagcctgcacccctgcagaatgatcctggagccctgggtggcctacagacagcacagaggccacaagtgcggcgtgttcctgctgaacggccccgagtggagattcaacagactgagactgaaccccgacgtgctgagccccaaggccgtgcagagattcctgcccatggtggacgccgtggccagagacttcagccaggccctgaagaagaaggtgctgcagaacgccagaggcagcctgaccctggacgtgcagcccagcatcttccactacaccatcgaggccagcaacctggccctgttcggcgagagactgggcctggtgggccacagccccagcagcgccagcctgaacttcctgcacgccctggaggtgatgttcaagagcaccgtgcagctgatgttcatgcccagaagcctgagcagatggatcagccccaaggtgtggaaggagcacttcgaggcctgggactgcatcttccagtacggcgacaactgcatccagaagatctaccaggagctggccttcaacagaccccagcactacaccggcatcgtggccgagctgctgctgaaggccgagctgagcctggaggccatcaaggccaacagcatggagctgaccgccggcagcgtggacaccaccgccttccccctgctgatgaccctgttcgagctggccagaaaccccgacgtgcagcagatcctgagacaggagagcctggccgccgccgccagcatcagcgagcacccccagaaggccaccaccgagctgcccctgctgagagccgccctgaaggagaccctgagactgtaccccgtgggcctgttcctggagagagtggtgagcagcgacctggtgctgcagaactaccacatccccgccggcaccctggtgcaggtgttcctgtacagcctgggcagaaacgccgccctgttccccagacccgagagatacaacccccagagatggctggacatcagaggcagcggcagaaacttccaccacgtgcccttcggcttcggcatgagacagtgcctgggcagaagactggccgaggccgagatgctgctgctgctgcaccacgtgctgaagcacttcctggtggagaccctgacccaggaggacatcaagatggtgtacagcttcatcctgagacccggcaccagccccctgctgaccttcagagccatcaactag

SEQ ID NO: 78239 - DNA, 1527 bp, Artificial Sequence
  Description of Artificial Sequence: Synthetic coding sequence
atgtgggagctggtggccctgctgctgctgaccctggcctacctgttctggcccaagagaagatgccccggcgccaagtaccccaagagcctgctgagcctgcccctggtgggcagcctgcccttcctgcccagacacggccacatgcacaacaacttcttcaagctgcagaagaagtacggccccatctacagcgtgagaatgggcaccaagaccaccgtgatcgtgggccaccaccagctggccaaggaggtgctgatcaagaagggcaaggacttcagcggcagaccccagatggccaccctggacatcgccagcaacaacagaaagggcatcgccttcgccgacagcggcgcccactggcagctgcacagaagactggccatggccaccttcgccctgttcaaggacggcgaccagaagctggagaagatcatctgccaggagatcagcaccctgtgcgacatgctggccacccacaacggccagagcatcgacatcagcttccccgtgttcgtggccgtgaccaacgtgatcagcctgatctgcttcaacaccagctacaagaacggcgaccccgagctgaacgtgatccagaactacaacgagggcatcatcgacaacctgagcaaggacagcctggtggacctggtgccctggctgaagatcttccccaacaagaccctggagaagctgaagagccacgtgaagatcagaaacgacctgctgaacaagatcctggagaactacaaggagaagttcagaagcgacagcatcaccaacatgctggacaccctgatgcaggccaagatgaacagcgacaacggcaacgccggccccgaccaggacagcgagctgctgagcgacaaccacatcctgaccaccatcggcgacatcttcggcgccggcgtggagaccaccaccagcgtggtgaagtggaccctggccttcctgctgcacaacccccaggtgaagaagaagctgtacgaggagatcgaccagaacgtgggcttcagcagaacccccaccatcagcgacagaaacagactgctgctgctggaggccaccatcagagaggtgctgagactgagacccgtggcccccatgctgatcccccacaaggccaacgtggacagcagcatcggcgagttcgccgtggacaagggcaccgaggtgatcatcaacctgtgggccctgcaccacaacgagaaggagtggcaccagcccgaccagttcatgcccgagagattcctgaaccccgccggcacccagctgatcagccccagcgtgagctacctgcccttcggcgccggccccagaagctgcatcggcgagatcctggccagacaggagctgttcctgatcatggcctggctgctgcagagattcgacctggaggtgcccgacgacggccagctgcccagcctggagggcatccccaaggtggtgttcctgatcgacagcttcaaggtgaagatcaaggtgagacaggcctggagagaggcccaggccgagggcagcacctag

SEQ ID NO: 78240 - DNA, 1512 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctggacagactggaggaggtgaccaacgagagcggctacgtggacgtgctgaccctgctgagaagagtgatgctggacaccagcaacaccctgttcctgagaatccccctggacgagagcgccatcgtggtgaagatccagggctacttcgacgcctggcaggccctgctgatcaagcccgacatcttcttcaagatcagctggctgtacaagaagtacgagaagagcgtgaaggacctgaaggacgccatcgaggtgctgatcgccgagaagagaagaagaatcagcaccgaggagaagctggaggagtgcatggacttcgccaccgagctgatcctggccgagaagagaggcgacctgaccagagagaacgtgaaccagtgcatcctggagatgctgatcgccgcccccgacaccatgagcgtgagcctgttcttcatgctgttcctgatcgccaagcaccccaacgtggaggaggccatcatcaaggagatccagaccgtgatcggcgagagagacatcaagatcgacgacatccagaagctgaaggtgatggagaacttcatctacgagagcatgagataccagcccgtggtggacctggtgatgagaaaggccctggaggacgacgtgatcgacggctaccccgtgaagaagggcaccaacatcatcctgaacatcggcagaatgcacagactggagttcttccccaagcccaacgagttcaccctggagaacttcgccaagaacgtgccctacagatacttccagcccttcggcttcggccccagaggctgcgccggcaagtacatcgccatggtgatgatgaaggccatcctggtgaccctgctgagaagattccacgtgaagaccctgcagggccagtgcgtggagagcatccagaagatccacgacctgagcctgcaccccgacgagaccaagaacatgctggagatgatcttcacccccagaaacagcgacagatgcctggagcactag

SEQ ID NO: 78241 - DNA, 1512 bp, Artificial Sequence; identical to SEQ ID NO: 78240
  Description of Artificial Sequence: Synthetic coding sequence

SEQ ID NO: 78242 - DNA, 1512 bp, Artificial Sequence; identical to SEQ ID NO: 78240
  Description of Artificial Sequence: Synthetic coding sequence

SEQ ID NO: 78243 - DNA, 501 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagtag

SEQ ID NO: 78244 - DNA, 657 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctggacagactggaggaggtgaccaacgagagcggctacgtggacgtgctgaccctgctgagaagagtgatgctggacaccagcaacaccctgttcctgagaatccccctggacggcaccgagatcttcaccctgaccagctag

SEQ ID NO: 78245 - DNA, 1080 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctggacagactggaggaggtgaccaacgagagcggctacgtggacgtgctgaccctgctgagaagagtgatgctggacaccagcaacaccctgttcctgagaatccccctggacgagagcgccatcgtggtgaagatccagggctacttcgacgcctggcaggccctgctgatcaagcccgacatcttcttcaagatcagctggctgtacaagaagtacgagaagagcgtgaaggacctgaaggacgccatcgaggtgctgatcgccgagaagagaagaagaatcagcaccgaggagaagctggaggagtgcatggacttcgccaccgagctgatcctggccgagaagagaggcgacctgaccagagagaacgtgaaccagtgcatcctggagatgctgatcgccgcccccgacaccatgagcgtgagcctgttcttcatgctgttcctgatcgccaagcaccccaacgtggaggaggccatcatcaaggagatccagaccgtgatcggcgagagagacatcaagatcgacgacatccagaagctgaagaagcacgacgccaagtag

SEQ ID NO: 78246 - DNA, 1059 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctggacagactggaggaggtgaccaacgagagcggctacgtggacgtgctgaccctgctgagaagagtgatgctggacaccagcaacaccctgttcctgagaatccccctggacgagagcgccatcgtggtgaagatccagggctacttcgacgcctggcaggccctgctgatcaagcccgacatcttcttcaagatcagctggctgtacaagaagtacgagaagagcgtgaaggacctgaaggacgccatcgaggtgctgatcgccgagaagagaagaagaatcagcaccgaggagaagctggaggagtgcatggacttcgccaccgagctgatcctggccgagaagagaggcgacctgaccagagagaacgtgaaccagtgcatcctggagatgctgatcgccgcccccgacaccatgagcgtgagcctgttcttcatgctgttcctgatcgccaagcaccccaacgtggaggaggccatcatcaaggagatccagaccgtgatcggcgagagagacatcaagatcgacgacatccagaagtag

SEQ ID NO: 78247 - DNA, 729 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctggacagactggaggaggtgaccaacgagagcggctacgtggacgtgctgaccctgctgagaagagtgatgctggacaccagcaacaccctgttcctgagaatccccctggacgagagcgccatcgtggtgaagatccagggctacttcgacgcctggcaggccctgctgatcaagcccgacatcttcttcaagatcagctggctgtacaagtag

SEQ ID NO: 78248 - DNA, 546 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctgctgctgttcacccccgccagcgtgaactag

SEQ ID NO: 78249 - DNA, 657 bp, Artificial Sequence; identical to SEQ ID NO: 78244
  Description of Artificial Sequence: Synthetic coding sequence

SEQ ID NO: 78250 - DNA, 1059 bp, Artificial Sequence; identical to SEQ ID NO: 78246
  Description of Artificial Sequence: Synthetic coding sequence

SEQ ID NO: 78251 - DNA, 852 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctggacagactggaggaggtgaccaacgagagcggctacgtggacgtgctgaccctgctgagaagagtgatgctggacaccagcaacaccctgttcctgagaatccccctggacgagagcgccatcgtggtgaagatccagggctacttcgacgcctggcaggccctgctgatcaagcccgacatcttcttcaagatcagctggctgtacaagaagtacgagaagagcgtgaaggacctgaaggacgccatcgaggtgctgatcgccgagaagagaagaagaatcagcaccgaggagaagctggaggagtgcatggacttcgccaccgagctgatctag

SEQ ID NO: 78252 - DNA, 498 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgcctag

SEQ ID NO: 78253 - DNA, 1512 bp, Artificial Sequence; identical to SEQ ID NO: 78240
  Description of Artificial Sequence: Synthetic coding sequence

SEQ ID NO: 78254 - DNA, 519 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggccctgagcggccccggcctggtgagaatggtgaccgtgtgcgccgagagcctgaagacccacctgtag

SEQ ID NO: 78255 - DNA, 735 bp, Artificial Sequence
  Description of Artificial Sequence: Synthetic coding sequence
atggtgctggagatgctgaaccccatccactacaacatcaccagcatcgtgcccgaggccatgcccgccgccaccatgcccgtgctgctgctgaccggcctgttcctgctggtgtggaactacgagggcaccagcagcatccccggccccggctactgcatgggcatcggccccctgatcagccacggcagattcctgtggatgggcatcggcagcgcctgcaactactacaacagagtgtacggcgagttcatgagagtgtggatcagcggcgaggagaccctgatcatcagcaagagcagcagcatgttccacatcatgaagcacaaccactacagcagcagattcggcagcaagctgggcctgcagtgcatcggcatgcacgagaagggcatcatcttcaacaacaaccccgagctgtggaagaccaccagacccttcttcatgaaggagagcgccatcgtggtgaagatccagggctacttcgacgcctggcaggccctgctgatcaagcccgacatcttcttcaagatcagctggctgtacaagaagtacgagaagagcgtgaaggacctgaaggacgccatcgaggtgctgatcgccgagaagagaagaagaatcagcaccgaggagaagctggaggagtgcatggacttcgccaccgagctgatcctggccgagaagagaggcgacctgaccagagagaacgtgaaccagtgcatcctggagatgtag

SEQ ID NO: 78256 - DNA, 1485 bp, Artificial Sequence
  Description of Artificial Sequence: Synthetic coding sequence
atgctggccagcggcctgctgctggtgaccctgctggcctgcctgaccgtgatggtgctgatgagcgtgtggagacagagaaagagcagaggcaagctgccccccggccccacccccctgcccttcatcggcaactacctgcagctgaacaccgagcagatgtacaacagcctgatgaagatcagcgagagatacggccccgtgttcaccatccacctgggccccagaagagtggtggtgctgtgcggccacgacgccgtgaaggaggccctggtggaccaggccgaggagttcagcggcagaggcgagcaggccaccttcgactggctgttcaagggctacggcgtggccttcagcaacggcgagagagccaagcagctgagaagattcagcatcgccaccctgagaggcttcggcgtgggcaagagaggcatcgaggagagaatccaggaggaggccggcttcctgatcgacgccctgagaggcacccacggcgccaacatcgaccccaccttcttcctgagcagaaccgtgagcaacgtgatcagcagcatcgtgttcggcgacagattcgactacgaggacaaggagttcctgagcctgctgagaatgatgctgggcagcttccagttcaccgccaccagcaccggccagctgtacgagatgttcagcagcgtgatgaagcacctgcccggcccccagcagcaggccttcaaggagctgcagggcctggaggacttcatcgccaagaaggtggagcacaaccagagaaccctggaccccaacagccccagagacttcatcgacagcttcctgatcagaatgcaggaggaggagaagaaccccaacaccgagttctacctgaagaacctggtgatgaccaccctgaacctgttcttcgccggcaccgagaccgtgagcaccaccctgagatacggcttcctgctgctgatgaagcaccccgaggtggaggccaaggtgcacgaggagatcgacagagtgatcggcaagaacagacagcccaagttcgaggacagagccaagatgccctacaccgaggccgtgatccacgagatccagagattcggcgacatgctgcccatgggcctggcccacagagtgaacaaggacaccaagttcagagacttcttcctgcccaagggcaccgaggtgttccccatgctgggcagcgtgctgagagaccccagattcttcagcaaccccagagacttcaacccccagcacttcctggacaagaagggccagttcaagaagagcgacgccttcgtgcccttcagcatcggcaagagatactgcttcggcgagggcctggccagaatggagctgttcctgttcttcaccaccatcatgcagaacttcagattcaagagcccccagagccccaaggacatcgacgtgagccccaagcacgtgggcttcgccaccatccccagaaactacaccatgagcttcctgcccagatag

SEQ ID NO: 78257 - DNA, 1485 bp, Artificial Sequence
  Description of Artificial Sequence: Synthetic coding sequence
atgctggccagcggcatgctgctggtggccctgctggtgtgcctgaccgtgatggtgctgatgagcgtgtggcagcagagaaagagcaagggcaagctgccccccggccccacccccctgcccttcatcggcaactacctgcagctgaacaccgagcagatgtacaacagcctgatgaagatcagcgagagatacggccccgtgttcaccatccacctgggccccagaagagtggtggtgctgtgcggccacgacgccgtgagagaggccctggtggaccaggccgaggagttcagcggcagaggcgagcaggccaccttcgactgggtgttcaagggctacggcgtggtgttcagcaacggcgagagagccaagcagctgagaagattcagcatcgccaccctgagagacttcggcgtgggcaagagaggcatcgaggagagaatccaggaggaggccggcttcctgatcgacgccctgagaggcaccggcggcgccaacatcgaccccaccttcttcctgagcagaaccgtgagcaacgtgatcagcagcatcgtgttcggcgacagattcgactacaaggacaaggagttcctgagcctgctgagaatgatgctgggcatcttccagttcaccagcaccagcaccggccagctgtacgagatgttcagcagcgtgatgaagcacctgcccggcccccagcagcaggccttccagctgctgcagggcctggaggacttcatcgccaagaaggtggagcacaaccagagaaccctggaccccaacagccccagagacttcatcgacagcttcctgatcagaatgcaggaggaggagaagaaccccaacaccgagttctacctgaagaacctggtgatgaccaccctgaacctgttcatcggcggcaccgagaccgtgagcaccaccctgagatacggcttcctgctgctgatgaagcaccccgaggtggaggccaaggtgcacgaggagatcgacagagtgatcggcaagaacagacagcccaagttcgaggacagagccaagatgccctacatggaggccgtgatccacgagatccagagattcggcgacgtgatccccatgagcctggccagaagagtgaagaaggacaccaagttcagagacttcttcctgcccaagggcaccgaggtgttccccatgctgggcagcgtgctgagagaccccagcttcttcagcaacccccaggacttcaacccccagcacttcctgaacgagaagggccagttcaagaagagcgacgccttcgtgcccttcagcatcggcaagagaaactgcttcggcgagggcctggccagaatggagctgttcctgttcttcaccaccgtgatgcagaacttcagactgaagagcagccagagccccaaggacatcgacgtgagccccaagcacgtgggcttcgccaccatccccagaaactacaccatgagcttcctgcccagatag

SEQ ID NO: 78258 - DNA, 1332 bp, Artificial Sequence
  Description of Artificial Sequence: Synthetic coding sequence
atgctggccagcggcctgctgctggtggccctgctggcctgcctgaccgtgatggtgctgatgagcgtgtggcagcagagaaagagcagaggcaagctgccccccggccccacccccctgcccttcatcggcaactacctgcagctgaacaccgagcacatctgcgacagcatcatgaaggtgagccagggcgtggccttcagcaacggcgagagagccaagcagctgctgagattcgccatcgccaccctgagagacttcggcgtgggcaagagaggcatcgaggagagaatccaggaggagagcggcttcctgatcgaggccatcagaagcacccacggcgccaacatcgaccccaccttcttcctgagcagaaccgtgagcaacgtgatcagcagcatcgtgttcggcgacagattcgactacgaggacaaggagttcctgagcctgctgagcatgatgctgggcatcttccagttcaccagcaccagcaccggccagctgtacgagatgttcagcagcgtgatgaagcacctgcccggcccccagcagcaggccttcaagctgctgcagggcctggaggacttcatcgccaagaaggtggagcacaaccagagaaccctggaccccaacagcccccaggacttcatcgacagcttcctgatccacatgcaggaggaggagaagaaccccaacaccgagttctacctgaagaacctgatgatgagcaccctgaacctgttcatcgccggcaccgagaccgtgagcaccaccctgagatacggcttcctgctgctgatgaagcaccccgaggtggaggccaaggtgcacgaggagatcgacagagtgatcggcaagaacagacagcccaagttcgaggacagaaccaagatgccctacatggaggccgtgatccacgagatccagagattcggcgacgtgatccccatgagcctggccagaagagtgaagaaggacaccaagttcagagacttcttcctgcccaagggcaccgaggtgttccccatgctgggcagcgtgctgagagaccccagcttcttcagcaacccccaggacttcaacccccagcacttcctggacgacaagggccagttcaagaagagcgacgccttcgtgcccttcagcatcggcaagagaaactgcttcggcgagggcctggccagaatggagctgttcctgttcttcaccaccgtgatgcagaacttcagactgaagagcagccagagccccaaggacatcgacgtgagccccaagcacgtggtgttcgccaccatccccagaaactacaccatgagcttcctgcccagatag

SEQ ID NO: 78259 - DNA, 1485 bp, Artificial Sequence
  Description of Artificial Sequence: Synthetic coding sequence
atgctggccagcggcctgctgctggtggccctgctggcctgcctgaccgtgatggtgctgatgagcgtgtggcagcagagaaagagcagaggcaagctgccccccggccccacccccctgcccttcatcggcaactacctgcagctgaacaccgagcacatctgcgacagcatcatgaagttcagcgagtgctacggccccgtgttcaccatccacctgggccccagaagagtggtggtgctgtgcggccacgacgccgtgagagaggccctggtggaccaggccgaggagttcagcggcagaggcgagcaggccaccttcgactgggtgttcaagggctacggcgtggccttcagcaacggcgagagagccaagcagctgctgagattcgccatcgccaccctgagagacttcggcgtgggcaagagaggcatcgaggagagaatccaggaggagagcggcttcctgatcgaggccatcagaagcacccacggcgccaacatcgaccccaccttcttcctgagcagaaccgtgagcaacgtgatcagcagcatcgtgttcggcgacagattcgactacgaggacaaggagttcctgagcctgctgagcatgatgctgggcatcttccagttcaccagcaccagcaccggccagctgtacgagatgttcagcagcgtgatgaagcacctgcccggcccccagcagcaggccttcaagctgctgcagggcctggaggacttcatcgccaagaaggtggagcacaaccagagaaccctggaccccaacagcccccaggacttcatcgacagcttcctgatccacatgcaggaggaggagaagaaccccaacaccgagttctacctgaagaacctgatgatgagcaccctgaacctgttcatcgccggcaccgagaccgtgagcaccaccctgagatacggcttcctgctgctgatgaagcaccccgaggtggaggccaaggtgcacgaggagatcgacagagtgatcggcaagaacagacagcccaagttcgaggacagaaccaagatgccctacatggaggccgtgatccacgagatccagagattcggcgacgtgatccccatgagcctggccagaagagtgaagaaggacaccaagttcagagacttcttcctgcccaagggcaccgaggtgttccccatgctgggcagcgtgctgagagaccccagcttcttcagcaacccccaggacttcaacccccagcacttcctggacgacaagggccagttcaagaagagcgacgccttcgtgcccttcagcatcggcaagagaaactgcttcggcgagggcctggccagaatggagctgttcctgttcttcaccaccgtgatgcagaacttcagactgaagagcagccagagccccaaggacatcgacgtgagccccaagcacgtggtgttcgccaccatccccagaaactacaccatgagcttcctgcccagatag

SEQ ID NO: 78260 - DNA, 1476 bp, Artificial Sequence
  Description of Artificial Sequence: Synthetic coding sequence
atggagctgagcgtgctgctgttcctggccctgctgaccggcctgctgctgctgctggtgcagagacaccccaacacccacgacagactgccccccggccccagacccctgcccctgctgggcaacctgctgcagatggacagaagaggcctgctgaagagcttcctgagattcagagagaagtacggcgacgtgttcaccgtgcacctgggccccagacccgtggtgatgctgtgcggcgtggaggccatcagagaggccctggtggacaaggccgaggccttcagcggcagaggcaagatcgccatggtggaccccttcttcagaggctacggcgtgatcttcgccaacggcaacagatggaaggtgctgagaagattcagcgtgaccaccatgagagacttcggcatgggcaagagaagcgtggaggagagaatccaggaggaggcccagtgcctgatcgaggagctgagaaagagcaagggcgccctgatggaccccaccttcctgttccagagcatcaccgccaacatcatctgcagcatcgtgttcggcaagagattccactaccaggaccaggagttcctgaagatgctgaacctgttctaccagaccttcagcctgatcagcagcgtgttcggccagctgttcgagctgttcagcggcttcctgaagtacttccccggcgcccacagacaggtgtacaagaacctgcaggagatcaacgcctacatcggccacagcgtggagaagcacagagagaccctggaccccagcgcccccaaggacctgatcgacacctacctgctgcacatggagaaggagaagagcaacgcccacagcgagttcagccaccagaacctgaacctgaacaccctgagcctgttcttcgccggcaccgagaccaccagcaccaccctgagatacggcttcctgctgatgctgaagtacccccacgtggccgagagagtgtacagagagatcgagcaggtgatcggcccccacagaccccccgagctgcacgacagagccaagatgccctacaccgaggccgtgatctacgagatccagagattcagcgacctgctgcccatgggcgtgccccacatcgtgacccagcacaccagcttcagaggctacatcatccccaaggacaccgaggtgttcctgatcctgagcaccgccctgcacgacccccactacttcgagaagcccgacgccttcaaccccgaccacttcctggacgccaacggcgccctgaagaagaccgaggccttcatccccttcagcctgggcaagagaatctgcctgggcgagggcatcgccagagccgagctgttcctgttcttcaccaccatcctgcagaacttcagcatggccagccccgtggcccccgaggacatcgacctgaccccccaggagtgcggcgtgggcaagatcccccccacctaccagatcagattcctgcccagatag

SEQ ID NO: 78261 - DNA, 876 bp, Artificial Sequence
  Description of Artificial Sequence: Synthetic coding sequence
atgagatgcatgctgaccaacagccacccctggtgcggctgcgactggcagttcagagagaagtacggcgacgtgttcaccgtgcacctgggccccagacccgtggtgatgctgtgcggcgtggaggccatcagagaggccctggtggacaaggccgaggccttcagcggcagaggcaagatcgccatggtggaccccttcttcagaggctacggcgtgatcttcgccaacggcaacagatggaaggtgctgagaagattcagcgtgaccaccatgagagacttcggcatgggcaagagaagcgtggaggagagaatccaggaggaggcccagtgcctgatcgaggagctgagaaagagcaaggagagagtgtacagagagatcgagcaggtgatcggcccccacagaccccccgagctgcacgacagagccaagatgccctacaccgaggccgtgatctacgagatccagagattcagcgacctgctgcccatgggcgtgccccacatcgtgacccagcacaccagcttcagaggctacatcatccccaaggacaccgaggtgttcctgatcctgagcaccgccctgcacgacccccactacttcgagaagcccgacgccttcaaccccgaccacttcctggacgccaacggcgccctgaagaagaccgaggccttcatccccttcagcctgggcaagagaatctgcctgggcgagggcatcgccagagccgagctgttcctgttcttcaccaccatcctgcagaacttcagcatggccagccccgtggcccccgaggacatcgacctgaccccccaggagtgcggcgtgggcaagatcccccccacctaccagatcagattcctgcccagatag

SEQ ID NO: 78262 - DNA, 1473 bp, Artificial Sequence
  Description of Artificial Sequence: Synthetic coding sequence
atggaccccttcgtggtgctggtgctgtgcctgagctgcctgctgctgctgagcatctggagacagagcagcggcagaggcaagctgccccccggccccacccccctgcccgtgatcggcaacatcctgcagatcgacatcaaggacgtgagcaagagcctgaccaacctgagcaagatctacggccccgtgttcaccctgtacttcggcctggagagaatggtggtgctgcacggctacgaggtggtgaaggaggccctgatcgacctgggcgaggagttcagcggcagaggccacttccccctggccgagagagccaacagaggcttcggcatcgtgttcagcaacggcaagagatggaaggagatcagaagattcagcctgatgaccctgagaaacttcggcatgggcaagagaagcatcgaggacagagtgcaggaggaggccagatgcctggtggaggagctgagaaagaccaaggccagcccctgcgaccccaccttcatcctgggctgcgccccctgcaacgtgatctgcagcatcatcttccagaagagattcgactacaaggaccagcagttcctgaacctgatggagaagctgaacgagaacatcagaatcgtgagcaccccctggatccagatctgcaacaacttccccaccatcatcgactacttccccggcacccacaacaagctgctgaagaacctggccttcatggagagcgacatcctggagaaggtgaaggagcaccaggagagcatggacatcaacaaccccagagacttcatcgactgcttcctgatcaagatggagaaggagaagcagaaccagcagagcgagttcaccatcgagaacctggtgatcaccgccgccgacctgctgggcgccggcaccgagaccaccagcaccaccctgagatacgccctgctgctgctgctgaagcaccccgaggtgaccgccaaggtgcaggaggagatcgagagagtggtgggcagaaacagaagcccctgcatgcaggacagaggccacatgccctacaccgacgccgtggtgcacgaggtgcagagatacatcgacctgatccccaccagcctgccccacgccgtgacctgcgacgtgaagttcagaaactacctgatccccaagggcaccaccatcctgaccagcctgaccagcgtgctgcacgacaacaaggagttccccaaccccgagatgttcgaccccagacacttcctggacgagggcggcaacttcaagaagagcaactacttcatgcccttcagcgccggcaagagaatctgcgtgggcgagggcctggccagaatggagctgttcctgttcctgaccttcatcctgcagaacttcaacctgaagagcctgatcgaccccaaggacctggacaccacccccgtggtgaacggcttcgccagcgtgccccccttctaccagctgtgcttcatccccgtgtag

SEQ ID NO: 78263 - DNA, 1473 bp, Artificial Sequence
  Description of Artificial Sequence: Synthetic coding sequence
atggagcccttcgtggtgctggtgctgtgcctgagcttcatgctgctgttcagcctgtggagacagagctgcagaagaagaaagctgccccccggccccacccccctgcccatcatcggcaacatgctgcagatcgacgtgaaggacatctgcaagagcttcaccaacttcagcaaggtgtacggccccgtgttcaccgtgtacttcggcatgaaccccatcgtggtgttccacggctacgaggccgtgaaggaggccctgatcgacaacggcgaggagttcagcggcagaggcaacagccccatcagccagagaatcaccaagggcctgggcatcatcagcagcaacggcaagagatggaaggagatcagaagattcagcctgaccaccctgagaaacttcggcatgggcaagagaagcatcgaggacagagtgcaggaggaggcccactgcctggtggaggagctgagaaagaccaaggccagcccctgcgaccccaccttcatcctgggctgcgccccctgcaacgtgatctgcagcgtggtgttccagaagagattcgactacaaggaccagaacttcctgaccctgatgaagagattcaacgagaacttcagaatcctgaacagcccctggatccaggtgtgcaacaacttccccctgctgatcgactgcttccccggcacccacaacaaggtgctgaagaacgtggccctgaccagaagctacatcagagagaaggtgaaggagcaccaggccagcctggacgtgaacaaccccagagacttcatcgactgcttcctgatcaagatggagcaggagaaggacaaccagaagagcgagttcaacatcgagaacctggtgggcaccgtggccgacctgttcgtggccggcaccgagaccaccagcaccaccctgagatacggcctgctgctgctgctgaagcaccccgaggtgaccgccaaggtgcaggaggagatcgaccacgtgatcggcagacacagaagcccctgcatgcaggacagaagccacatgccctacaccgacgccgtggtgcacgagatccagagatacagcgacctggtgcccaccggcgtgccccacgccgtgaccaccgacaccaagttcagaaactacctgatccccaagggcaccaccatcatggccctgctgaccagcgtgctgcacgacgacaaggagttccccaaccccaacatcttcgaccccggccacttcctggacaagaacggcaacttcaagaagagcgactacttcatgcccttcagcgccggcaagagaatctgcgccggcgagggcctggccagaatggagctgttcctgttcctgaccaccatcctgcagaacttcaacctgaagagcgtggacgacctgaagaacctgaacaccaccgccgtgaccaagggcatcgtgagcctgccccccagctaccagatctgcttcatccccgtgtag

SEQ ID NO: 78264 - DNA, 1374 bp, Artificial Sequence
  Description of Artificial Sequence: Synthetic coding sequence
atggagagaagcttcctggaggaggccatcccccagtacctgaaggagctgctgaaggacctggtgggcgcccacatcagcgtgagcgccctggtgaccggcgtgagaggcatggagaacagagccctgaagagcttcagcgccgagctgagcctgagcgcctggctgcccagcgtggccgccctgagcagcctggccgtgaacagccccagcttctgccccttcttcctgggcatcatcagcagcaacggcaagagatggaaggagatcagaagattcagcctgaccaccctgagaaacttcggcatgggcaagagaagcatcgaggacagagtgcaggaggaggcccactgcctggtggaggagctgagaaagaccaaggccagcccctgcgaccccaccttcatcctgggctgcgccccctgcaacgtgatctgcagcgtggtgttccagaagagattcgactacaaggaccagaacttcctgaccctgatgaagagattcaacgagaacttcagaatcctgaacagcccctggatccaggtgtgcaacaacttccccctgctgatcgactgcttccccggcacccacaacaaggtgctgaagaacgtggccctgaccagaagctacatcagagagaaggtgaaggagcaccaggccagcctggacgtgaacaaccccagagacttcatcgactgcttcctgatcaagatggagcaggagaaggacaaccagaagagcgagttcaacatcgagaacctggtgggcaccgtggccgacctgttcgtggccggcaccgagaccaccagcaccaccctgagatacggcctgctgctgctgctgaagcaccccgaggtgaccgccaaggtgcaggaggagatcgaccacgtgatcggcagacacagaagcccctgcatgcaggacagaagccacatgccctacaccgacgccgtggtgcacgagatccagagatacagcgacctggtgcccaccggcgtgccccacgccgtgaccaccgacaccaagttcagaaactacctgatccccaagggcaccaccatcatggccctgctgaccagcgtgctgcacgacgacaaggagttccccaaccccaacatcttcgaccccggccacttcctggacaagaacggcaacttcaagaagagcgactacttcatgcccttcagcgccggcaagagaatctgcgccggcgagggcctggccagaatggagctgttcctgttcctgaccaccatcctgcagaacttcaacctgaagagcgtggacgacctgaagaacctgaacaccaccgccgtgaccaagggcatcgtgagcctgccccccagctaccagatctgcttcatccccgtgtag

SEQ ID NO: 78265 - DNA, 1167 bp, Artificial Sequence
  Description of Artificial Sequence: Synthetic coding sequence
atgttcctgcagcccatcgccaagggcatcatcagcagcaacggcaagagatggaaggagatcagaagattcagcctgaccaccctgagaaacttcggcatgggcaagagaagcatcgaggacagagtgcaggaggaggcccactgcctggtggaggagctgagaaagaccaaggccagcccctgcgaccccaccttcatcctgggctgcgccccctgcaacgtgatctgcagcgtggtgttccagaagagattcgactacaaggaccagaacttcctgaccctgatgaagagattcaacgagaacttcagaatcctgaacagcccctggatccaggtgtgcaacaacttccccctgctgatcgactgcttccccggcacccacaacaaggtgctgaagaacgtggccctgaccagaagctacatcagagagaaggtgaaggagcaccaggccagcctggacgtgaacaaccccagagacttcatcgactgcttcctgatcaagatggagcaggagaaggacaaccagaagagcgagttcaacatcgagaacctggtgggcaccgtggccgacctgttcgtggccggcaccgagaccaccagcaccaccctgagatacggcctgctgctgctgctgaagcaccccgaggtgaccgccaaggtgcaggaggagatcgaccacgtgatcggcagacacagaagcccctgcatgcaggacagaagccacatgccctacaccgacgccgtggtgcacgagatccagagatacagcgacctggtgcccaccggcgtgccccacgccgtgaccaccgacaccaagttcagaaactacctgatccccaagggcaccaccatcatggccctgctgaccagcgtgctgcacgacgacaaggagttccccaaccccaacatcttcgaccccggccacttcctggacaagaacggcaacttcaagaagagcgactacttcatgcccttcagcgccggcaagagaatctgcgccggcgagggcctggccagaatggagctgttcctgttcctgaccaccatcctgcagaacttcaacctgaagagcgtggacgacctgaagaacctgaacaccaccgccgtgaccaagggcatcgtgagcctgccccccagctaccagatctgcttcatccccgtgtag

SEQ ID NO: 78266 - DNA, 924 bp, Artificial Sequence
  Description of Artificial Sequence: Synthetic coding sequence
atggccgccaagtgctgcagcaccttcttcctgggctgcgagttcagccagttcctgcccctgttcctgctgggcatcatcagcagcaacggcaagagatggaaggagatcagaagattcagcctgaccaccctgagaaacttcggcatgggcaagagaagcatcgaggacagagtgcaggaggaggcccactgcctggtggaggagctgagaaagaccaaggccagcccctgcgaccccaccttcatcctgggctgcgccccctgcaacgtgatctgcagcgtggtgttccagaagagattcgactacaaggaccagaacttcctgaccctgatgaagagattcaacgagaacttcagaatcctgaacagcccctggatccaggtgtgcaacaacttccccctgctgatcgactgcttccccggcacccacaacaaggtgctgaagaacgtggccctgaccagaagctacatcagagagaaggtgaaggagcaccaggccagcctggacgtgaacaaccccagagacttcatcgactgcttcctgatcaagatggagcaggagaaggacaaccagaagagcgagttcaacatcgagaacctggtgggcaccgtggccgacctgttcgtggccggcaccgagaccaccagcaccaccctgagatacggcctgctgctgctgctgaagcaccccgaggtgaccgccaaggtgcaggaggagatcgaccacgtgatcggcagacacagaagcccctgcatgcaggacagaagccacatgccctacaccgacgccgtggtgcacgagatccagagatacagcgacctggtgcccaccggcgtgccccacgccgtgaccaccgacaccaagttcagaaactacctgatccccaagagcttcgacaacaagatcatgctggccgcctag

SEQ ID NO: 78267 - DNA, 1473 bp, Artificial Sequence
  Description of Artificial Sequence: Synthetic coding sequence
atggacagcctggtggtgctggtgctgtgcctgagctgcctgctgctgctgagcctgtggagacagagcagcggcagaggcaagctgccccccggccccacccccctgcccgtgatcggcaacatcctgcagatcggcatcaaggacatcagcaagagcctgaccaacctgagcaaggtgtacggccccgtgttcaccctgtacttcggcctgaagcccatcgtggtgctgcacggctacgaggccgtgaaggaggccctgatcgacctgggcgaggagttcagcggcagaggcatcttccccctggccgagagagccaacagaggcttcggcatcgtgttcagcaacggcaagaagtggaaggagatcagaagattcagcctgatgaccctgagaaacttcggcatgggcaagagaagcatcgaggacagagtgcaggaggaggccagatgcctggtggaggagctgagaaagaccaaggccagcccctgcgaccccaccttcatcctgggctgcgccccctgcaacgtgatctgcagcatcatcttccacaagagattcgactacaaggaccagcagttcctgaacctgatggagaagctgaacgagaacatcaagatcctgagcagcccctggatccagatctgcaacaacttcagccccatcatcgactacttccccggcacccacaacaagctgctgaagaacgtggccttcatgaagagctacatcctggagaaggtgaaggagcaccaggagagcatggacatgaacaacccccaggacttcatcgactgcttcctgatgaagatggagaaggagaagcacaaccagcccagcgagttcaccatcgagagcctggagaacaccgccgtggacctgttcggcgccggcaccgagaccaccagcaccaccctgagatacgccctgctgctgctgctgaagcaccccgaggtgaccgccaaggtgcaggaggagatcgagagagtgatcggcagaaacagaagcccctgcatgcaggacagaagccacatgccctacaccgacgccgtggtgcacgaggtgcagagatacatcgacctgctgcccaccagcctgccccacgccgtgacctgcgacatcaagttcagaaactacctgatccccaagggcaccaccatcctgatcagcctgaccagcgtgctgcacgacaacaaggagttccccaaccccgagatgttcgacccccaccacttcctggacgagggcggcaacttcaagaagagcaagtacttcatgcccttcagcgccggcaagagaatctgcgtgggcgaggccctggccggcatggagctgttcctgttcctgaccagcatcctgcagaacttcaacctgaagagcctggtggaccccaagaacctggacaccacccccgtggtgaacggcttcgccagcgtgccccccttctaccagctgtgcttcatccccgtgtag

SEQ ID NO: 78268 - DNA, 1362 bp, Artificial Sequence
  Description of Artificial Sequence: Synthetic coding sequence
atggacagcctggtggtgctggtgctgtgcctgagctgcctgctgctgctgagcctgtggagacagagcagcggcagaggcaagctgccccccggccccacccccctgcccgtgatcggcaacatcctgcagatcggcatcaaggacatcagcaagagcctgaccaacctgagcaaggtgtacggccccgtgttcaccctgtacttcggcctgaagcccatcgtggtgctgcacggctacgaggccgtgaaggaggccctgatcgacctgggcgaggagttcagcggcagaggcatcttccccctggccgagagagccaacagaggcttcggcatcgtgttcagcaacggcaagaagtggaaggagatcagaagattcagcctgatgaccctgagaaacttcggcatgggcaagagaagcatcgaggacagagtgcaggaggaggccagatgcctggtggaggagctgagaaagaccaaggccagcccctgcgaccccaccttcatcctgggctgcgccccctgcaacgtgatctgcagcatcatcttccacaagagattcgactacaaggaccagcagttcctgaacctgatggagaagctgaacgagaacatcaagatcctgagcagcccctggatccagatctgcaacaacttcagccccatcatcgactacttccccggcacccacaacaagctgctgaagaacgtggccttcatgaagagctacatcctggagaaggtgaaggagcaccaggagagcatggacatgaacaacccccaggacttcatcgactgcttcctgatgaagatggagaaggagaagcacaaccagcccagcgagttcaccatcgagagcctggagaacaccgccgtggacctgttcggcgccggcaccgagaccaccagcaccaccctgagatacgccctgctgctgctgctgaagcaccccgaggtgaccgccaaggtgcaggaggagatcgagagagtgatcggcagaaacagaagcccctgcatgcaggacagaagccacatgccctacaccgacgccgtggtgcacgaggtgcagagatacatcgacctgctgcccaccagcctgccccacgccgtgacctgcgacatcaagttcagaaactacctgatccccaagggcaccaccatcctgatcagcctgaccagcgtgctgcacgacaacaaggagttccccaaccccgagatgttcgacccccaccacttcctggacgagggcggcaacttcaagaagagcaagtacttcatgctggtgctgaagatgatcagaaccgagagaaccaagagaaagagagtgggcaagctgttctgggtgagcgtgagagtgacctag

SEQ ID NO: 78269 - DNA, 1341 bp, Artificial Sequence
  Description of Artificial Sequence: Synthetic coding sequence
atgggcctggaggccctggtgcccctggccgtgatcgtggccatcttcctgctgctggtggacctgatgcacagaagacagagatgggccgccagatacccccccggccccctgcccctgcccggcctgggcaacctgctgcacgtggacttccagaacaccccctactgcttcgaccagctgagaagaagattcggcgacgtgttcagcctgcagctggcctggacccccgtggtggtgctgaacggcctggccgccgtgagagaggccctggtgacccacggcgaggacaccgccgacagaccccccgtgcccatcacccagatcctgggcttcggccccagaagccagggcagacccttcagacccaacggcctgctggacaaggccgtgagcaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccgagatggagaaggccaagggcaaccccgagagcagcttcaacgacgagaacctgtgcatcgtggtggccgacctgttcagcgccggcatggtgaccaccagcaccaccctggcctggggcctgctgctgatgatcctgcaccccgacgtgcagagaagagtgcagcaggagatcgacgacgtgatcggccaggtgagaagacccgagatgggcgaccaggcccacatgccctacaccaccgccgtgatccacgaggtgcagagattcggcgacatcgtgcccctgggcgtgacccacatgaccagcagagacatcgaggtgcagggcttcagaatccccaagggcaccaccctgatcaccaacctgagcagcgtgctgaaggacgaggccgtgtgggagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtgcccaccggccagcccagacccagccaccacggcgtgttcgccttcctggtgacccccagcccctacgagctgtgcgccgtgcccagatag

SEQ ID NO: 78270 - DNA, 1494 bp, Artificial Sequence
  Description of Artificial Sequence: Synthetic coding sequence
atgggcctggaggccctggtgcccctggccgtgatcgtggccatcttcctgctgctggtggacctgatgcacagaagacagagatgggccgccagatacccccccggccccctgcccctgcccggcctgggcaacctgctgcacgtggacttccagaacaccccctactgcttcgaccagctgagaagaagattcggcgacgtgttcagcctgcagctggcctggacccccgtggtggtgctgaacggcctggccgccgtgagagaggccctggtgacccacggcgaggacaccgccgacagaccccccgtgcccatcacccagatcctgggcttcggccccagaagccagggcgtgttcctggccagatacggccccgcctggagagagcagagaagattcagcgtgagcaccctgagaaacctgggcctgggcaagaagagcctggagcagtgggtgaccgaggaggccgcctgcctgtgcgccgccttcgccaaccacagcggcagacccttcagacccaacggcctgctggacaaggccgtgagcaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccgagatggagaaggccaagggcaaccccgagagcagcttcaacgacgagaacctgtgcatcgtggtggccgacctgttcagcgccggcatggtgaccaccagcaccaccctggcctggggcctgctgctgatgatcctgcaccccgacgtgcagagaagagtgcagcaggagatcgacgacgtgatcggccaggtgagaagacccgagatgggcgaccaggcccacatgccctacaccaccgccgtgatccacgaggtgcagagattcggcgacatcgtgcccctgggcgtgacccacatgaccagcagagacatcgaggtgcagggcttcagaatccccaagggcaccaccctgatcaccaacctgagcagcgtgctgaaggacgaggccgtgtgggagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtgcccaccggccagcccagacccagccaccacggcgtgttcgccttcctggtgacccccagcccctacgagctgtgcgccgtgcccagatag

SEQ ID NO: 78271 - DNA, 1494 bp, Artificial Sequence
  Description of Artificial Sequence: Synthetic coding sequence
atgggcctggaggccctggtgcccctggccgtgatcgtggccatcttcctgctgctggtggacctgatgcacagaagacagagatgggccgccagatacccccccggccccctgcccctgcccggcctgggcaacctgctgcacgtggacttccagaacaccccctactgcttcgaccagctgagaagaagattcggcgacgtgttcagcctgcagctggcctggacccccgtggtggtgctgaacggcctggccgccgtgagagaggccctggtgacccacggcgaggacaccgccgacagaccccccgtgcccatcacccagatcctgggcttcggccccagaggccagggcgtgttcctggccagatacggccccgcctggagagagcagagaagattcagcgtgagcaccctgagaaacctgggcctgggcaagaagagcctggagcagtgggtgaccgaggaggccgcctgcctgtgcgccgccttcgccaaccacagcggcagacccttcagacccaacggcctgctggacaaggccgtgagcaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccgagatggagaaggccaagggcaaccccgagagcagcttcaacgacgagaacctgtgcatcgtggtggccgacctgttcagcgccggcatggtgaccaccagcaccaccctggcctggggcctgctgctgatgatcctgcaccccgacgtgcagagaagagtgcagcaggagatcgacgacgtgatcggccaggtgagaagacccgagatgggcgaccaggcccacatgccctacaccaccgccgtgatccacgaggtgcagagattcggcgacatcgtgcccctgggcgtgacccacatgaccagcagagacatcgaggtgcagggcttcagaatccccaagggcaccaccctgatcaccaacctgagcagcgtgctgaaggacgaggccgtgtgggagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtgcccaccggccagcccagacccagccaccacggcgtgttcgccttcctggtgacccccagcccctacgagctgtgcgccgtgcccagatag

SEQ ID NO: 78272 - DNA, 1332 bp, Artificial Sequence
  Description of Artificial Sequence: Synthetic coding sequence
caggaggccctgaccctgcccctgcagctgagaagaagattcggcgacgtgttcagcctgcagctggcctggacccccgtggtggtgctgaacggcctggccgccgtgagagaggccctggtgacccacggcgaggacaccgccgacagaccccccgtgcccatcacccagatcctgggcttcggccccagaggccagggcgtgttcctggccagatacggccccgcctggagagagcagagaagattcagcgtgagcaccctgagaaacctgggcctgggcaagaagagcctggagcagtgggtgaccgaggaggccgcctgcctgtgcgccgccttcgccaaccacgacgcccccttcgcccccaccgtgagctggaccaagcccaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccgagatggagaaggccaagggcaaccccgagagcagcttcaacgacgagaacctgtgcatcgtggtggccgacctgttcagcgccggcatggtgaccaccagcaccaccctggcctggggcctgctgctgatgatcctgcaccccgacgtgcagagaagagtgcagcaggagatcgacgacgtgatcggccaggtgagaagacccgagatgggcgaccaggcccacatgccctacaccaccgccgtgatccacgaggtgcagagattcggcgacatcgtgcccctgggcgtgacccacatgaccagcagagacatcgaggtgcagggcttcagaatccccaagggcaccaccctgatcaccaacctgagcagcgtgctgaaggacgaggccgtgtgggagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtgcccaccggccagcccagacccagccaccacggcgtgttcgccttcctggtgacccccagcccctacgagctgtgcgccgtgcccagatag

SEQ ID NO: 78273 - DNA, 1341 bp, Artificial Sequence
  Description of Artificial Sequence: Synthetic coding sequence
atgggcctggaggccctggtgcccctggccatgatcgtggccatcttcctgctgctggtggacctgatgcacagaagacagagatgggccgccagatacccccccggccccctgcccctgcccggcctgggcaacctgctgcacgtggacttccagaacaccccctactgcttcgaccagctgagaagaagattcggcgacgtgttcagcctgcagctggcctggacccccgtggtggtgctgaacggcctggccgccgtgagagaggccctggtgacccacggcgaggacaccgccgacagaccccccgtgcccatcacccagatcctgggcttcggccccagaagccagggcagacccttcagacccaacggcctgctggacaaggccgtgagcaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccgagatggagaaggccaagggcaaccccgagagcagcttcaacgacgagaacctgtgcatcgtggtggccgacctgttcagcgccggcatggtgaccaccagcaccaccctggcctggggcctgctgctgatgatcctgcaccccgacgtgcagagaagagtgcagcaggagatcgacgacgtgatcggccaggtgagaagacccgagatgggcgaccaggcccacatgccctacaccaccgccgtgatccacgaggtgcagagattcggcgacatcgtgcccctgggcgtgacccacatgaccagcagagacatcgaggtgcagggcttcagaatccccaagggcaccaccctgatcaccaacctgagcagcgtgctgaaggacgaggccgtgtgggagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtgcccaccggccagcccagacccagccaccacggcgtgttcgccttcctggtgacccccagcccctacgagctgtgcgccgtgcccagatag

SEQ ID NO: 78274 - DNA, 1482 bp, Artificial Sequence
  Description of Artificial Sequence: Synthetic coding sequence
atgagcgccctgggcgtgaccgtggccctgctggtgtgggccgccttcctgctgctggtgagcatgtggagacaggtgcacagcagctggaacctgccccccggccccttccccctgcccatcatcggcaacctgttccagctggagctgaagaacatccccaagagcttcaccagactggcccagagattcggccccgtgttcaccctgtacgtgggcagccagagaatggtggtgatgcacggctacaaggccgtgaaggaggccctgctggactacaaggacgagttcagcggcagaggcgacctgcccgccttccacgcccacagagacagaggcatcatcttcaacaacggccccacctggaaggacatcagaagattcagcctgaccaccctgagaaactacggcatgggcaagcagggcaacgagagcagaatccagagagaggcccacttcctgctggaggccctgagaaagacccagggccagcccttcgaccccaccttcctgatcggctgcgccccctgcaacgtgatcgccgacatcctgttcagaaagcacttcgactacaacgacgagaagttcctgagactgatgtacctgttcaacgagaacttccacctgctgagcaccccctggctgcagctgtacaacaacttccccagcttcctgcactacctgcccggcagccacagaaaggtgatcaagaacgtggccgaggtgaaggagtacgtgagcgagagagtgaaggagcaccaccagagcctggaccccaactgccccagagacctgaccgactgcctgctggtggagatggagaaggagaagcacagcgccgagagactgtacaccatggacggcatcaccgtgaccgtggccgacctgttcttcgccggcaccgagaccaccagcaccaccctgagatacggcctgctgatcctgatgaagtaccccgagatcgaggagaagctgcacgaggagatcgacagagtgatcggccccagcagaatccccgccatcaaggacagacaggagatgccctacatggacgccgtggtgcacgagatccagagattcatcaccctggtgcccagcaacctgccccacgaggccaccagagacaccatcttcagaggctacctgatccccaagggcaccgtggtggtgcccaccctggacagcgtgctgtacgacaaccaggagttccccgaccccgagaagttcaagcccgagcacttcctgaacgagaacggcaagttcaagtacagcgactacttcaagcccttcagcaccggcaagagagtgtgcgccggcgagggcctggccagaatggagctgttcctgctgctgtgcgccatcctgcagcacttcaacctgaagcccctggtggaccccaaggacatcgacctgagccccatccacatcggcttcggctgcatcccccccagatacaagctgtgcgtgatccccagaagctag

SEQ ID NO: 78275 - DNA, 1482 bp, Artificial Sequence; identical to SEQ ID NO: 78274
  Description of Artificial Sequence: Synthetic coding sequence

SEQ ID NO: 78276 - DNA, 261 bp, Artificial Sequence
  Description of Artificial Sequence: Synthetic coding sequence
atgagcgccctgggcgtgaccgtggccctgctggtgtgggccgccttcctgctgctggtgagcatgtggagacaggtgcacagcagctggaacctgccccccggccccttccccctgcccatcatcggcaacctgttccagctggagctgaagaacatccccaagagcttcaccagactggcccagagattcggccccgtgttcaccctgtacgtgggcagccagagaatggtggtgatgcacggctacaaggccgtgtag

SEQ ID NO: 78277 - DNA, 1476 bp, Artificial Sequence
  Description of Artificial Sequence: Synthetic coding sequence
atggacagcatcagcaccgccatcctgctgctgctgctggccctggtgtgcctgctgctgaccctgagcagcagagacaagggcaagctgccccccggccccagacccctgagcatcctgggcaacctgctgctgctgtgcagccaggacatgctgaccagcctgaccaagctgagcaaggagtacggcagcatgtacaccgtgcacctgggccccagaagagtggtggtgctgagcggctaccaggccgtgaaggaggccctggtggaccagggcgaggagttcagcggcagaggcgactaccccgccttcttcaacttcaccaagggcaacggcatcgccttcagcagcggcgacagatggaaggtgctgagacagttcagcatccagatcctgagaaacttcggcatgggcaagagaagcatcgaggagagaatcctggaggagggcagcttcctgctggccgagctgagaaagaccgagggcgagcccttcgaccccaccttcgtgctgagcagaagcgtgagcaacatcatctgcagcgtgctgttcggcagcagattcgactacgacgacgagagactgctgaccatcatcagactgatcaacgacaacttccagatcatgagcagcccctggggcgagctgtacgacatcttccccagcctgctggactgggtgcccggcccccaccagagaatcttccagaacttcaagtgcctgagagacctgatcgcccacagcgtgcacgaccaccaggccagcctggaccccagaagccccagagacttcatccagtgcttcctgaccaagatggccgaggagaaggaggaccccctgagccacttccacatggacaccctgctgatgaccacccacaacctgctgttcggcggcaccaagaccgtgagcaccaccctgcaccacgccttcctggccctgatgaagtaccccaaggtgcaggccagagtgcaggaggagatcgacctggtggtgggcagagccagactgcccgccctgaaggacagagccgccatgccctacaccgacgccgtgatccacgaggtgcagagattcgccgacatcatccccatgaacctgccccacagagtgaccagagacaccgccttcagaggcttcctgatccccaagggcaccgacgtgatcaccctgctgaacaccgtgcactacgaccccagccagttcctgaccccccaggagttcaaccccgagcacttcctggacgccaaccagagcttcaagaagagccccgccttcatgcccttcagcgccggcagaagactgtgcctgggcgagagcctggccagaatggagctgttcctgtacctgaccgccatcctgcagagcttcagcctgcagcccctgggcgcccccgaggacatcgacctgacccccctgagcagcggcctgggcaacctgcccagacccttccagctgtgcctgagacccagatag

SEQ ID NO: 78278 - DNA, 1509 bp, Artificial Sequence
  Description of Artificial Sequence: Synthetic coding sequence
atgctggccgccatgggcagcctggccgccgccctgtgggccgtggtgcaccccagaaccctgctgctgggcaccgtggccttcctgctggccgccgacttcctgaagagaagaagacccaagaactacccccccggcccctggagactgcccttcctgggcaacttcttcctggtggacttcgagcagagccacctggaggtgcagctgttcgtgaagaagtacggcaacctgttcagcctggagctgggcgacatcagcgccgtgctgatcaccggcctgcccctgatcaaggaggccctgatccacatggaccagaacttcggcaacagacccgtgacccccatgagagagcacatcttcaagaagaacggcctgatcatgagcagcggccaggcctggaaggagcagagaagattcaccctgaccgccctgagaaacttcggcctgggcaagaagagcctggaggagagaatccaggaggaggcccagcacctgaccgaggccatcaaggaggagaacggccagcccttcgacccccacttcaagatcaacaacgccgtgagcaacatcatctgcagcatcaccttcggcgagagattcgagtaccaggacagctggttccagcagctgctgaagctgctggacgaggtgacctacctggaggccagcaagacctgccagctgtacaacgtgttcccctggatcatgaagttcctgcccggcccccaccagaccctgttcagcaactggaagaagctgaagctgttcgtgagccacatgatcgacaagcacagaaaggactggaaccccgccgagaccagagacttcatcgacgcctacctgaaggagatgagcaagcacaccggcaaccccaccagcagcttccacgaggagaacctgatctgcagcaccctggacctgttcttcgccggcaccgagaccaccagcaccaccctgagatgggccctgctgtacatggccctgtaccccgagatccaggagaaggtgcaggccgagatcgacagagtgatcggccagggccagcagcccagcaccgccgccagagagagcatgccctacaccaacgccgtgatccacgaggtgcagagaatgggcaacatcatccccctgaacgtgcccagagaggtgaccgtggacaccaccctggccggctaccacctgcccaagggcaccatgatcctgaccaacctgaccgccctgcacagagaccccaccgagtgggccacccccgacaccttcaaccccgaccacttcctggagaacggccagttcaagaagagagaggccttcatgcccttcagcatcggcaagagagcctgcctgggcgagcagctggccagaaccgagctgttcatcttcttcaccagcctgatgcagaagttcaccttcagaccccccaacaacgagaagctgagcctgaagttcagaatgggcatcaccatcagccccgtgagccacagactgtgcgccgtgccccaggtgtag

SEQ ID NO: 78279 - DNA, 1506 bp, Artificial Sequence
  Description of Artificial Sequence: Synthetic coding sequence
atgtggaagctgtggagagccgaggagggcgccgccgccctgggcggcgccctgttcctgctgctgttcgccctgggcgtgagacagctgctgaagcagagaagacccatgggcttcccccccggcccccccggcctgcccttcatcggcaacatctacagcctggccgccagcagcgagctgccccacgtgtacatgagaaagcagagccaggtgtacggcgagatcttcagcctggacctgggcggcatcagcaccgtggtgctgaacggctacgacgtggtgaaggagtgcctggtgcaccagagcgagatcttcgccgacagaccctgcctgcccctgttcatgaagatgaccaagatgggcggcctgctgaacagcagatacggcagaggctgggtggaccacagaagactggccgtgaacagcttcagatacttcggctacggccagaagagcttcgagagcaagatcctggaggagaccaagttcttcaacgacgccatcgagacctacaagggcagacccttcgacttcaagcagctgatcaccaacgccgtgagcaacatcaccaacctgatcatcttcggcgagagattcacctacgaggacaccgacttccagcacatgatcgagctgttcagcgagaacgtggagctggccgccagcgccagcgtgttcctgtacaacgccttcccctggatcggcatcctgcccttcggcaagcaccagcagctgttcagaaacgccgccgtggtgtacgacttcctgagcagactgatcgagaaggccagcgtgaacagaaagccccagctgccccagcacttcgtggacgcctacctggacgagatggaccagggcaagaacgaccccagcagcaccttcagcaaggagaacctgatcttcagcgtgggcgagctgatcatcgccggcaccgagaccaccaccaacgtgctgagatgggccatcctgttcatggccctgtaccccaacatccagggccaggtgcagaaggagatcgacctgatcatgggccccaacggcaagcccagctgggacgacaagtgcaagatgccctacaccgaggccgtgctgcacgaggtgctgagattctgcaacatcgtgcccctgggcatcttccacgccaccagcgaggacgccgtggtgagaggctacagcatccccaagggcaccaccgtgatcaccaacctgtacagcgtgcacttcgacgagaagtactggagagaccccgaggtgttccaccccgagagattcctggacagcagcggctacttcgccaagaaggaggccctggtgcccttcagcctgggcagaagacactgcctgggcgagcacctggccagaatggagatgttcctgttcttcaccgccctgctgcagagattccacctgcacttcccccacgagctggtgcccgacctgaagcccagactgggcatgaccctgcagccccagccctacctgatctgcgccgagagaagatag

SEQ ID NO: 78280 - DNA, 1695 bp, Artificial Sequence
  Description of Artificial Sequence: Synthetic coding sequence
atggaggccaccggcacctgggccctgctgctggccctggccctgctgctgctgctgaccctggccctgagcggcaccagagccagaggccacctgccccccggccccacccccctgcccctgctgggcaacctgctgcagctgagacccggcgccctgtacagcggcctgatgagactgagcaagaagtacggccccgtgttcaccatctacctgggcccctggagacccgtggtggtgctggtgggccaggaggccgtgagagaggccctgggcggccaggccgaggagttcagcggcagaggcaccgtggccatgctggagggcaccttcgacggccacggcgtgttcttcagcaacggcgagagatggagacagctgagaaagttcaccatgctggccctgagagacctgggcatgggcaagagagagggcgaggagctgatccaggccgaggccagatgcctggtggagaccttccagggcaccgagggcagacccttcgaccccagcctgctgctggcccaggccaccagcaacgtggtgtgcagcctgctgttcggcctgagattcagctacgaggacaaggagttccaggccgtggtgagagccgccggcggcaccctgctgggcgtgagcagccagggcggccagacctacgagatgttcagctggttcctgagacccctgcccggcccccacaagcagctgctgcaccacgtgagcaccctggccgccttcaccgtgagacaggtgcagcagcaccagggcaacctggacgccagcggccccgccagagacctggtggacgccttcctgctgaagatggcccaggaggagcagaaccccggcaccgagttcaccaacaagaacatgctgatgaccgtgatctacctgctgttcgccggcaccatgaccgtgagcaccaccgtgggctacaccctgctgctgctgatgaagtacccccacgtgcagaagtgggtgagagaggagctgaacagagagctgggcgccggccaggcccccagcctgggcgacagaaccagactgccctacaccgacgccgtgctgcacgaggcccagagactgctggccctggtgcccatgggcatccccagaaccctgatgagaaccaccagattcagaggctacaccctgccccagggcaccgaggtgttccccctgctgggcagcatcctgcacgaccccaacatcttcaagcaccccgaggagttcaaccccgacagattcctggacgccgacggcagattcagaaagcacgaggccttcctgcccttcagcctgggcaagagagtgtgcctgggcgagggcctggccaaggccgagctgttcctgttcttcaccaccatcctgcaggccttcagcctggagagcccctgcccccccgacaccctgagcctgaagcccaccgtgagcggcctgttcaacatcccccccgccagcaccgtgggcatggacagagtgaacgtgagcagagtgtacaccgccggcagccacatctacacccccgccgtggtgttcagaagcctgagccacggcccccacgcccacctgacccacgccgccaagatgcacaacagaacccccatccacaactacaagggccacaaggccaccgccggcctggccttccacagacacaagtacagccccagcgccatcaccagcacctag

SEQ ID NO: 78281 - DNA, 1515 bp, Artificial Sequence
  Description of Artificial Sequence: Synthetic coding sequence
atggaggccaccggcacctgggccctgctgctggccctggccctgctgctgctgctgaccctggccctgagcggcaccagagccagaggccacctgccccccggccccacccccctgcccctgctgggcaacctgctgcagctgagacccggcgccctgtacagcggcctgatgagactgagcaagaagtacggccccgtgttcaccatctacctgggcccctggagacccgtggtggtgctggtgggccaggaggccgtgagagaggccctgggcggccaggccgaggagttcagcggcagaggcaccgtggccatgctggagggcaccttcgacggccacggcgtgttcttcagcaacggcgagagatggagacagctgagaaagttcaccatgctggccctgagagacctgggcatgggcaagagagagggcgaggagctgatccaggccgaggccagatgcctggtggagaccttccagggcaccgagggcagacccttcgaccccagcctgctgctggcccaggccaccagcaacgtggtgtgcagcctgctgttcggcctgagattcagctacgaggacaaggagttccaggccgtggtgagagccgccggcggcaccctgctgggcgtgagcagccagggcggccagacctacgagatgttcagctggttcctgagacccctgcccggcccccacaagcagctgctgcaccacgtgagcaccctggccgccttcaccgtgagacaggtgcagcagcaccagggcaacctggacgccagcggccccgccagagacctggtggacgccttcctgctgaagatggcccaggaggagcagaaccccggcaccgagttcaccaacaagaacatgctgatgaccgtgatctacctgctgttcgccggcaccatgaccgtgagcaccaccgtgggctacaccctgctgctgctgatgaagtacccccacgtgcagaagtgggtgagagaggagctgaacagagagctgggcgccggccaggcccccagcctgggcgacagaaccagactgccctacaccgacgccgtgctgcacgaggcccagagactgctggccctggtgcccatgggcatccccagaaccctgatgagaaccaccagattcagaggctacaccctgccccagggcaccgaggtgttccccctgctgggcagcatcctgcacgaccccaacatcttcaagcaccccgaggagttcaaccccgacagattcctggacgccgacggcagattcagaaagcacgaggccttcctgcccttcagcctgggcaagagagtgtgcctgggcgagggcctggccaaggccgagctgttcctgttcttcaccaccatcctgcaggccttcagcctggagagcccctgcccccccgacaccctgagcctgaagcccaccgtgagcggcctgttcaacatcccccccgccttccagctgcaggtgagacccaccgacctgcacagcaccacccagaccagatag

SEQ ID NO: 78282 - DNA, 690 bp, Artificial Sequence
  Description of Artificial Sequence: Synthetic coding sequence
atggccatggaggagcagaaccccggcaccgagttcaccaacaagaacatgctgatgaccgtgatctacctgctgttcgccggcaccatgaccgtgagcaccaccgtgggctacaccctgctgctgctgatgaagtacccccacgtgcagaagtgggtgagagaggagctgaacagagagctgggcgccggccaggcccccagcctgggcgacagaaccagactgccctacaccgacgccgtgctgcacgaggcccagagactgctggccctggtgcccatgggcatccccagaaccctgatgagaaccaccagattcagaggctacaccctgccccagggcaccgaggtgttccccctgctgggcagcatcctgcacgaccccaacatcttcaagcaccccgaggagttcaaccccgacagattcctggacgccgacggcagattcagaaagcacgaggccttcctgcccttcagcctgggcaagagagtgtgcctgggcgagggcctggccaaggccgagctgttcctgttcttcaccaccatcctgcaggccttcagcctggagagcccctgcccccccgacaccctgagcctgaagcccaccgtgagcggcctgttcaacatcccccccgccttccagctgcaggtgagacccaccgacctgcacagcaccacccagaccagatag

SEQ ID NO: 78283 - DNA, 1635 bp, Artificial Sequence
  Description of Artificial Sequence: Synthetic coding sequence
atgagcagccccggccccagccagccccccgccgaggaccccccctggcccgccagactgctgagagcccccctgggcctgctgagactggaccccagcggcggcgccctgctgctgtgcggcctggtggccctgctgggctggagctggctgagaagaagaagagccagaggcatcccccccggccccaccccctggcccctggtgggcaacttcggccacgtgctgctgccccccttcctgagaagaagaagctggctgagcagcagaaccagagccgccggcatcgaccccagcgtgatcggcccccaggtgctgctggcccacctggccagagtgtacggcagcatcttcagcttcttcatcggccactacctggtggtggtgctgagcgacttccacagcgtgagagaggccctggtgcagcaggccgaggtgttcagcgacagacccagagtgcccctgatcagcatcgtgaccaaggagaagggcgtggtgttcgcccactacggccccgtgtggagacagcagagaaagttcagccacagcaccctgagacacttcggcctgggcaagctgagcctggagcccaagatcatcgaggagttcaagtacgtgaaggccgagatgcagaagcacggcgaggaccccttctgccccttcagcatcatcagcaacgccgtgagcaacatcatctgcagcctgtgcttcggccagagattcgactacaccaacagcgagttcaagaagatgctgggcttcatgagcagaggcctggagatctgcctgaacagccaggtgctgctggtgaacatctgcccctggctgtactacctgcccttcggccccttcaaggagctgagacagatcgagaaggacatcaccagcttcctgaagaagatcatcaaggaccaccaggagagcctggacagagagaacccccaggacttcatcgacatgtacctgctgcacatggaggaggagagaaagaacaacagcaacagcagcttcgacgaggagtacctgttctacatcatcggcgacctgttcatcgccggcaccgacaccaccaccaacagcctgctgtggtgcctgctgtacatgagcctgaaccccgacgtgcaggagaaggtgcacgaggagatcgagagagtgatcggcgccaacagagcccccagcctgaccgacaaggcccagatgccctacaccgaggccaccatcatggaggtgcagagactgaccgtggtggtgcccctggccatcccccacatgaccagcgagaacaccgtgctgcagggctacaccatccccaagggcaccctgatcctgcccaacctgtggagcgtgcacagagaccccgccatctgggagaagcccgaggacttctaccccaacagattcctggacgaccagggccagctgatcaagaaggagaccttcatccccttcggcatcggcaagagagtgtgcatgggcgagcagctggccaagatggagctgttcctgatgttcgtgagcctgatgcagagcttcgccttcgccctgcccgaggacagcaagaagcccctgctgaccggcagattcggcctgaccctggccccccaccccttcaacatcaccatcagcagaagatag

SEQ ID NO: 78284 - DNA, 1506 bp, Artificial Sequence
  Description of Artificial Sequence: Synthetic coding sequence
atgagcagccccggccccagccagccccccgccgaggaccccccctggcccgccagactgctgagagcccccctggtgggcaacttcggccacgtgctgctgccccccttcctgagaagaagaagctggctgagcagcagaaccagagccgccggcatcgaccccagcgtgatcggcccccaggtgctgctggcccacctggccagagtgtacggcagcatcttcagcttcttcatcggccactacctggtggtggtgctgagcgacttccacagcgtgagagaggccctggtgcagcaggccgaggtgttcagcgacagacccagagtgcccctgatcagcatcgtgaccaaggagaagggcgtggtgttcgcccactacggccccgtgtggagacagcagagaaagttcagccacagcaccctgagacacttcggcctgggcaagctgagcctggagcccaagatcatcgaggagttcaagtacgtgaaggccgagatgcagaagcacggcgaggaccccttctgccccttcagcatcatcagcaacgccgtgagcaacatcatctgcagcctgtgcttcggccagagattcgactacaccaacagcgagttcaagaagatgctgggcttcatgagcagaggcctggagatctgcctgaacagccaggtgctgctggtgaacatctgcccctggctgtactacctgcccttcggccccttcaaggagctgagacagatcgagaaggacatcaccagcttcctgaagaagatcatcaaggaccaccaggagagcctggacagagagaacccccaggacttcatcgacatgtacctgctgcacatggaggaggagagaaagaacaacagcaacagcagcttcgacgaggagtacctgttctacatcatcggcgacctgttcatcgccggcaccgacaccaccaccaacagcctgctgtggtgcctgctgtacatgagcctgaaccccgacgtgcaggagaaggtgcacgaggagatcgagagagtgatcggcgccaacagagcccccagcctgaccgacaaggcccagatgccctacaccgaggccaccatcatggaggtgcagagactgaccgtggtggtgcccctggccatcccccacatgaccagcgagaacaccgtgctgcagggctacaccatccccaagggcaccctgatcctgcccaacctgtggagcgtgcacagagaccccgccatctgggagaagcccgaggacttctaccccaacagattcctggacgaccagggccagctgatcaagaaggagaccttcatccccttcggcatcggcaagagagtgtgcatgggcgagcagctggccaagatggagctgttcctgatgttcgtgagcctgatgcagagcttcgccttcgccctgcccgaggacagcaagaagcccctgctgaccggcagattcggcctgaccctggccccccaccccttcaacatcaccatcagcagaagatag

SEQ ID NO: 78285 - DNA, 1398 bp, Artificial Sequence
  Description of Artificial Sequence: Synthetic coding sequence
atgctgctgctgggcctgctgctgctgctgcccctgctggccggcgccagactgctgtggaactggtggaagctgagaagcctgcacctgccccccctggcccccggcttcctgcacctgctgcagcccgacctgcccatctacctgctgggcctgacccagaagttcggccccatctacagactgcacctgggcctgcaggacaagctggtgagcagaaactaccccgacctgagcctgggcgactacagcctgctgtggaaggcccacaagaagctgaccagaagcgccctgctgctgggcatcagagacagcatggagcccgtggtggagcagctgacccaggagttctgcgagagaatgagagcccagcccggcacccccgtggccatcgaggaggagttcagcctgctgacctgcagcatcatctgctacctgaccttcggcgacaagatcaaggacgacaacctgatgcccgcctactacaagtgcatccaggaggtgctgaagacctggagccactggagcatccagatcgtggacgtgatccccttcctgagattcttccccaaccccggcctgagaagactgaagcaggccatcgagaagagagaccacatcgtggagatgcagctgagacagcacaaggagagcctggtggccggccagtggagagacatgatggactacatgctgcagggcgtggcccagcccagcatggaggagggcagcggccagctgctggagggccacgtgcacatggccgccgtggacctgctgatcggcggcaccgagaccaccgccaacaccctgagctgggccgtggtgttcctgctgcaccaccccgagatccagcagagactgcaggaggagctggaccacgagctgggccccggcgccagcagcagcagagtgccctacaaggacagagccagactgcccctgctgaacgccaccatcgccgaggtgctgagactgagacccgtggtgcccctggccctgccccacagaaccaccagacccagcagcatcagcggctacgacatccccgagggcaccgtgatcatccccaacctgcagggcgcccacctggacgagaccgtgtgggagagaccccacgagttctggcccgacagattcctggagcccggcaagaacagcagagccctggccttcggctgcggcgccagagtgtgcctgggcgagcccctggccagactggagctgttcgtggtgctgaccagactgctgcaggccttcaccctgctgcccagcggcgacgccctgcccagcctgcagcccctgccccactgcagcgtgatcctgaagatgcagcccttccaggtgagactgcagcccagaggcatgggcgcccacagccccggccagagccagtag

SEQ ID NO: 78286 - DNA, 1488 bp, Artificial Sequence
  Description of Artificial Sequence: Synthetic coding sequence
atgctgctgctgggcctgctgctgctgctgcccctgctggccggcgccagactgctgtggaactggtggaagctgagaagcctgcacctgccccccctggcccccggcttcctgcacctgctgcagcccgacctgcccatctacctgctgggcctgacccagaagttcggccccatctacagactgcacctgggcctgcaggacgtggtggtgctgaacagcaagagaaccatcgaggaggccatggtgaagaagtgggccgacttcgccggcagacccgagcccctgacctacaagctggtgagcagaaactaccccgacctgagcctgggcgactacagcctgctgtggaaggcccacaagaagctgaccagaagcgccctgctgctgggcatcagagacagcatggagcccgtggtggagcagctgacccaggagttctgcgagagaatgagagcccagcccggcacccccgtggccatcgaggaggagttcagcctgctgacctgcagcatcatctgctacctgaccttcggcgacaagatcaaggacgacaacctgatgcccgcctactacaagtgcatccaggaggtgctgaagacctggagccactggagcatccagatcgtggacgtgatccccttcctgagattcttccccaaccccggcctgagaagactgaagcaggccatcgagaagagagaccacatcgtggagatgcagctgagacagcacaaggagagcctggtggccggccagtggagagacatgatggactacatgctgcagggcgtggcccagcccagcatggaggagggcagcggccagctgctggagggccacgtgcacatggccgccgtggacctgctgatcggcggcaccgagaccaccgccaacaccctgagctgggccgtggtgttcctgctgcaccaccccgagatccagcagagactgcaggaggagctggaccacgagctgggccccggcgccagcagcagcagagtgccctacaaggacagagccagactgcccctgctgaacgccaccatcgccgaggtgctgagactgagacccgtggtgcccctggccctgccccacagaaccaccagacccagcagcatcagcggctacgacatccccgagggcaccgtgatcatccccaacctgcagggcgcccacctggacgagaccgtgtgggagagaccccacgagttctggcccgacagattcctggagcccggcaagaacagcagagccctggccttcggctgcggcgccagagtgtgcctgggcgagcccctggccagactggagctgttcgtggtgctgaccagactgctgcaggccttcaccctgctgcccagcggcgacgccctgcccagcctgcagcccctgccccactgcagcgtgatcctgaagatgcagcccttccaggtgagactgcagcccagaggcatgggcgcccacagccccggccagagccagtag

SEQ ID NO: 78287 - DNA, 1488 bp, Artificial Sequence; identical to SEQ ID NO: 78286
  Description of Artificial Sequence: Synthetic coding sequence

SEQ ID NO: 78288 - DNA, 1398 bp, Artificial Sequence; identical to SEQ ID NO: 78285
  Description of Artificial Sequence: Synthetic coding sequence

SEQ ID NO: 78289 - DNA, 1398 bp, Artificial Sequence; identical to SEQ ID NO: 78285
  Description of Artificial Sequence: Synthetic coding sequence

SEQ ID NO: 78290 - DNA, 1485 bp, Artificial Sequence
  Description of Artificial Sequence: Synthetic coding sequence
atgctgctgctgggcctgctgctgctgcccctgctggccggcgccagactgctgtggaactggtggaagctgagaagcctgcacctgccccccctggcccccggcttcctgcacctgctgcagcccgacctgcccatctacctgctgggcctgacccagaagttcggccccatctacagactgcacctgggcctgcaggacgtggtggtgctgaacagcaagagaaccatcgaggaggccatggtgaagaagtgggccgacttcgccggcagacccgagcccctgacctacaagctggtgagcaagaactaccccgacctgagcctgggcgactacagcctgctgtggaaggcccacaagaagctgaccagaagcgccctgctgctgggcatcagagacagcatggagcccgtggtggagcagctgacccaggagttctgcgagagaatgagagcccagcccggcacccccgtggccatcgaggaggagttcagcctgctgacctgcagcatcatctgctacctgaccttcggcgacaagatcaaggacgacaacctgatgcccgcctactacaagtgcatccaggaggtgctgaagacctggagccactggagcatccagatcgtggacgtgatccccttcctgagattcttccccaaccccggcctgagaagactgaagcaggccatcgagaagagagaccacatcgtggagatgcagctgagacagcacaaggagagcctggtggccggccagtggagagacatgatggactacatgctgcagggcgtggcccagcccagcatggaggagggcagcggccagctgctggagggccacgtgcacatggccgccgtggacctgctgatcggcggcaccgagaccaccgccaacaccctgagctgggccgtggtgttcctgctgcaccaccccgagatccagcagagactgcaggaggagctggaccacgagctgggccccggcgccagcagcagcagagtgccctacaaggacagagccagactgcccctgctgaacgccaccatcgccgaggtgctgagactgagacccgtggtgcccctggccctgccccacagaaccaccagacccagcagcatcagcggctacgacatccccgagggcaccgtgatcatccccaacctgcagggcgcccacctggacgagaccgtgtgggagagaccccacgagttctggcccgacagattcctggagcccggcaagaacagcagagccctggccttcggctgcggcgccagagtgtgcctgggcgagcccctggccagactggagctgttcgtggtgctgaccagactgctgcaggccttcaccctgctgcccagcggcgacgccctgcccagcctgcagcccctgccccactgcagcgtgatcctgaagatgcagcccttccaggtgagactgcagcccagaggcatgggcgcccacagccccggccagaaccagtag

SEQ ID NO: 78291 - DNA, 1485 bp, Artificial Sequence; identical to SEQ ID NO: 78290
  Description of Artificial Sequence: Synthetic coding sequence

SEQ ID NO: 78292 - DNA, 1488 bp, Artificial Sequence; identical to SEQ ID NO: 78286
  Description of Artificial Sequence: Synthetic coding sequence

SEQ ID NO: 78293 - DNA, 1395 bp, Artificial Sequence
  Description of Artificial Sequence: Synthetic coding sequence
atgctgctgctgggcctgctgctgctgcccctgctggccggcgccagactgctgtggaactggtggaagctgagaagcctgcacctgccccccctggcccccggcttcctgcacctgctgcagcccgacctgcccatctacctgctgggcctgacccagaagttcggccccatctacagactgcacctgggcctgcaggacaagctggtgagcaagaactaccccgacctgagcctgggcgactacagcctgctgtggaaggcccacaagaagctgaccagaagcgccctgctgctgggcatcagagacagcatggagcccgtggtggagcagctgacccaggagttctgcgagagaatgagagcccagcccggcacccccgtggccatcgaggaggagttcagcctgctgacctgcagcatcatctgctacctgaccttcggcgacaagatcaaggacgacaacctgatgcccgcctactacaagtgcatccaggaggtgctgaagacctggagccactggagcatccagatcgtggacgtgatccccttcctgagattcttccccaaccccggcctgagaagactgaagcaggccatcgagaagagagaccacatcgtggagatgcagctgagacagcacaaggagagcctggtggccggccagtggagagacatgatggactacatgctgcagggcgtggcccagcccagcatggaggagggcagcggccagctgctggagggccacgtgcacatggccgccgtggacctgctgatcggcggcaccgagaccaccgccaacaccctgagctgggccgtggtgttcctgctgcaccaccccgagatccagcagagactgcaggaggagctggaccacgagctgggccccggcgccagcagcagcagagtgccctacaaggacagagccagactgcccctgctgaacgccaccatcgccgaggtgctgagactgagacccgtggtgcccctggccctgccccacagaaccaccagacccagcagcatcagcggctacgacatccccgagggcaccgtgatcatccccaacctgcagggcgcccacctggacgagaccgtgtgggagagaccccacgagttctggcccgacagattcctggagcccggcaagaacagcagagccctggccttcggctgcggcgccagagtgtgcctgggcgagcccctggccagactggagctgttcgtggtgctgaccagactgctgcaggccttcaccctgctgcccagcggcgacgccctgcccagcctgcagcccctgccccactgcagcgtgatcctgaagatgcagcccttccaggtgagactgcagcccagaggcatgggcgcccacagccccggccagaaccagtag

SEQ ID NO: 78294 - DNA, 1398 bp, Artificial Sequence; identical to SEQ ID NO: 78285
  Description of Artificial Sequence: Synthetic coding sequence

SEQ ID NO: 78295 - DNA, 1395 bp, Artificial Sequence; identical to SEQ ID NO: 78293
  Description of Artificial Sequence: Synthetic coding sequence

SEQ ID NO: 78296 - DNA, 1488 bp, Artificial Sequence
  Description of Artificial Sequence: Synthetic coding sequence
atgctgctgctgggcctgctgctgctgctgcccctgctggccggcgccagactgctgtggaactggtggaagctgagaagcctgcacctgctgcccctggcccccggcttcctgcacctgctgcagcccgacctgcccatctacctgctgggcctgacccagaagttcggccccatctacagactgcacctgggcctgcaggacgtggtggtgctgaacagcaagagaaccatcgaggaggccatggtgaagaagtgggccgacttcgccggcagacccgagcccctgacctacaagctggtgagcaagaactaccccgacctgagcctgggcgactacagcctgctgtggaaggcccacaagaagctgaccagaagcgccctgctgctgggcatcagagacagcatggagcccgtggtggagcagctgacccaggagttctgcgagagaatgagagcccagcccggcacccccgtggccatcgaggaggagttcagcctgctgacctgcagcatcatctgctacctgaccttcggcgacaagatcaaggacgacaacctgatgcccgcctactacaagtgcatccaggaggtgctgaagacctggagccactggagcatccagatcgtggacgtgatccccttcctgagattcttccccaaccccggcctgagaagactgaagcaggccatcgagaagagagaccacatcgtggagatgcagctgagacagcacaaggagagcctggtggccggccagtggagagacatgatggactacatgctgcagggcgtggcccagcccagcatggaggagggcagcggccagctgctggagggccacgtgcacatggccgccgtggacctgctgatcggcggcaccgagaccaccgccaacaccctgagctgggccgtggtgttcctgctgcaccaccccgagatccagcagagactgcaggaggagctggaccacgagctgggccccggcgccagcagcagcagagtgccctacaaggacagagccagactgcccctgctgaacgccaccatcgccgaggtgctgagactgagacccgtggtgcccctggccctgccccacagaaccaccagacccagcagcatcagcggctacgacatccccgagggcaccgtgatcatccccaacctgcagggcgcccacctggacgagaccgtgtgggagagaccccacgagttctggcccgacagattcctggagcccggcaagaacagcagagccctggccttcggctgcggcgccagagtgtgcctgggcgagcccctggccagactggagctgttcgtggtgctgaccagactgctgcaggccttcaccctgctgcccagcggcgacgccctgcccagcctgcagcccctgccccactgcagcgtgatcctgaagatgcagcccttccaggtgagactgcagcccagaggcatgggcgcccacagccccggccagaaccagtag

SEQ ID NO: 78297 - DNA, 1488 bp, Artificial Sequence
  Description of Artificial Sequence: Synthetic coding sequence
atgctgctgctgggcctgctgctgctgctgcccctgctggccggcgccagactgctgtggaactggtggaagctgagaagcctgcacctgccccccctggcccccggcttcctgcacctgctgcagcccgacctgcccatctacctgctgggcctgacccagaagttcggccccatctacagactgcacctgggcctgcaggacgtggtggtgctgaacagcaagagaaccatcgaggaggccatggtgaagaagtgggccgacttcgccggcagacccgagcccctgacctacaagctggtgagcaagaactaccccgacctgagcctgggcgactacagcctgctgtggaaggcccacaagaagctgaccagaagcgccctgctgctgggcatcagagacagcatggagcccgtggtggagcagctgacccaggagttctgcgagagaatgagagcccagcccggcacccccgtggccatcgaggaggagttcagcctgctgacctgcagcatcatctgctacctgaccttcggcgacaagatcaaggacgacaacctgatgcccgcctactacaagtgcatccaggaggtgctgaagacctggagccactggagcatccagatcgtggacgtgatccccttcctgagattcttccccaaccccggcctgagaagactgaagcaggccatcgagaagagagaccacatcgtggagatgcagctgagacagcacaaggagagcctggtggccggccagtggagagacatgatggactacatgctgcagggcgtggcccagcccagcatggaggagggcagcggccagctgctggagggccacgtgcacatggccgccgtggacctgctgatcggcggcaccgagaccaccgccaacaccctgagctgggccgtggtgttcctgctgcaccaccccgagatccagcagagactgcaggaggagctggaccacgagctgggccccggcgccagcagcagcagagtgccctacaaggacagagccagactgcccctgctgaacgccaccatcgccgaggtgctgagactgagacccgtggtgcccctggccctgccccacagaaccaccagacccagcagcatcagcggctacgacatccccgagggcaccgtgatcatccccaacctgcagggcgcccacctggacgagaccgtgtgggagagaccccacgagttctggcccgacagattcctggagcccggcaagaacagcagagccctggccttcggctgcggcgccagagtgtgcctgggcgagcccctggccagactggagctgttcgtggtgctgaccagactgctgcaggccttcaccctgctgcccagcggcgacgccctgcccagcctgcagcccctgccccactgcagcgtgatcctgaagatgcagcccttccaggtgagactgcagcccagaggcatgggcgcccacagccccggccagaaccagtag

SEQ ID NO: 78298 - DNA, 1398 bp, Artificial Sequence
  Description of Artificial Sequence: Synthetic coding sequence
atgctgctgctgggcctgctgctgctgctgcccctgctggccggcgccagactgctgtggaactggtggaagctgagaagcctgcacctgctgcccctggcccccggcttcctgcacctgctgcagcccgacctgcccatctacctgctgggcctgacccagaagttcggccccatctacagactgcacctgggcctgcaggacaagctggtgagcaagaactaccccgacctgagcctgggcgactacagcctgctgtggaaggcccacaagaagctgaccagaagcgccctgctgctgggcatcagagacagcatggagcccgtggtggagcagctgacccaggagttctgcgagagaatgagagcccagcccggcacccccgtggccatcgaggaggagttcagcctgctgacctgcagcatcatctgctacctgaccttcggcgacaagatcaaggacgacaacctgatgcccgcctactacaagtgcatccaggaggtgctgaagacctggagccactggagcatccagatcgtggacgtgatccccttcctgagattcttccccaaccccggcctgagaagactgaagcaggccatcgagaagagagaccacatcgtggagatgcagctgagacagcacaaggagagcctggtggccggccagtggagagacatgatggactacatgctgcagggcgtggcccagcccagcatggaggagggcagcggccagctgctggagggccacgtgcacatggccgccgtggacctgctgatcggcggcaccgagaccaccgccaacaccctgagctgggccgtggtgttcctgctgcaccaccccgagatccagcagagactgcaggaggagctggaccacgagctgggccccggcgccagcagcagcagagtgccctacaaggacagagccagactgcccctgctgaacgccaccatcgccgaggtgctgagactgagacccgtggtgcccctggccctgccccacagaaccaccagacccagcagcatcagcggctacgacatccccgagggcaccgtgatcatccccaacctgcagggcgcccacctggacgagaccgtgtgggagagaccccacgagttctggcccgacagattcctggagcccggcaagaacagcagagccctggccttcggctgcggcgccagagtgtgcctgggcgagcccctggccagactggagctgttcgtggtgctgaccagactgctgcaggccttcaccctgctgcccagcggcgacgccctgcccagcctgcagcccctgccccactgcagcgtgatcctgaagatgcagcccttccaggtgagactgcagcccagaggcatgggcgcccacagccccggccagaaccagtag

SEQ ID NO: 78299 - DNA, 1704 bp, Artificial Sequence
  Description of Artificial Sequence: Synthetic coding sequence
atgcacggcagactgaaggtgaagaccagcgaggagcaggccgaggccaagagactggagagagagcagaagctgaagctgtaccagagcgccacccaggccgtgttccagaagagacaggccggcgagctggacgagagcgtgctggagctgaccagccagatcctgggcgccaaccccgacttcgccaccctgtggaactgcagaagagaggtgctgcagcagctggagacccagaagagccccgaggagctggccgccctggtgaaggccgagctgggcttcctggagagctgcctgagagtgaaccccaagagctacggcacctggcaccacagatgctggctgctgggcagactgcccgagcccaactggaccagagagctggagctgtgcgccagattcctggaggtggacgagagaaacttccactgctgggactacagaagattcgtggccacccaggccgccgtgccccccgccgaggagctggccttcaccgacagcctgatcaccagaaacttcagcaactacagcagctggcactacagaagctgcctgctgccccagctgcacccccagcccgacagcggcccccagggcagactgcccgaggacgtgctgctgaaggagctggagctggtgcagaacgccttcttcaccgaccccaacgaccagagcgcctggttctaccacagatggctgctgggcagagccgacccccaggacgccctgagatgcctgcacgtgagcagagacgaggcctgcctgaccgtgagcttcagcagacccctgctggtgggcagcagaatggagatcctgctgctgatggtggacgacagccccctgatcgtggagtggagaacccccgacggcagaaacagacccagccacgtgtggctgtgcgacctgcccgccgccagcctgaacgaccagctgccccagcacaccttcagagtgatctggaccgccggcgacgtgcagaaggagtgcgtgctgctgaagggcagacaggagggctggtgcagagacagcaccaccgacgagcagctgttcagatgcgagctgagcgtggagaagagcaccgtgctgcagagcgagctggagagctgcaaggagctgcaggagctggagcccgagaacaagtggtgcctgctgaccatcatcctgctgatgagagccctggaccccctgctgtacgagaaggagaccctgcagtacttccagaccctgaaggccgtggaccccatgagagccacctacctggacgacctgagaagcaagttcctgctggagaacagcgtgctgaagatggagtacgccgaggtgagagtgctgcacctggcccacaaggacctgaccgtgctgtgccacctggagcagctgctgctggtgacccacctggacctgagccacaacagactgagaaccctgccccccgccctggccgccctgagatgcctggaggtgctgcaggccagcgacaacgccatcgagagcctggacggcgtgaccaacctgcccagactgcaggagctgctgctgtgcaacaacagactgcagcagcccgccgtgctgcagcccctggccagctgccccagactggtgctgctgaacctgcagggcaaccccctgtgccaggccgtgggcatcctggagcagctggccgagctgctgcccagcgtgagcagcgtgctgacctag

SEQ ID NO: 78300 - DNA, 1347 bp, Artificial Sequence
  Description of Artificial Sequence: Synthetic coding sequence
atgagcagccccatcagcaagagcagaagcctggccgccttcctgcagcagctgagaagccccagacagccccccagactggtgaccagcaccgcctacaccagcccccagcccagagaggtgcccgtgtgccccctgaccgccggcggcgagacccagaacgccgccgccctgcccggccccaccagctggcccctgctgggcagcctgctgcagatcctgtggaagggcggcctgaagaagcagcacgacaccctggtggagtaccacaagaagtacggcaagatcttcagaatgaagctgggcagcttcgagagcgtgcacctgggcagcccctgcctgctggaggccctgtacagaaccgagagcgcctacccccagagactggagatcaagccctggaaggcctacagagactacagaaaggagggctacggcctgctgatcctggagggcgaggactggcagagagtgagaagcgccttccagaagaagctgatgaagcccggcgaggtgatgaagctggacaacaagatcaacgaggtgctggccgacttcatgggcagaatcgacgagctgtgcgacgagagaggccacgtggaggacctgtacagcgagctgaacaagtggagcttcgagagcatctgcctggtgctgtacgagaagagattcggcctgctgcagaagaacgccggcgacgaggccgtgaacttcatcatggccatcaagaccatgatgagcaccttcggcagaatgatggtgacccccgtggagctgcacaagagcctgaacaccaaggtgtggcaggaccacaccctggcctgggacaccatcttcaagagcgtgaaggcctgcatcgacaacagactggagaagtacagccagcagcccagcgccgacttcctgtgcgacatctaccaccagaacagactgagcaagaaggagctgtacgccgccgtgaccgagctgcagctggccgccgtggagaccaccgccaacagcctgatgtggatcctgtacaacctgagcagaaacccccaggtgcagcagaagctgctgaaggagatccagagcgtgctgcccgagaaccaggtgcccagagccgaggacctgagaaacatgccctacctgaaggcctgcctgaaggagagcatgagactgacccccagcgtgcccttcaccaccagaaccctggacaaggccaccgtgctgggcgagtacgccctgcccaagggcatcgtgagaaagtacgacatccaggccaccgacaacgagcccgtggagatgctgcacagcggcaccctggtgcccagcagagagctgcccatcgccttctgccagagatag

SEQ ID NO: 78301 - DNA, 1371 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcgacaacagaagcagccagagacacagcccccccttcagcaagaccctgcccagcaagcccagctggcccagcgagaaggccagactgaccagcaccctgcccgccctgaccgccctgcagaagccccaggtgccccccaagcccaagggcctgctggaggacgaggccgactacgtggtgcccgtggaggacaacgacgagaactacatccaccccaccgagagcagcagccccccccccgagaaggcccccatggtgaacagaagcaccaagcccaacagcagcacccccgccagcccccccggcaccgccagcggcagaaacagcggcgcctgggagaccaagagccccccccccgccgcccccagccccctgcccagagccggcaagaagcccaccacccccctgaagaccacccccgtggccagccagcagaacgccagcagcgtgtgcgaggagaagcccatccccgccgagagacacagaggcagcagccacagacaggaggccgtgcagagccccgtgttcccccccgcccagaagcagatccaccagaagcccatccccctgcccagattcaccgagggcggcaaccccaccgtggacggccccctgcccagcttcagcagcaacagcaccatcagcgagcaggaggccggcgtgctgtgcaagccctggtacgccggcgcctgcgacagaaagagcgccgaggaggccctgcacagaagcaacaaggacggcagcttcctgatcagaaagagcagcggccacgacagcaagcagccctacaccctggtggtgttcttcaacaagagagtgtacaacatccccgtgagattcatcgaggccaccaagcagtacgccctgggcagaaagaagaacggcgaggagtacttcggcagcgtggccgagatcatcagaaaccaccagcacagccccctggtgctgatcgacagccagaacaacaccaaggacagcaccagactgaagtacgccgtgaaggtgagctag

SEQ ID NO: 78302 - DNA, 1287 bp, Artificial Sequence
  Description of Artificial Sequence: Synthetic coding sequence
atgaagagaagaaagtacggcttcatctacaagacccacctgttcggcagacccaccgtgagagtgatgggcgccgacaacgtgagaagaatcctgctgggcgagcacagactggtgagcgtgcactggcccgccagcgtgagaaccatcctgggcagcggctgcctgagcaacctgcacgacagcagccacaagcagagaaagaaggtgatcatgagagccttcagcagagaggccctggagtgctacgtgcccgtgatcaccgaggaggtgggcagcagcctggagcagtggctgagctgcggcgagagaggcctgctggtgtaccccgaggtgaagagactgatgttcagaatcgccatgagaatcctgctgggctgcgagccccagctggccggcgacggcgacagcgagcagcagctggtggaggccttcgaggagatgaccagaaacctgttcagcctgcccatcgacgtgcccttcagcggcctgtacagaggcatgaaggccagaaacctgatccacgccagaatcgagcagaacatcagagccaagatctgcggcctgagagccagcgaggccggccagggctgcaaggacgccctgcagctgctgatcgagcacagctgggagagaggcgagagactggacatgcaggccctgaagcagagcagcaccgagctgctgttcggcggccacgagaccaccgccagcgccgccaccagcctgatcacctacctgggcctgtacccccacgtgctgcagaaggtgagagaggagctgaagagcaagggcctgctgtgcaagagcaaccaggacaacaagctggacatggagatcctggagcagctgaagtacatcggctgcgtgatcaaggagaccctgagactgaacccccccgtgcccggcggcttcagagtggccctgaagaccttcgagctgaacggctaccagatccccaagggctggaacgtgatctacagcatctgcgacacccacgacgtggccgagatcttcaccaacaaggaggagttcaaccccgacagattcatgctgccccaccccgaggacgccagcagattcagcttcatccccttcggcggcggcctgagaagctgcgtgggcaaggagttcgccaagatcctgctgaagatcttcaccgtggagctggccagacactgcgactggcagctgctgaacggcccccccaccatgaagaccagccccaccgtgtaccccgtggacaacctgcccgccagattcacccacttccacggcgagatctag

SEQ ID NO: 78303 - DNA, 1287 bp, Artificial Sequence; identical to SEQ ID NO: 78302
  Description of Artificial Sequence: Synthetic coding sequence

SEQ ID NO: 78304 - DNA, 1569 bp, Artificial Sequence
  Description of Artificial Sequence: Synthetic coding sequence
atgttcccctggggcctgagctgcctgagcgtgctgggcgccgccggcaccgccctgctgtgcgccggcctgctgctgagcctggcccagcacctgtggaccctgagatggatgctgagcagagacagagccagcaccctgcccctgcccaagggcagcatgggctggcccttcttcggcgagaccctgcactggctggtgcagggcagcagattccacagcagcagaagagagagatacggcaccgtgttcaagacccacctgctgggcagacccgtgatcagagtgagcggcgccgagaacgtgagaaccatcctgctgggcgagcacagactggtgagaagccagtggccccagagcgcccacatcctgctgggcagccacaccctgctgggcgccgtgggcgagccccacagaagaagaagaaaggtgctggccagagtgttcagcagagccgccctggagagatacgtgcccagactgcagggcgccctgagacacgaggtgagaagctggtgcgccgccggcggccccgtgagcgtgtacgacgccagcaaggccctgaccttcagaatggccgccagaatcctgctgggcctgagactggacgaggcccagtgcgccaccctggccagaaccttcgagcagctggtggagaacctgttcagcctgcccctggacgtgcccttcagcggcctgagaaagggcatcagagccagagaccagctgcacagacacctggagggcgccatcagcgagaagctgcacgaggacaaggccgccgagcccggcgacgccctggacctgatcatccacagcgccagagagctgggccacgagcccagcatgcaggagctgaaggagagcgccgtggagctgctgttcgccgccttcttcaccaccgccagcgccagcaccagcctggtgctgctgctgctgcagcaccccgccgccatcgccaagatcagagaggagctggtggcccagggcctgggcagagcctgcggctgcgcccccggcgccgccggcggcagcgagggccccccccccgactgcggctgcgagcccgacctgagcctggccgccctgggcagactgagatacgtggactgcgtggtgaaggaggtgctgagactgctgccccccgtgagcggcggctacagaaccgccctgagaaccttcgagctggacggctaccagatccccaagggctggagcgtgatgtacagcatcagagacacccacgagaccgccgccgtgtacagaagcccccccgagggcttcgaccccgagagattcggcgccgccagagaggacagcagaggcgccagcagcagattccactacatccccttcggcggcggcgccagaagctgcctgggccaggagctggcccaggccgtgctgcagctgctggccgtggagctggtgagaaccgccagatgggagctggccacccccgccttccccgccatgcagaccgtgcccatcgtgcaccccgtggacggcctgagactgttcttccaccccctgacccccagcgtggccggcaacggcctgtgcctgtag

SEQ ID NO: 78305 - DNA, 1596 bp, Artificial Sequence
  Description of Artificial Sequence: Synthetic coding sequence
atggccgccctgggctgcgccagactgagatgggccctgagaggcgccggcagaggcctgtgcccccacggcgccagagccaaggccgccatccccgccgccctgcccagcgacaaggccaccggcgcccccggcgccggccccggcgtgagaagaagacagagaagcctggaggagatccccagactgggccagctgagattcttcttccagctgttcgtgcagggctacgccctgcagctgcaccagctgcaggtgctgtacaaggccaagtacggccccatgtggatgagctacctgggcccccagatgcacgtgaacctggccagcgcccccctgctggagcaggtgatgagacaggagggcaagtaccccgtgagaaacgacatggagctgtggaaggagcacagagaccagcacgacctgacctacggccccttcaccaccgagggccaccactggtaccagctgagacaggccctgaaccagagactgctgaagcccgccgaggccgccctgtacaccgacgccttcaacgaggtgatcgacgacttcatgaccagactggaccagctgagagccgagagcgccagcggcaaccaggtgagcgacatggcccagctgttctactacttcgccctggaggccatctgctacatcctgttcgagaagagaatcggctgcctgcagagaagcatccccgaggacaccgtgaccttcgtgagaagcatcggcctgatgttccagaacagcctgtacgccaccttcctgcccaagtggaccagacccgtgctgcccttctggaagagatacctggacggctggaacgccatcttcagcttcggcaagaagctgatcgacgagaagctggaggacatggaggcccagctgcaggccgccggccccgacggcatccaggtgagcggctacctgcacttcctgctggccagcggccagctgagccccagagaggccatgggcagcctgcccgagctgctgatggccggcgtggacaccaccagcaacaccctgacctgggccctgtaccacctgagcaaggaccccgagatccaggaggccctgcacgaggaggtggtgggcgtggtgcccgccggccaggtgccccagcacaaggacttcgcccacatgcccctgctgaaggccgtgctgaaggagaccctgagactgtaccccgtggtgcccaccaacagcagaatcatcgagaaggagatcgaggtggacggcttcctgttccccaagaacacccagttcgtgttctgccactacgtggtgagcagagaccccaccgccttcagcgagcccgagagcttccagccccacagatggctgagaaacagccagcccgccacccccagaatccagcaccccttcggcagcgtgcccttcggctacggcgtgagagcctgcctgggcagaagaatcgccgagctggagatgcagctgctgctggccagactgatccagaagtacaaggtggtgctggcccccgagaccggcgagctgaagagcgtggccagaatcgtgctggtgcccaacaagaaggtgggcctgcagttcctgcagagacagtgctag

SEQ ID NO: 78306 - DNA, 1572 bp, Artificial Sequence
  Description of Artificial Sequence: Synthetic coding sequence
atgagcttccacaaggaggacggcgtgaacagcctgtgccagaaggccctgcacatcgtgaccgagctgtgcttcgccggccaggtggagtgggagaagtgcagcggcatcttccccagagacagaggcagccagggcggcagcagcaccgacatcagcgtgagcctgctggccgtggtggtgagcttctgcggcctggccctgctggtggtgagcctgttcgtgttctggaagctgtgctggccctgctggaagagcaagcccgtgaccagcaacatcaccaccctgccccagagcatcagcagcgcccccaccgaggtgttcgagaccgaggagaagaaggagatcaaggagaacgagaagcccgccgtgaaggccatcgagcccgccatcaagatcagccacaccagccccgacatccccgccgaggtgcagaccgccctgaaggagcacctgatcaagcacgccagagtgcagagacagatcaccgagcccaccagcagcaccagacacagcagcttcagaagacacctgcccagacagatgcaggtgagcagcgtggacttcagcatgggcaccgagcccgtgctgcagagaggcgagaccaccaccagcatcggcagaatcaagcccgagctgtacaagcagaagagcgtggacagcgagggcaaccagaacgaggacgtgaagatctgcggcaagctgaacttcaccctgcagtacgactacgagaacgagctgctggtggtgaagatcatcaaggccctggacctgcccgccaaggacttcaccggcaccagcgacccctacgtgaagatgtacctgctgcccgacagaaagaagaagttccagaccagagtgcacagaaagaccctgaaccccctgttcgacgagaccttccagttccccgtggcctacgaccagctgagcaacagaaagctgcacttcagcgtgtacgacttcgacagattcagcagacacgacatgatcggcgaggtgatcctggacaacctgttcgaggtgagcgacctgagcagagaggccaccgtgtggaaggacatccactgcgccaccaccgagagcatcgacctgggcgagatcatgttcagcctgtgctacctgcccaccgccggcagaatgaccctgaccgtgatcaagtgcagaaacctgaaggccatggacatcaccggcagcagcgacccctacgtgaaggtgagcctgatgtgcgagggcagaagactgaagaagagaaagaccaccaccaagaagaacaccctgaaccccgtgtacaacgaggccatcatcttcgacatcccccccgagaacgtggaccaggtgagcctgagcatcgccgtgatggactacgacagagtgggccacaacgaggtgatcggcgtgtgcagaaccggcctggacgccgagggcctgggcagagaccactggaacgagatgctggcctaccacagaaagcccatcacccactggcaccccctgctggagctgcccggcagagccaccagcttcgacagccagggcagctgccccagccccaagccccccagcaccccctag

SEQ ID NO: 78307 - DNA, 1512 bp, Artificial Sequence
  Description of Artificial Sequence: Synthetic coding sequence
atggccctgatccccgacctggccatggagacctggctgctgctggccgtgagcctggtgctgctgtacctgtacggcacccacagccacggcctgttcaagaagctgggcatccccggccccacccccctgcccttcctgggcaacatcctgagctaccacaagggcttctgcatgttcgacatggagtgccacaagaagtacggcaaggtgtggggcttctacgacggccagcagcccgtgctggccatcaccgaccccgacatgatcaagaccgtgctggtgaaggagtgctacagcgtgttcaccaacagaagacccttcggccccgtgggcttcatgaagagcgccatcagcatcgccgaggacgaggagtggaagagactgagaagcctgctgagccccaccttcaccagcggcaagctgaaggagatggtgcccatcatcgcccagtacggcgacgtgctggtgagaaacctgagaagagaggccgagaccggcaagcccgtgaccctgaaggacgtgttcggcgcctacagcatggacgtgatcaccagcaccagcttcggcgtgaacatcgacagcctgaacaacccccaggaccccttcgtggagaacaccaagaagctgctgagattcgacttcctggaccccttcttcctgagcatcaccgtgttccccttcctgatccccatcctggaggtgctgaacatctgcgtgttccccagagaggtgaccaacttcctgagaaagagcgtgaagagaatgaaggagagcagactggaggacacccagaagcacagagtggacttcctgcagctgatgatcgacagccagaacagcaaggagaccgagagccacaaggccctgagcgacctggagctggtggcccagagcatcatcttcatcttcgccggctacgagaccaccagcagcgtgctgagcttcatcatgtacgagctggccacccaccccgacgtgcagcagaagctgcaggaggagatcgacgccgtgctgcccaacaaggccccccccacctacgacaccgtgctgcagatggagtacctggacatggtggtgaacgagaccctgagactgttccccatcgccatgagactggagagagtgtgcaagaaggacgtggagatcaacggcatgttcatccccaagggcgtggtggtgatgatccccagctacgccctgcacagagaccccaagtactggaccgagcccgagaagttcctgcccgagagattcagcaagaagaacaaggacaacatcgacccctacatctacacccccttcggcagcggccccagaaactgcatcggcatgagattcgccctgatgaacatgaagctggccctgatcagagtgctgcagaacttcagcttcaagccctgcaaggagacccagatccccctgaagctgagcctgggcggcctgctgcagcccgagaagcccgtggtgctgaaggtggagagcagagacggcaccgtgagcggcgcctag

SEQ ID NO: 78308 - DNA, 1062 bp, Artificial Sequence
  Description of Artificial Sequence: Synthetic coding sequence
atggccctgatccccgacctggccatggagacctggctgctgctggccgtgagcctggtgctgctgtacctggtgttcggcgcctacagcatggacgtgatcaccagcaccagcttcggcgtgaacatcgacagcctgaacaacccccaggaccccttcgtggagaacaccaagaagctgctgagattcgacttcctggaccccttcttcctgagcatcaccgtgttccccttcctgatccccatcctggaggtgctgaacatctgcgtgttccccagagaggtgaccaacttcctgagaaagagcgtgaagagaatgaaggagagcagactggaggacacccagaagcacagagtggacttcctgcagctgatgatcgacagccagaacagcaaggagaccgagagccacaaggccctgagcgacctggagctggtggcccagagcatcatcttcatcttcgccggctacgagaccaccagcagcgtgctgagcttcatcatgtacgagctggccacccaccccgacgtgcagcagaagctgcaggaggagatcgacgccgtgctgcccaacaaggccccccccacctacgacaccgtgctgcagatggagtacctggacatggtggtgaacgagaccctgagactgttccccatcgccatgagactggagagagtgtgcaagaaggacgtggagatcaacggcatgttcatccccaagggcgtggtggtgatgatccccagctacgccctgcacagagaccccaagtactggaccgagcccgagaagttcctgcccgagagattcagcaagaagaacaaggacaacatcgacccctacatctacacccccttcggcagcggccccagaaactgcatcggcatgagattcgccctgatgaacatgaagctggccctgatcagagtgctgcagaacttcagcttcaagccctgcaaggagacccagatccccctgaagctgagcctgggcggcctgctgcagcccgagaagcccgtggtgctgaaggtggagagcagagacggcaccgtgagcggcgcctag

SEQ ID NO: 78309 - DNA, 240 bp, Artificial Sequence
  Description of Artificial Sequence: Synthetic coding sequence
atggtgcccatcatcgcccagtacggcgacgtgctggtgagaaacctgagaagagaggccgagaccggcaagcccgtgaccctgaaggacgtgttcggcgcctacagcatggacgtgatcaccagcaccagcttcggcgtgaacatcgacagcctgaacaacccccaggaccccttcgtggagaacaccaagaagctgctgagattcgacttcctggaccccttcttcctgagcatctag

SEQ ID NO: 78310 - DNA, 1068 bp, Artificial Sequence
  Description of Artificial Sequence: Synthetic coding sequence
atggccaagctgatcgccctgaccctgctgggcatgggcctggccctgttcagaaaccaccagagcagctaccagaccagactgaacgccctgagagaggtgcagcccgtggagctgcccaactgcaacctggtgaagggcatcgagaccggcagcgaggacctggagatcctgcccaacggcctggccttcatcagcagcggcctgaagtaccccggcatcaagagcttcaaccccaacagccccggcaagatcctgctgatggacctgaacgaggaggaccccaccgtgctggagctgggcatcaccggcagcaagttcgacgtgagcagcttcaacccccacggcatcagcaccttcaccgacgaggacaacgccatgtacctgctggtggtgaaccaccccgacgccaagagcaccgtggagctgttcaagttccaggaggaggagaagagcctgctgcacctgaagaccatcagacacaagctgctgcccaacctgaacgacatcgtggccgtgggccccgagcacttctacggcaccaacgaccactacttcctggacccctacctgcagagctgggagatgtacctgggcctggcctggagctacgtggtgtactacagccccagcgaggtgagagtggtggccgagggcttcgacttcgccaacggcatcaacatcagccccgacggcaagtacgtgtacatcgccgagctgctggcccacaagatccacgtgtacgagaagcacgccaactggaccctgacccccctgaagagcctggacttcaacaccctggtggacaacatcagcgtggaccccgagaccggcgacctgtgggtgggctgccaccccaacggcatgaagatcttcttctacgacagcgagaacccccccgccagcgaggtgctgagaatccagaacatcctgaccgaggagcccaaggtgacccaggtgtacgccgagaacggcaccgtgctgcagggcagcaccgtggccagcgtgtacaagggcaagctgctgatcggcaccgtgttccacaaggccctgtactgcgagctgtag

SEQ ID NO: 78311 - DNA, 1263 bp, Artificial Sequence
  Description of Artificial Sequence: Synthetic coding sequence
atggacctgatccccaacttcgccatggagacctgggtgctggtggccaccagcctggtgctgctgtacatctacggcacccacagccacaagctgttcaagaagctgggcatccccggccccacccccctgcccttcctgggcaccatcctgttctacctgagaggcctgtggaacttcgacagagagtgcaacgagaagtacggcgagatgtggggcctgtacgagggccagcagcccatgctggtgatcatggaccccgacatgatcaagaccgtgctggtgaaggagtgctacagcgtgttcaccaaccagatgcccctgggccccatgggcttcctgaagagcgccctgagcttcgccgaggacgaggagtggaagagaatcagaaccctgctgagccccgccttcaccagcgtgaagttcaaggagatggtgcccatcatcagccagtgcggcgacatgctggtgagaagcctgagacaggaggccgagaacagcaagagcatcaacctgaaggacttcttcggcgcctacaccatggacgtgatcaccggcaccctgttcggcgtgaacctggacagcctgaacaacccccaggaccccttcctgaagaacatgaagaagctgctgaagctggacttcctggaccccttcctgctgctgatcagcctgttccccttcctgacccccgtgttcgaggccctgaacatcggcctgttccccaaggacgtgacccacttcctgaagaacagcatcgagagaatgaaggagagcagactgaaggacaagcagaagcacagagtggacttcttccagcagatgatcgacagccagaacagcaaggagaccaagagccacaaggccctgagcgacctggagctggtggcccagagcatcatcatcatcttcgccgcctacgacaccaccagcaccaccctgcccttcatcatgtacgagctggccacccaccccgacgtgcagcagaagctgcaggaggagatcgacgccgtgctgcccaacaaggcccccgtgacctacgacgccctggtgcagatggagtacctggacatggtggtgaacgagaccctgagactgttccccgtggtgagcagagtgaccagagtgtgcaagaaggacatcgagatcaacggcgtgttcatccccaagggcctggccgtgatggtgcccatctacgccctgcaccacgaccccaagtactggaccgagcccgagaagttctgccccgagagaagccactag

SEQ ID NO: 78312 - DNA, 843 bp, Artificial Sequence
  Description of Artificial Sequence: Synthetic coding sequence
atgaacctggagaccggcaacggcccccaccacttccccatgtggagatacgtgggcgagaagcccgaggccggcagcagagagcagcaggtgcaccagctggagagattcctgtggggcctgcaccacggctgcaaccactggcacatcatctggagcgagctgggcttcagccagcagagcaccagaagcctgagcgagaagtacgaggaggccttcaagatcggcttcttcggcagcctgttcaccctgaacatccagagcctggccgtgctgcccagacccgagtgcatggtgagaagcggcctgaccgagaccagcaccagctgggtgagagtgatcctgctgccccagccccccgaggagctgggcctgcagcacagagtggacttcttccagcagatgatcgacagccagaacagcaaggagaccaagagccacaaggccctgagcgacctggagctggtggcccagagcatcatcatcatcttcgccgcctacgacaccaccagcaccaccctgcccttcatcatgtacgagctggccacccaccccgacgtgcagcagaagctgcaggaggagatcgacgccgtgctgcccaacaaggcccccgtgacctacgacgccctggtgcagatggagtacctggacatggtggtgaacgagaccctgagactgttccccgtggtgagcagagtgaccagagtgtgcaagaaggacatcgagatcaacggcgtgttcatccccaagggcctggccgtgatggtgcccatctacgccctgcaccacgaccccaagtactggaccgagcccgagaagttctgccccgagagaagccactag

SEQ ID NO: 78313 - DNA, 1512 bp, Artificial Sequence
  Description of Artificial Sequence: Synthetic coding sequence
atggacctgatccccaacttcgccatggagacctgggtgctggtggccaccagcctggtgctgctgtacatctacggcacccacagccacaagctgttcaagaagctgggcatccccggccccacccccctgcccttcctgggcaccatcctgttctacctgagaggcctgtggaacttcgacagagagtgcaacgagaagtacggcgagatgtggggcctgtacgagggccagcagcccatgctggtgatcatggaccccgacatgatcaagaccgtgctggtgaaggagtgctacagcgtgttcaccaaccagatgcccctgggccccatgggcttcctgaagagcgccctgagcttcgccgaggacgaggagtggaagagaatcagaaccctgctgagccccgccttcaccagcgtgaagttcaaggagatggtgcccatcatcagccagtgcggcgacatgctggtgagaagcctgagacaggaggccgagaacagcaagagcatcaacctgaaggacttcttcggcgcctacaccatggacgtgatcaccggcaccctgttcggcgtgaacctggacagcctgaacaacccccaggaccccttcctgaagaacatgaagaagctgctgaagctggacttcctggaccccttcctgctgctgatcagcctgttccccttcctgacccccgtgttcgaggccctgaacatcggcctgttccccaaggacgtgacccacttcctgaagaacagcatcgagagaatgaaggagagcagactgaaggacaagcagaagcacagagtggacttcttccagcagatgatcgacagccagaacagcaaggagaccaagagccacaaggccctgagcgacctggagctggtggcccagagcatcatcatcatcttcgccgcctacgacaccaccagcaccaccctgcccttcatcatgtacgagctggccacccaccccgacgtgcagcagaagctgcaggaggagatcgacgccgtgctgcccaacaaggcccccgtgacctacgacgccctggtgcagatggagtacctggacatggtggtgaacgagaccctgagactgttccccgtggtgagcagagtgaccagagtgtgcaagaaggacatcgagatcaacggcgtgttcatccccaagggcctggccgtgatggtgcccatctacgccctgcaccacgaccccaagtactggaccgagcccgagaagttctgccccgagagattcagcaagaagaacaaggacagcatcgacctgtacagatacatccccttcggcgccggccccagaaactgcatcggcatgagattcgccctgaccaacatcaagctggccgtgatcagagccctgcagaacttcagcttcaagccctgcaaggagacccagatccccctgaagctggacaacctgcccatcctgcagcccgagaagcccatcgtgctgaaggtgcacctgagagacggcatcaccagcggcccctag

SEQ ID NO: 78314 - DNA, 381 bp, Artificial Sequence
  Description of Artificial Sequence: Synthetic coding sequence
atggacctgatccccaacttcgccatggagacctgggtgctggtggccaccagcctggtgctgctgtacatctacggcacccacagccacaagctgttcaagaagctgggcatccccggccccacccccctgcccttcctgggcaccatcctgttctacctgagaggcctgtggaacttcgacagagagtgcaacgagaagttcctgtggggcctgcaccacggctgcaaccactggcacatcatctggagcgagctgggcttcagccagcagagcaccagaagcctgagcgagaagtacgaggaggccttcaagatcggcttcttcggcagcctgttcaccctgaacatcaccctgagcatcagctaccccagcttctag

SEQ ID NO: 78315 - DNA, 225 bp, Artificial Sequence
  Description of Artificial Sequence: Synthetic coding sequence
atggacctgatccccaacttcgccatggagacctgggtgctggtggccaccagcctggtgctgctgtacatctacggcacccacagccacaagctgttcaagaagctgggcatccccggccccacccccctgcccttcctgggcaccatcctgttctacctgagaggcctgtggaacttcgacagagagtgcaacgagaagtacggcgagatgtggggcccctag

SEQ ID NO: 78316 - DNA, 435 bp, Artificial Sequence
  Description of Artificial Sequence: Synthetic coding sequence
atgcccaaggtgaagagaagcagaaaggccccccccgacggctgggagctgatcgagcccaccctggacgagctggaccagaagatgagagaggccgagaccgagccccacgagggcaagagaaaggtggagagcctgtggcccatcttcagaatccaccaccagaagaccagatacatcttcgacctgttctacaagagaaaggccatcagcagagagctgtacgagtactgcatcaaggagggctacgccgacaagaacctgatcgccaagtggaagaagcagggctacgagaacctgtgctgcctgagatgcatccagaccagagacaccaacttcggcaccaactgcatctgcagagtgcccaagagcaagctggaggtgggcagaatcatcgagtgcacccactgcggctgcagaggctgcagcggctag

SEQ ID NO: 78317 - DNA, 120 bp, Artificial Sequence
  Description of Artificial Sequence: Synthetic coding sequence
atggacctgatccccaacctggccgtggagacctggctgctgctggccgtgagcctggtgctgctgtacctgatgagagtgcccaagagcgccaagagccccctgaccaagcagacctag

SEQ ID NO: 78318 - DNA, 1479 bp, Artificial Sequence
  Description of Artificial Sequence: Synthetic coding sequence
atgcagctgctgatgctggagctgctgctgctgttcatcgtgtacggcaccagaacccacggcctgttcaagagactgggcatccccggccccacccccctgcccctgctgggcaacgtgctgagctacagacagggcctgtggaagttcgacaccgagtgctacaagaagtacggcaagatgtggggcacctacgagggccagctgcccgtgctggccatcaccgaccccgacgtgatcagaaccgtgctggtgaaggagtgctacagcgtgttcaccaacagaagaagcctgggccccgtgggcttcatgaagagcgccatcagcctggccgaggacgaggagtggaagagaatcagaagcctgctgagccccaccttcaccagcggcaagctgaaggagatgttccccatcatcgcccagtacggcgacgtgctggtgagaaacctgagaagagaggccgagaagggcaagcccgtgaccctgaaggacatcttcggcgcctacagcatggacgtgatcaccggcaccagcttcggcgtgaacatcgacagcctgaacaacccccaggaccccttcgtggagagcaccaagaagttcctgaagttcggcttcctggaccccctgttcctgagcatcatcctgttccccttcctgacccccgtgttcgaggccctgaacgtgagcctgttccccaaggacaccatcaacttcctgagcaagagcgtgaacagaatgaagaagagcagactgaacgacaagcagaagcacagactggacttcctgcagctgatgatcgacagccagaacagcaaggagaccgagagccacaaggccctgagcgacctggagctggccgcccagagcatcatcttcatcttcgccggctacgagaccaccagcagcgtgctgagcttcaccctgtacgagctggccacccaccccgacgtgcagcagaagctgcagaaggagatcgacgccgtgctgcccaacaaggccccccccacctacgacgccgtggtgcagatggagtacctggacatggtggtgaacgagaccctgagactgttccccgtggccatcagactggagagaacctgcaagaaggacgtggagatcaacggcgtgttcatccccaagggcagcatggtggtgatccccacctacgccctgcaccacgaccccaagtactggaccgagcccgaggagttcagacccgagagattcagcaagaagaaggacagcatcgacccctacatctacacccccttcggcaccggccccagaaactgcatcggcatgagattcgccctgatgaacatgaagctggccctgatcagagtgctgcagaacttcagcttcaagccctgcaaggagacccagatccccctgaagctggacacccagggcctgctgcagcccgagaagcccatcgtgctgaaggtggacagcagagacggcaccctgagcggcgagtag

SEQ ID NO: 78319 - DNA, 1602 bp, Artificial Sequence
  Description of Artificial Sequence: Synthetic coding sequence
atggacctgatccccaacctggccgtggagacctggctgctgctggccgtgagcctgatcctgctgtacctgtacggcaccagaacccacggcctgttcaagaagctgggcatccccggccccacccccctgcccttcctgggcaacgccctgagcttcagaaagggctactggaccttcgacatggagtgctacaagaagtacagaaaggtgtggggcatctacgactgccagcagcccatgctggccatcaccgaccccgacatgatcaagaccgtgctggtgaaggagtgctacagcgtgttcaccaacagaagacccttcggccccgtgggcttcatgaagaacgccatcagcatcgccgaggacgaggagtggaagagaatcagaagcctgctgagccccaccttcaccagcggcaagctgaaggagatggtgcccatcatcgcccagtacggcgacgtgctggtgagaaacctgagaagagaggccgagaccggcaagcccgtgaccctgaagcacgtgttcggcgcctacagcatggacgtgatcaccagcaccagcttcggcgtgagcatcgacagcctgaacaacccccaggaccccttcgtggagaacaccaagaagctgctgagattcaaccccctggaccccttcgtgctgagcatcaaggtgttccccttcctgacccccatcctggaggccctgaacatcaccgtgttccccagaaaggtgatcagcttcctgaccaagagcgtgaagcagatcaaggagggcagactgaaggagacccagaagcacagagtggacttcctgcagctgatgatcgacagccagaacagcaaggacagcgagacccacaaggccctgagcgacctggagctgatggcccagagcatcatcttcatcttcgccggctacgagaccaccagcagcgtgctgagcttcatcatctacgagctggccacccaccccgacgtgcagcagaaggtgcagaaggagatcgacaccgtgctgcccaacaaggccccccccacctacgacaccgtgctgcagctggagtacctggacatggtggtgaacgagaccctgagactgttccccgtggccatgagactggagagagtgtgcaagaaggacgtggagatcaacggcatgttcatccccaagggcgtggtggtgatgatccccagctacgtgctgcaccacgaccccaagtactggagagagcccgagaagttcctgcccgagagattcagcaagaagaacaaggacaacatcgacccctacatctacacccccttcggcagcggccccagaaactgcatcggcatgagattcgccctggtgaacatgaagctggccctggtgagagtgctgcagaacttcagcttcaagccctgcaaggagacccagatccccctgaagctgagattcggcggcctgctgctgaccgagaagcccatcgtgctgaaggccgagagcagagacgagaccttcgtggacatggagcccatccacatggacttcctgagaagcctggccttccagggcccccacctgtgcttcttctgggagctgctgtgccccaccatcagatag

SEQ ID NO: 78320 - DNA, 1512 bp, Artificial Sequence
  Description of Artificial Sequence: Synthetic coding sequence
atggacctgatccccaacctggccgtggagacctggctgctgctggccgtgagcctgatcctgctgtacctgtacggcaccagaacccacggcctgttcaagaagctgggcatccccggccccacccccctgcccttcctgggcaacgccctgagcttcagaaagggctactggaccttcgacatggagtgctacaagaagtacagaaaggtgtggggcatctacgactgccagcagcccatgctggccatcaccgaccccgacatgatcaagaccgtgctggtgaaggagtgctacagcgtgttcaccaacagaagacccttcggccccgtgggcttcatgaagaacgccatcagcatcgccgaggacgaggagtggaagagaatcagaagcctgctgagccccaccttcaccagcggcaagctgaaggagatggtgcccatcatcgcccagtacggcgacgtgctggtgagaaacctgagaagagaggccgagaccggcaagcccgtgaccctgaagcacgtgttcggcgcctacagcatggacgtgatcaccagcaccagcttcggcgtgagcatcgacagcctgaacaacccccaggaccccttcgtggagaacaccaagaagctgctgagattcaaccccctggaccccttcgtgctgagcatcaaggtgttccccttcctgacccccatcctggaggccctgaacatcaccgtgttccccagaaaggtgatcagcttcctgaccaagagcgtgaagcagatcaaggagggcagactgaaggagacccagaagcacagagtggacttcctgcagctgatgatcgacagccagaacagcaaggacagcgagacccacaaggccctgagcgacctggagctgatggcccagagcatcatcttcatcttcgccggctacgagaccaccagcagcgtgctgagcttcatcatctacgagctggccacccaccccgacgtgcagcagaaggtgcagaaggagatcgacaccgtgctgcccaacaaggccccccccacctacgacaccgtgctgcagctggagtacctggacatggtggtgaacgagaccctgagactgttccccgtggccatgagactggagagagtgtgcaagaaggacgtggagatcaacggcatgttcatccccaagggcgtggtggtgatgatccccagctacgtgctgcaccacgaccccaagtactggagagagcccgagaagttcctgcccgagagattcagcaagaagaacaaggacaacatcgacccctacatctacacccccttcggcagcggccccagaaactgcatcggcatgagattcgccctggtgaacatgaagctggccctggtgagagtgctgcagaacttcagcttcaagccctgcaaggagacccagatccccctgaagctgagattcggcggcctgctgctgaccgagaagcccatcgtgctgaaggccgagagcagagacgagaccgtgagcggcgcctag

SEQ ID NO: 78321 - DNA, 1410 bp, Artificial Sequence
  Description of Artificial Sequence: Synthetic coding sequence
atggagctgatcagccccaccgtgatcatcatcctgggctgcctggccctgttcctgctgctgcagagaaagaacctgagaagacccccctgcatcaagggctggatcccctggatcggcgtgggcttcgagttcggcaaggcccccctggagttcatcgagaaggccagaatcaagtacggccccatcttcaccgtgttcgccatgggcaacagaatgaccttcgtgaccgaggaggagggcatcaacgtgttcctgaagagcaagaaggtggacttcgagctggccgtgcagaacatcgtgtacagaaccgccagcatccccaagaacgtgttcctggccctgcacgagaagctgtacatcatgctgaagggcaagatgggcaccgtgaacctgcaccagttcaccggccagctgaccgaggagctgcacgagcagctggagaacctgggcacccacggcaccatggacctgaacaacctggtgagacacctgctgtaccccgtgaccgtgaacatgctgttcaacaagagcctgttcagcaccaacaagaagaagatcaaggagttccaccagtacttccaggtgtacgacgaggacttcgagtacggcagccagctgcccgagtgcctgctgagaaactggagcaagagcaagaagtggttcctggagctgttcgagaagaacatccccgacatcaaggcctgcaagagcgccaaggacaacagcatgaccctgctgcaggccaccctggacatcgtggagaccgagaccagcaaggagaacagccccaactacggcctgctgctgctgtgggccagcctgagcaacgccgtgcccgtggccttctggaccctggcctacgtgctgagccaccccgacatccacaaggccatcatggagggcatcagcagcgtgttcggcaaggccggcaaggacaagatcaaggtgagcgaggacgacctggagaacctgctgctgatcaagtggtgcgtgctggagaccatcagactgaaggcccccggcgtgatcaccagaaaggtggtgaagcccgtggagatcctgaactacatcatccccagcggcgacctgctgatgctgagccccttctggctgcacagaaaccccaagtacttccccgagcccgagctgttcaagcccgagagatggaagaaggccaacctggagaagcacagcttcctggactgcttcatggccttcggcagcggcaagttccagtgccccgccagatggttcgccctgctggaggtgcagatgtgcatcatcctgatcctgtacaagtacgactgcagcctgctggaccccctgcccaagcagagctacctgcacctggtgggcgtgccccagcccgagggccagtgcagaatcgagtacaagcagagaatctag

SEQ ID NO: 78322 - DNA, 1560 bp, Artificial Sequence
  Description of Artificial Sequence: Synthetic coding sequence
atgagcgtgagcgtgctgagccccagcagactgctgggcgacgtgagcggcatcctgcaggccgccagcctgctgatcctgctgctgctgctgatcaaggccgtgcagctgtacctgcacagacagtggctgctgaaggccctgcagcagttcccctgcccccccagccactggctgttcggccacatccaggagctgcagcaggaccaggagctgcagagaatccagaagtgggtggagaccttccccagcgcctgcccccactggctgtggggcggcaaggtgagagtgcagctgtacgaccccgactacatgaaggtgatcctgggcagaagcgaccccaagagccacggcagctacagattcctggccccctggatcggctacggcctgctgctgctgaacggccagacctggttccagcacagaagaatgctgacccccgccttccactacgacatcctgaagccctacgtgggcctgatggccgacagcgtgagagtgatgctggacaagtgggaggagctgctgggccaggacagccccctggaggtgttccagcacgtgagcctgatgaccctggacaccatcatgaagtgcgccttcagccaccagggcagcatccaggtggacagaaacagccagagctacatccaggccatcagcgacctgaacaacctggtgttcagcagagtgagaaacgccttccaccagaacgacaccatctacagcctgaccagcgccggcagatggacccacagagcctgccagctggcccaccagcacaccgaccaggtgatccagctgagaaaggcccagctgcagaaggagggcgagctggagaagatcaagagaaagagacacctggacttcctggacatcctgctgctggccaagatggagaacggcagcatcctgagcgacaaggacctgagagccgaggtggacaccttcatgttcgagggccacgacaccaccgccagcggcatcagctggatcctgtacgccctggccacccaccccaagcaccaggagagatgcagagaggagatccacagcctgctgggcgacggcgccagcatcacctggaaccacctggaccagatgccctacaccaccatgtgcatcaaggaggccctgagactgtacccccccgtgcccggcatcggcagagagctgagcacccccgtgaccttccccgacggcagaagcctgcccaagggcatcatggtgctgctgagcatctacggcctgcaccacaaccccaaggtgtggcccaaccccgaggtgttcgaccccttcagattcgcccccggcagcgcccagcacagccacgccttcctgcccttcagcggcggcagcagaaactgcatcggcaagcagttcgccatgaacgagctgaaggtggccaccgccctgaccctgctgagattcgagctgctgcccgaccccaccagaatccccatccccatcgccagactggtgctgaagagcaagaacggcatccacctgagactgagaagactgcccaacccctgcgaggacaaggaccagctgtag

SEQ ID NO: 78323 - DNA, 1563 bp, Artificial Sequence
  Description of Artificial Sequence: Synthetic coding sequence
atgagcgtgagcgtgctgagccccagcagactgctgggcgacgtgagcggcatcctgcaggccgccagcctgctgatcctgctgctgctgctgatcaaggccgtgcagctgtacctgcacagacagtggctgctgaaggccctgcagcagttcccctgcccccccagccactggctgttcggccacatccaggagctgcagcaggaccaggagctgcagagaatccagaagtgggtggagaccttccccagcgcctgcccccactggctgtggggcggcaaggtgagagtgcagctgtacgaccccgactacatgaaggtgatcctgggcagaagcgaccccaagagccacggcagctacagattcctggccccctggatcggctacggcctgctgctgctgaacggccagacctggttccagcacagaagaatgctgacccccgccttccactacgacatcctgaagccctacgtgggcctgatggccgacagcgtgagagtgatgctggacaagtgggaggagctgctgggccaggacagccccctggaggtgttccagcacgtgagcctgatgaccctggacaccatcatgaagtgcgccttcagccaccagggcagcatccaggtggacagaaacagccagagctacatccaggccatcagcgacctgaacaacctggtgttcagcagagtgagaaacgccttccaccagaacgacaccatctacagcctgaccagcgccggcagatggacccacagagcctgccagctggcccaccagcacaccggcgaccaggtgatccagctgagaaaggcccagctgcagaaggagggcgagctggagaagatcaagagaaagagacacctggacttcctggacatcctgctgctggccaagatggagaacggcagcatcctgagcgacaaggacctgagagccgaggtggacaccttcatgttcgagggccacgacaccaccgccagcggcatcagctggatcctgtacgccctggccacccaccccaagcaccaggagagatgcagagaggagatccacagcctgctgggcgacggcgccagcatcacctggaaccacctggaccagatgccctacaccaccatgtgcatcaaggaggccctgagactgtacccccccgtgcccggcatcggcagagagctgagcacccccgtgaccttccccgacggcagaagcctgcccaagggcatcatggtgctgctgagcatctacggcctgcaccacaaccccaaggtgtggcccaaccccgaggtgttcgaccccttcagattcgcccccggcagcgcccagcacagccacgccttcctgcccttcagcggcggcagcagaaactgcatcggcaagcagttcgccatgaacgagctgaaggtggccaccgccctgaccctgctgagattcgagctgctgcccgaccccaccagaatccccatccccatcgccagactggtgctgaagagcaagaacggcatccacctgagactgagaagactgcccaacccctgcgaggacaaggaccagctgtag

SEQ ID NO: 78324 - DNA, 1368 bp, Artificial Sequence
  Description of Artificial Sequence: Synthetic coding sequence
atgagcgtgagcgtgctgagccccagcagactgctgggcgacgtgagcggcatcctgcaggccgccagcctgctgatcctgctgctgctgctgatcaaggccgtgcagctgtacctgcacagacagtggctgctgaaggccctgcagcagttcccctgcccccccagccactggctgttcggccacatccaggagctgcagcaggaccaggagctgcagagaatccagaagtgggtggagaccttccccagcgcctgcccccactggctgtggggcggcaaggtgagagtgcagctgtacgaccccgactacatgaaggtgatcctgggcagaagcgaccccaagagccacggcagctacagattcctggccccctggatcggctacggcctgctgctgctgaacggccagacctggttccagcacagaagaatgctgacccccgccttccactacgacatcctgaagccctacgtgggcctgatggccgacagcgtgagagtgatgctggacaagtgggaggagctgctgggccaggacagccccctggaggtgttccagcacgtgagcctgatgaccctggacaccatcatgaagtgcgccttcagccaccagggcagcatccaggtggacagaaacagccagagctacatccaggccatcagcgacctgaacaacctggtgttcagcagagtgagaaacgccttccaccagaacgacaccatctacagcctgaccagcgccggcagatggacccacagagcctgccagctggcccaccagcacaccgaccaggtgatccagctgagaaaggcccagctgcagaaggagggcgagctggagaagatcaagagaaagagacacctggacttcctggacatcctgctgctggccaagatggagaacggcagcatcctgagcgacaaggacctgagagccgaggtggacaccttcatgttcgagggccacgacaccaccgccagcggcatcagctggatcctgtacgccctggccacccaccccaagcaccaggagagatgcagagaggagatccacagcctgctgggcgacggcgccagcatcacctggaaccacctggaccagatgccctacaccaccatgtgcatcaaggaggccctgagactgtacccccccgtgcccggcatcggcagagagctgagcacccccgtgaccttccccgacggcagaagcctgcccaagggcatcatggtgctgctgagcatctacggcctgcaccacaaccccaaggtgtggcccaaccccgaggtgttcgaccccttcagattcgcccccggcagcgcccagcacagccacgccttcctgcccttcagcggcggcagcagatag

SEQ ID NO: 78325 - DNA, 474 bp, Artificial Sequence
  Description of Artificial Sequence: Synthetic coding sequence
atgaaggtgatcctgggcagaagcgaccccaagagccacggcagctacagattcctggccccctggatcggctacggcctgctgctgctgaacggccagacctggttccagcacagaagaatgctgacccccgccttccactacgacatcctgaagccctacgtgggcctgatggccgacagcgtgagagtgatgctggacaagtgggaggagctgctgggccaggacagccccctggaggtgttccagcacgtgagcctgatgaccctggacaccatcatgaagtgcgccttcagccaccagggcagcatccaggtggacagacccagcgaccccaccgaggagggcagcaccaccgagggcggcggcgccggcgaggaccaggaggaggaggccttcggcttcagcggctacccccccctgggccagaacggcgagtgggagcacctggtgagacagggccccccctgctag

SEQ ID NO: 78326 - DNA, 1575 bp, Artificial Sequence
  Description of Artificial Sequence: Synthetic coding sequence
atgccccagctgagcctgagctggctgggcctgggccccgtggccgccagcccctggctgctgctgctgctggtgggcggcagctggctgctggccagagtgctggcctggacctacaccttctacgacaactgcagaagactgcagtgcttcccccagccccccaagcagaactggttctggggccaccagggcctggtgacccccaccgaggagggcatgaagaccctgacccagctggtgaccacctacccccagggcttcaagctgtggctgggccccaccttccccctgctgatcctgtgccaccccgacatcatcagacccatcaccagcgccagcgccgccgtggcccccaaggacatgatcttctacggcttcctgaagccctggctgggcgacggcctgctgctgagcggcggcgacaagtggagcagacacagaagaatgctgacccccgccttccacttcaacatcctgaagccctacatgaagatcttcaacaagagcgtgaacatcatgcacgacaagtggcagagactggccagcgagggcagcgccagactggacatgttcgagcacatcagcctgatgaccctggacagcctgcagaagtgcgtgttcagcttcgagagcaactgccaggagaagcccagcgagtacatcgccgccatcctggagctgagcgccttcgtggagaagagaaaccagcagatcctgctgcacaccgacttcctgtactacctgacccccgacggccagagattcagaagagcctgccacctggtgcacgacttcaccgacgccgtgatccaggagagaagatgcaccctgcccacccagggcatcgacgacttcctgaagaacaaggccaagagcaagaccctggacttcatcgacgtgctgctgctgagcaaggacgaggacggcaaggagctgagcgacgaggacatcagagccgaggccgacaccttcatgttcgagggccacgacaccaccgccagcggcctgagctgggtgctgtaccacctggccaagcaccccgagtaccaggagcagtgcagacaggaggtgcaggagctgctgaaggacagagagcccatcgagatcgagtgggacgacctggcccagctgcccttcctgaccatgtgcatcaaggagagcctgagactgcacccccccgtgcccgtgatcagcagatgctgcacccaggacttcgtgctgcccgacggcagagtgatccccaagggcatcgtgtgcctgatcaacatcatcggcatccactacaaccccaccgtgtggcccgaccccgaggtgtacgaccccttcagattcgaccaggagaacatcaaggagagaagccccctggccttcatccccttcagcgccggccccagaaactgcatcggccaggccttcgccatggccgagatgaaggtggtgctggccctgaccctgctgcacttcagaatcctgcccacccacaccgagcccagaagaaagcccgagctgatcctgagagccgagggcggcctgtggctgagagtggagcccctgggcgccaacagccagtag

SEQ ID NO: 78327 - DNA, 1365 bp, Artificial Sequence
  Description of Artificial Sequence: Synthetic coding sequence
atgccccagctgagcctgagctggctgggcctgggccccgtggccgccagcccctggctgctgctgctgctggtgggcggcagctggctgctggccagagtgctggcctggacctacaccttctacgacaactgcagaagactgcagtgcttcccccagccccccaagcagaactggttctggggccaccagggcctggtgacccccaccgaggagggcatgaagaccctgacccagctggtgaccacctacccccagggcttcaagctgtggctgggccccaccttccccctgctgatcctgtgccaccccgacatcatcagacccatcaccagcgccagcgccgccgtggcccccaaggacatgatcttctacggcttcctgaagccctggctgggcgacggcctgctgctgagcggcggcgacaagtggagcagacacagaagaatgctgacccccgccttccacttcaacatcctgaagccctacatgaagatcttcaacaagagcgtgaacatcatgcacgacaagtggcagagactggccagcgagggcagcgccagactggacatgttcgagcacatcagcctgatgaccctggacagcctgcagaagtgcgtgttcagcttcgagagcaactgccaggagaagcccagcgagtacatcgccgccatcctggagctgagcgccttcgtggagaagagaaaccagcagatcctgctgcacaccgacttcctgtactacctgacccccgacggccagagattcagaagagcctgccacctggtgcacgacttcaccgacgccgtgatccaggagagaagatgcaccctgcccacccagggcatcgacgacttcctgaagaacaaggccaagagcaagaccctggacttcatcgacgtgctgctgctgagcaaggacgaggacggcaaggagctgagcgacgaggacatcagagccgaggccgacaccttcatgttcgagggccacgacaccaccgccagcggcctgagctgggtgctgtaccacctggccaagcaccccgagtaccaggagcagtgcagacaggaggtgcaggagctgctgaaggacagagagcccatcgagatcgagtgggacgacctggcccagctgcccttcctgaccatgtgcatcaaggagagcctgagactgcacccccccgtgcccgtgatcagcagatgctgcacccaggacttcgtgctgcccgacggcagagtgatccccaagggcctgagacccctgcccttcagacccagagagcaccagggcgaggtgaccagcggcttctacagcctgctgggcagagcccagaagctgcacagagccggcgtgagacacggctag

SEQ ID NO: 78328 - DNA, 1575 bp, Artificial Sequence; identical to SEQ ID NO: 78326
  Description of Artificial Sequence: Synthetic coding sequence

SEQ ID NO: 78329 - DNA, 1575 bp, Artificial Sequence
  Description of Artificial Sequence: Synthetic coding sequence
atgagcctgctgagcctgccctggctgggcctgagacccgtggccaccagcccctggctgctgctgctgctggtggtgggcagctggctgctggccagaatcctggcctggacctacgccttctacaacaactgcagaagactgcagtgcttcccccagccccccaagagaaactggttctggggccacctgggcctgatcacccccaccgaggagggcctgaagaacagcacccagatgagcgccacctacagccagggcttcaccatctggctgggccccatcatccccttcatcgtgctgtgccaccccgacaccatcagaagcatcaccaacgccagcgccgccatcgcccccaaggacaacctgttcatcagattcctgaagccctggctgggcgagggcatcctgctgagcggcggcgacaagtggagcagacacagaagaatgctgacccccgccttccacttcaacatcctgaagagctacatcaccatcttcaacaagagcgccaacatcatgctggacaagtggcagcacctggccagcgagggcagcagctgcctggacatgttcgagcacatcagcctgatgaccctggacagcctgcagaagtgcatcttcagcttcgacagccactgccaggagagacccagcgagtacatcgccaccatcctggagctgagcgccctggtggagaagagaagccagcacatcctgcagcacatggacttcctgtactacctgagccacgacggcagaagattccacagagcctgcagactggtgcacgacttcaccgacgccgtgatcagagagagaagaagaaccctgcccacccagggcatcgacgacttcttcaaggacaaggccaagagcaagaccctggacttcatcgacgtgctgctgctgagcaaggacgaggacggcaaggccctgagcgacgaggacatcagagccgaggccgacaccttcatgttcggcggccacgacaccaccgccagcggcctgagctgggtgctgtacaacctggccagacaccccgagtaccaggagagatgcagacaggaggtgcaggagctgctgaaggacagagaccccaaggagatcgagtgggacgacctggcccagctgcccttcctgaccatgtgcgtgaaggagagcctgagactgcacccccccgcccccttcatcagcagatgctgcacccaggacatcgtgctgcccgacggcagagtgatccccaagggcatcacctgcctgatcgacatcatcggcgtgcaccacaaccccaccgtgtggcccgaccccgaggtgtacgaccccttcagattcgaccccgagaacagcaagggcagaagccccctggccttcatccccttcagcgccggccccagaaactgcatcggccaggccttcgccatggccgagatgaaggtggtgctggccctgatgctgctgcacttcagattcctgcccgaccacaccgagcccagaagaaagctggagctgatcatgagagccgagggcggcctgtggctgagagtggagcccctgaacgtgagcctgcagtag

SEQ ID NO: 78330 - DNA, 1575 bp, Artificial Sequence; identical to SEQ ID NO: 78329
  Description of Artificial Sequence: Synthetic coding sequence

SEQ ID NO: 78331 - DNA, 1596 bp, Artificial Sequence
  Description of Artificial Sequence: Synthetic coding sequence
atgctgcccatcaccgacagactgctgcacctgctgggcctggagaagaccgccttcagaatctacgccgtgagcaccctgctgctgttcctgctgttcttcctgttcagactgctgctgagattcctgagactgtgcagaagcttctacatcacctgcagaagactgagatgcttcccccagccccccagaagaaactggctgctgggccacctgggcatgtacctgcccaacgaggccggcctgcaggacgagaagaaggtgctggacaacatgcaccacgtgctgctggtgtggatgggccccgtgctgcccctgctggtgctggtgcaccccgactacatcaagcccctgctgggcgccagcgccgccatcgcccccaaggacgacctgttctacggcttcctgaagccctggctgggcgacggcctgctgctgagcaagggcgacaagtggagcagacacagaagactgctgacccccgccttccacttcgacatcctgaagccctacatgaagatcttcaaccagagcgccgacatcatgcacgccaagtggagacacctggccgagggcagcgccgtgagcctggacatgttcgagcacatcagcctgatgaccctggacagcctgcagaagtgcgtgttcagctacaacagcaactgccaggagaagatgagcgactacatcagcgccatcatcgagctgagcgccctgagcgtgagaagacagtacagactgcaccactacctggacttcatctactacagaagcgccgacggcagaagattcagacaggcctgcgacatggtgcaccacttcaccaccgaggtgatccaggagagaagaagagccctgagacagcagggcgccgaggcctggctgaaggccaagcagggcaagaccctggacttcatcgacgtgctgctgctggccagagacgaggacggcaaggagctgagcgacgaggacatcagagccgaggccgacaccttcatgttcgagggccacgacaccaccagcagcggcatcagctggatgctgttcaacctggccaagtaccccgagtaccaggagaagtgcagagaggagatccaggaggtgatgaagggcagagagctggaggagctggagtgggacgacctgacccagctgcccttcaccaccatgtgcatcaaggagagcctgagacagtacccccccgtgaccctggtgagcagacagtgcaccgaggacatcaagctgcccgacggcagaatcatccccaagggcatcatctgcctggtgagcatctacggcacccaccacaaccccaccgtgtggcccgacagcaaggtgtacaacccctacagattcgaccccgacaacccccagcagagaagccccctggcctacgtgcccttcagcgccggccccagaaactgcatcggccagagcttcgccatggccgagctgagagtggtggtggccctgaccctgctgagattcagactgagcgtggacagaaccagaaaggtgagaagaaagcccgagctgatcctgagaaccgagaacggcctgtggctgaaggtggagcccctgccccccagagcctag

SEQ ID NO: 78332 - DNA, 1782 bp, Artificial Sequence
  Description of Artificial Sequence: Synthetic coding sequence
atggcccccagcggcctgaaggccgtggtgggcgagaagatcctgagcggcgtgatcagaagcgtgaagaaggacggcgagtggaaggtgctgatcatggaccaccccagcatgagaatcctgagcagctgctgcaagatgagcgacatcctggccgagggcatcaccatcgtggaggacatcaacaagagaagagagcccatccccagcctggaggccatctacctgctgagccccaccgagaagagcgtgcaggccctgatcaaggacttccagggcacccccaccttcacctacaaggccgcccacatcttcttcaccgacacctgccccgagcccctgttcagcgagctgggcagaagcagactggccaaggtggtgaagaccctgaaggagatccacctggccttcctgccctacgaggcccaggtgttcagcctggacgccccccacagcacctacaacctgtactgccccttcagagccgaggagagaaccagacagctggaggtgctggcccagcagatcgccaccctgtgcgccaccctgcaggagtaccccgccatcagatacagaaagggccccgaggacaccgcccagctggcccacgccgtgctggccaagctgaacgccttcaaggccgacacccccagcctgggcgagggccccgagaagaccagaagccagctgctgatcatggacagagccgccgaccccgtgagccccctgctgcacgagctgaccttccaggccatggcctacgacctgctggacatcgagcaggacacctacagatacgagaccaccggcctgagcgaggccagagagaaggccgtgctgctggacgaggacgacgacctgtgggtggagctgagacacatgcacatcgccgacgtgagcaagaaggtgaccgagctgctgagaaccttctgcgagagcaagagactgaccaccgacaaggccaacatcaaggacctgagccagatcctgaagaagatgccccagtaccagaaggagctgaacaagtacagcacccacctgcacctggccgacgactgcatgaagcacttcaagggcagcgtggagaagctgtgcagcgtggagcaggacctggccatgggcagcgacgccgagggcgagaagatcaaggacagcatgaagctgatcgtgcccgtgctgctggacgccgccgtgcccgcctacgacaagatcagagtgctgctgctgtacatcctgctgagaaacggcgtgagcgaggagaacctggccaagctgatccagcacgccaacgtgcaggcccacagcagcctgatcagaaacctggagcagctgggcggcaccgtgaccaaccccggcggcagcggcaccagcagcagactggagcccagagagagaatggagcccacctaccagctgagcagatggacccccgtgatcaaggacgtgatggaggacgccgtggaggacagactggacagaaacctgtggcccttcgtgagcgaccccgcccccaccgccagcagccaggccgccgtgagcgccagattcggccactggcacaagaacaaggccggcatcgaggccagagccggccccagactgatcgtgtacgtgatgggcggcgtggccatgagcgagatgagagccgcctacgaggtgaccagagccaccgagggcaagtgggaggtgctgatcggcagcagccacatcctgacccccaccagattcctggacgacctgaaggccctggacaagaagctggaggacatcgccctgccctag

SEQ ID NO: 78333 - DNA, 1344 bp, Artificial Sequence
  Description of Artificial Sequence: Synthetic coding sequence
atgagagtgctgacccagctggtggccacctacccccagggcttcaaggtgtggatgggccccatcttccccgtgatcagattctgccaccccaacatcatcagaagcgtgatcaacgccagcgccgccatcgtgcccaaggacaaggtgttctacagcttcctgaagccctggctgggcgacggcctgctgctgagcgccggcgagaagtggagcagacacagaagaatgctgacccccgccttccacttcaacatcctgaagccctacatgaagatcttcaacgagagcgtgaacatcatgcacgccaagtggcagctgctggccagcgagggcagcgccagactggacatgttcgagcacatcagcctgatgaccctggacagcctgcagaagtgcgtgttcagcttcgacagccactgccaggagaagcccagcgagtacatcgccgccatcctggagctgagcgccctggtgaccaagagacaccagcagatcctgctgtacatcgacttcctgtactacctgacccccgacggccagagattcagaagagcctgcagactggtgcacgacttcaccgacgccgtgatccaggagagaagaagaaccctgcccagccagggcgtggacgacttcctgcaggccaaggccaagagcaagaccctggacttcatcgacgtgctgctgctgagcaaggacgaggacggcaagaagctgagcgacgaggacatcagagccgaggccgacaccttcatgttcgagggccacgacaccaccgccagcggcctgagctgggtgctgtaccacctggccaagcaccccgagtaccaggagagatgcagacaggaggtgcaggagctgctgaaggacagagagcccaaggagatcgagtgggacgacctggcccagctgcccttcctgaccatgtgcatcaaggagagcctgagactgcacccccccgtgcccgccgtgagcagatgctgcacccaggacatcgtgctgcccgacggcagagtgatccccaagggcatcatctgcctgatcagcgtgttcggcacccaccacaaccccgccgtgtggcccgaccccgaggtgtacgaccccttcagattcgaccccaagaacatcaaggagagaagccccctggccttcatccccttcagcgccggccccagaaactgcatcggccaggccttcgccatggccgagatgaaggtggtgctgggcctgaccctgctgagattcagagtgctgcccgaccacaccgagcccagaagaaagcccgagctggtgctgagagccgagggcggcctgtggctgagagtggagcccctgagctag

SEQ ID NO: 78334 - DNA, 999 bp, Artificial Sequence
  Description of Artificial Sequence: Synthetic coding sequence
atgcccagcatcaccaccgccgccgccagcggcgtgagcagaagccccggcaacagaaccggcagctgggtgacctgggcctggaagcccagcgagtacatcaccgccatcatggagctgagcgccctggtggtgaagagaaacaaccagttcttcagatacaaggacttcctgtacttcctgaccccctgcggcagaagattccacagagcctgcagactggtgcacgacttcaccgacgccgtgatccaggagagaagaagaaccctgaccagccagggcgtggacgacttcctgcaggccaaggccaagagcaagaccctggacttcatcgacgtgctgctgctgagcgaggacaagaacggcaaggagctgagcgacgaggacatcagagccgaggccgacaccttcatgttcggcggccacgacaccaccgccagcggcctgagctgggtgctgtacaacctggccagacaccccgagtaccaggagagatgcagacaggaggtgcaggagctgctgaaggacagagagcccaaggagatcgagtgggacgacctggcccagctgcccttcctgaccatgtgcctgaaggagagcctgagactgcacccccccatccccaccttcgccagaggctgcacccaggacgtggtgctgcccgacagcagagtgatccccaagggcaacgtgtgcaacatcaacatcttcgccatccaccacaaccccagcgtgtggcccgaccccgaggtgtacgaccccttcagattcgaccccgagaacgcccagaagagaagccccatggccttcatccccttcagcgccggccccagaaactgcatcggccagaagttcgccatggccgagatgaaggtggtgctggccctgaccctgctgagattcagaatcctgcccgaccacagagagcccagaagaacccccgagatcgtgctgagagccgaggacggcctgtggctgagagtggagcccctgggctag

SEQ ID NO: 78335 - DNA, 1560 bp, Artificial Sequence
  Description of Artificial Sequence: Synthetic coding sequence
atgagcctgctgagcctgagctggctgggcctgagacccgtggccgccagcccctggctgctgctgctggtggtgggcgccagctggctgctggccagaatcctggcctggacctacgccttctaccacaacggcagaagactgagatgcttcccccagcccagaaagcagaactggttcctgggccacctgggcctggtgacccccaccgaggagggcctgagagtgctgacccagctggtggccacctacccccagggcttcgtgagatggctgggccccatcacccccatcatcaacctgtgccaccccgacatcgtgagaagcgtgatcaacaccagcgacgccatcaccgacaaggacatcgtgttctacaagaccctgaagccctggctgggcgacggcctgctgctgagcgtgggcgacaagtggagacaccacagaagactgacccccgccttccacttcaacatcctgaagccctacatcaagatcttcagcaagagcgccaacatcatgcacgccaagtggcagagactggccatggagggcagcacctgcctggacgtgttcgagcacatcagcctgatgaccctggacagcctgcagaagtgcatcttcagcttcgacagcaactgccaggagaagcccagcgagtacatcaccgccatcatggagctgagcgccctggtggtgaagagaaacaaccagttcttcagatacaaggacttcctgtacttcctgaccccctgcggcagaagattccacagagcctgcagactggtgcacgacttcaccgacgccgtgatccaggagagaagaagaaccctgaccagccagggcgtggacgacttcctgcaggccaaggccaagagcaagaccctggacttcatcgacgtgctgctgctgagcgaggacaagaacggcaaggagctgagcgacgaggacatcagagccgaggccgacaccttcatgttcggcggccacgacaccaccgccagcggcctgagctgggtgctgtacaacctggccagacaccccgagtaccaggagagatgcagacaggaggtgcaggagctgctgaaggacagagagcccaaggagatcgagtgggacgacctggcccagctgcccttcctgaccatgtgcctgaaggagagcctgagactgcacccccccatccccaccttcgccagaggctgcacccaggacgtggtgctgcccgacagcagagtgatccccaagggcaacgtgtgcaacatcaacatcttcgccatccaccacaaccccagcgtgtggcccgaccccgaggtgtacgaccccttcagattcgaccccgagaacgcccagaagagaagccccatggccttcatccccttcagcgccggccccagaaactgcatcggccagaagttcgccatggccgagatgaaggtggtgctggccctgaccctgctgagattcagaatcctgcccgaccacagagagcccagaagaacccccgagatcgtgctgagagccgaggacggcctgtggctgagagtggagcccctgggctag

SEQ ID NO: 78336 - DNA, 804 bp, Artificial Sequence
  Description of Artificial Sequence: Synthetic coding sequence
acccccgccttccacttcaacatcctgaagccctacatcaagatcttcagcaagagcgccaacatcatgcacgccaagtggcagagactggccatggagggcagcacctgcctggacgtgttcgagcacatcagcctgatgaccctggacagcctgcagaagtgcatcttcagcttcgacagcaactgccaggagaagcccagcgagtacatcaccgccatcatggagctgagcgccctggtggtgaagagaaacaaccagttcttcagatacaaggacttcctgtacttcctgaccccctgcggcagaagattccacagagcctgcagactggtgcacgacttcaccgacgccgtgatccaggagagaagaagaaccctgaccagccagggcgtggacgacttcctgcaggccaaggccaagagcaagaccctggacttcatcgacgtgctgctgctgagcgaggacaagaacggcaaggagctgagcgacgaggacatcagagccgaggccgacaccttcatgttcggcggccacgacaccaccgccagcggcctgagctgggtgctgtacaacctggccagacaccccgagtaccaggagagatgcagacaggaggtgcaggagctgctgaaggacagagagcccaaggagatcgagtgggacgacctggcccagctgcccttcctgaccatgtgcctgaaggagagcctgagactgcacccccccatccccaccttcgccagaggctgcacccaggacgtggtgctgcccgacagcagagtgatccccaagggcctgtag

SEQ ID NO: 78337 - DNA, 1512 bp, Artificial Sequence
  Description of Artificial Sequence: Synthetic coding sequence
atggccggcctgtggctgggcctggtgtggcagaagctgctgctgtggggcgccgccagcgccctgagcctggccggcgccagcctggtgctgagcctgctgcagagagtggccagctacgccctgctgatgaagcccgacggcagagagttcttccagcagatcatcgagtacaccgaggagtacagacacatgcccctgctgaagctgtgggtgggccccgtgcccatggtggccctgtacaacgccgagaacgtggaggtgatcctgaccagcagcaagcagatcgacaagagcagcatgtacaagttcctggagccctggctgggcctgggcctgctgaccagcaccggcaacaagtggagaagcagaagaaagatgctgacccccaccttccacttcaccatcctggaggacttcctggacatcatgaacgagcaggccaacatcctggtgaagaagctggagaagcacatcaaccaggaggccttcaactgcttcttctacatcaccctgtgcgccctggacatcatctgcgagaccgccatgggcaagaacatcggcgcccagagcaacgacgacagcgagtacgtgagagccgtgtacagaatgagcgagatgatcttcagaagaatcaagatgccctggctgtggctggacctgtggtacctgatgttcaaggagggctgggagcacaagaagagcctgcagatcctgcacaccttcaccaacagcgtgatcgccgagagagccaacgagatgaacgccaacgaggactgcagaggcgacggcagaggcagcgcccccagcaagaacaagagaagagccttcctggacctgctgctgagcgtgaccgacgacgagggcaacagactgagccacgaggacatcagagaggaggtggacaccttcatgttcgagggccacgacaccaccgccgccgccatcaactggagcctgtacctgctgggcagcaaccccgaggtgcagaagaaggtggaccacgagctggacgacgtgttcggcaagagcgacagacccgccaccgtggaggacctgaagaagctgagatacctggagtgcgtgatcaaggagaccctgagactgttccccagcgtgcccctgttcgccagaagcgtgagcgaggactgcgaggtggccggctacagagtgctgaagggcaccgaggccgtgatcatcccctacgccctgcacagagaccccagatacttccccaaccccgaggagttccagcccgagagattcttccccgagaacgcccagggcagacacccctacgcctacgtgcccttcagcgccggccccagaaactgcatcggccagaagttcgccgtgatggaggagaagaccatcctgagctgcatcctgagacacttctggatcgagagcaaccagaagagagaggagctgggcctggagggccagctgatcctgagacccagcaacggcatctggatcaagctgaagagaagaaacgccgacgagagatag

SEQ ID NO: 78338 - DNA, 1578 bp, Artificial Sequence
  Description of Artificial Sequence: Synthetic coding sequence
atggccggcctgtggctgggcctggtgtggcagaagctgctgctgtggggcgccgccagcgccctgagcctggccggcgccagcctggtgctgagcctgctgcagagagtggccagctacgccagaaagtggcagcagatgagacccatccccaccgtggccagagcctaccccctggtgggccacgccctgctgatgaagcccgacggcagagagttcttccagcagatcatcgagtacaccgaggagtacagacacatgcccctgctgaagctgtgggtgggccccgtgcccatggtggccctgtacaacgccgagaacgtggaggtgatcctgaccagcagcaagcagatcgacaagagcagcatgtacaagttcctggagccctggctgggcctgggcctgctgaccagcaccggcaacaagtggagaagcagaagaaagatgctgacccccaccttccacttcaccatcctggaggacttcctggacatcatgaacgagcaggccaacatcctggtgaagaagctggagaagcacatcaaccaggaggccttcaactgcttcttctacatcaccctgtgcgccctggacatcatctgcgagaccgccatgggcaagaacatcggcgcccagagcaacgacgacagcgagtacgtgagagccgtgtacagaatgagcgagatgatcttcagaagaatcaagatgccctggctgtggctggacctgtggtacctgatgttcaaggagggctgggagcacaagaagagcctgcagatcctgcacaccttcaccaacagcgtgatcgccgagagagccaacgagatgaacgccaacgaggactgcagaggcgacggcagaggcagcgcccccagcaagaacaagagaagagccttcctggacctgctgctgagcgtgaccgacgacgagggcaacagactgagccacgaggacatcagagaggaggtggacaccttcatgttcgagggccacgacaccaccgccgccgccatcaactggagcctgtacctgctgggcagcaaccccgaggtgcagaagaaggtggaccacgagctggacgacgtgttcggcaagagcgacagacccgccaccgtggaggacctgaagaagctgagatacctggagtgcgtgatcaaggagaccctgagactgttccccagcgtgcccctgttcgccagaagcgtgagcgaggactgcgaggtggccggctacagagtgctgaagggcaccgaggccgtgatcatcccctacgccctgcacagagaccccagatacttccccaaccccgaggagttccagcccgagagattcttccccgagaacgcccagggcagacacccctacgcctacgtgcccttcagcgccggccccagaaactgcatcggccagaagttcgccgtgatggaggagaagaccatcctgagctgcatcctgagacacttctggatcgagagcaaccagaagagagaggagctgggcctggagggccagctgatcctgagacccagcaacggcatctggatcaagctgaagagaagaaacgccgacgagagatag

SEQ ID NO: 78339 - DNA, 1503 bp, Artificial Sequence
  Description of Artificial Sequence: Synthetic coding sequence
atgagccccggcctgctgctgctgggcagcgccgtgctgctggccttcggcctgtgctgcaccttcgtgcacagagccagaagcagatacgagcacatccccggcccccccagacccagcttcctgctgggccacctgccctgcttctggaagaaggacgaggtgggcggcagagtgctgcaggacgtgttcctggactgggccaagaagtacggccccgtggtgagagtgaacgtgttccacaagaccagcgtgatcgtgaccagccccgagagcgtgaagaagttcctgatgagcaccaagtacaacaaggacagcaagatgtacagagccctgcagaccgtgttcggcgagagactgttcggccagggcctggtgagcgagtgcaactacgagagatggcacaagcagagaagagtgatcgacctggccttcagcagaagcagcctggtgagcctgatggagaccttcaacgagaaggccgagcagctggtggagatcctggaggccaaggccgacggccagacccccgtgagcatgcaggacatgctgacctacaccgccatggacatcctggccaaggccgccttcggcatggagaccagcatgctgctgggcgcccagaagcccctgagccaggccgtgaagctgatgctggagggcatcaccgccagcagaaacaccctggccaagttcctgcccggcaagagaaagcagctgagagaggtgagagagagcatcagattcctgagacaggtgggcagagactgggtgcagagaagaagagaggccctgaagagaggcgaggaggtgcccgccgacatcctgacccagatcctgaaggccgaggagggcgcccaggacgacgagggcctgctggacaacttcgtgaccttcttcatcgccggccacgagaccagcgccaaccacctggccttcaccgtgatggagctgagcagacagcccgagatcgtggccagactgcaggccgaggtggacgaggtgatcggcagcaagagatacctggacttcgaggacctgggcagactgcagtacctgagccaggtgctgaaggagagcctgagactgtacccccccgcctggggcaccttcagactgctggaggaggagaccctgatcgacggcgtgagagtgcccggcaacacccccctgctgttcagcacctacgtgatgggcagaatggacacctacttcgaggaccccctgaccttcaaccccgacagattcggccccggcgcccccaagcccagattcacctacttccccttcagcctgggccacagaagctgcatcggccagcagttcgcccagatggaggtgaaggtggtgatggccaagctgctgcagagactggagttcagactggtgcccggccagagattcggcctgcaggagcaggccaccctgaagcccctggaccccgtgctgtgcaccctgagacccagaggctggcagcccgccccccccccccccccctgctag

SEQ ID NO: 78340 - DNA, 1212 bp, Artificial Sequence
  Description of Artificial Sequence: Synthetic coding sequence
atgagcaccaagtacaacaaggacagcaagatgtacagagccctgcagaccgtgttcggcgagagactgttcggccagggcctggtgagcgagtgcaactacgagagatggcacaagcagagaagagtgatcgacctggccttcagcagaagcagcctggtgagcctgatggagaccttcaacgagaaggccgagcagctggtggagatcctggaggccaaggccgacggccagacccccgtgagcatgcaggacatgctgacctacaccgccatggacatcctggccaaggccgccttcggcatggagaccagcatgctgctgggcgcccagaagcccctgagccaggccgtgaagctgatgctggagggcatcaccgccagcagaaacaccctggccaagttcctgcccggcaagagaaagcagctgagagaggtgagagagagcatcagattcctgagacaggtgggcagagactgggtgcagagaagaagagaggccctgaagagaggcgaggaggtgcccgccgacatcctgacccagatcctgaaggccgaggagggcgcccaggacgacgagggcctgctggacaacttcgtgaccttcttcatcgccggccacgagaccagcgccaaccacctggccttcaccgtgatggagctgagcagacagcccgagatcgtggccagactgcaggccgaggtggacgaggtgatcggcagcaagagatacctggacttcgaggacctgggcagactgcagtacctgagccaggtgctgaaggagagcctgagactgtacccccccgcctggggcaccttcagactgctggaggaggagaccctgatcgacggcgtgagagtgcccggcaacacccccctgctgttcagcacctacgtgatgggcagaatggacacctacttcgaggaccccctgaccttcaaccccgacagattcggccccggcgcccccaagcccagattcacctacttccccttcagcctgggccacagaagctgcatcggccagcagttcgcccagatggaggtgaaggtggtgatggccaagctgctgcagagactggagttcagactggtgcccggccagagattcggcctgcaggagcaggccaccctgaagcccctggaccccgtgctgtgcaccctgagacccagaggctggcagcccgccccccccccccccccctgctag

SEQ ID NO: 78341 - DNA, 1530 bp, Artificial Sequence
  Description of Artificial Sequence: Synthetic coding sequence
atggccgccgccgccggcatgctgctgctgggcctgctgcaggccggcggcagcgtgctgggccaggccatggagaaggtgaccggcggcaacctgctgagcatgctgctgatcgcctgcgccttcaccctgagcctggtgtacctgatcagactggccgccggccacctggtgcagctgcccgccggcgtgaagagccccccctacatcttcagccccatccccttcctgggccacgccatcgccttcggcaagagccccatcgagttcctggagaacgcctacgagaagtacggccccgtgttcagcttcaccatggtgggcaagaccttcacctacctgctgggcagcgacgccgccgccctgctgttcaacagcaagaacgaggacctgaacgccgaggacgtgtacagcagactgaccacccccgtgttcggcaagggcgtggcctacgacgtgcccaaccccgtgttcctggagcagaagaagatgctgaagagcggcctgaacatcgcccacttcaagcagcacgtgagcatcatcgagaaggagaccaaggagtacttcgagagctggggcgagagcggcgagaagaacgtgttcgaggccctgagcgagctgatcatcctgaccgccagccactgcctgcacggcaaggagatcagaagccagctgaacgagaaggtggcccagctgtacgccgacctggacggcggcttcagccacgccgcctggctgctgcccggctggctgcccctgcccagcttcagaagaagagacagagcccacagagagatcaaggacatcttctacaaggccatccagaagagaagacagagccaggagaagatcgacgacatcctgcagaccctgctggacgccacctacaaggacggcagacccctgaccgacgacgaggtggccggcatgctgatcggcctgctgctggccggccagcacaccagcagcaccaccagcgcctggatgggcttcttcctggccagagacaagaccctgcagaagaagtgctacctggagcagaagaccgtgtgcggcgagaacctgccccccctgacctacgaccagctgaaggacctgaacctgctggacagatgcatcaaggagaccctgagactgagaccccccatcatgatcatgatgagaatggccagaaccccccagaccgtggccggctacaccatcccccccggccaccaggtgtgcgtgagccccaccgtgaaccagagactgaaggacagctgggtggagagactggacttcaaccccgacagatacctgcaggacaaccccgccagcggcgagaagttcgcctacgtgcccttcggcgccggcagacacagatgcatcggcgagaacttcgcctacgtgcagatcaagaccatctggagcaccatgctgagactgtacgagttcgacctgatcgacggctacttccccaccgtgaactacaccaccatgatccacacccccgagaaccccgtgatcagatacaagagaagaagcaagtag

SEQ ID NO: 78342 - DNA, 1215 bp, Artificial Sequence
  Description of Artificial Sequence: Synthetic coding sequence
atggtgggcaagaccttcacctacctgctgggcagcgacgccgccgccctgctgttcaacagcaagaacgaggacctgaacgccgaggacgtgtacagcagactgaccacccccgtgttcggcaagggcgtggcctacgacgtgcccaaccccgtgttcctggagcagaagaagatgctgaagagcggcctgaacatcgcccacttcaagcagcacgtgagcatcatcgagaaggagaccaaggagtacttcgagagctggggcgagagcggcgagaagaacgtgttcgaggccctgagcgagctgatcatcctgaccgccagccactgcctgcacggcaaggagatcagaagccagctgaacgagaaggtggcccagctgtacgccgacctggacggcggcttcagccacgccgcctggctgctgcccggctggctgcccctgcccagcttcagaagaagagacagagcccacagagagatcaaggacatcttctacaaggccatccagaagagaagacagagccaggagaagatcgacgacatcctgcagaccctgctggacgccacctacaaggacggcagacccctgaccgacgacgaggtggccggcatgctgatcggcctgctgctggccggccagcacaccagcagcaccaccagcgcctggatgggcttcttcctggccagagacaagaccctgcagaagaagtgctacctggagcagaagaccgtgtgcggcgagaacctgccccccctgacctacgaccagctgaaggacctgaacctgctggacagatgcatcaaggagaccctgagactgagaccccccatcatgatcatgatgagaatggccagaaccccccagaccgtggccggctacaccatcccccccggccaccaggtgtgcgtgagccccaccgtgaaccagagactgaaggacagctgggtggagagactggacttcaaccccgacagatacctgcaggacaaccccgccagcggcgagaagttcgcctacgtgcccttcggcgccggcagacacagatgcatcggcgagaacttcgcctacgtgcagatcaagaccatctggagcaccatgctgagactgtacgagttcgacctgatcgacggctacttccccaccgtgaactacaccaccatgatccacacccccgagaaccccgtgatcagatacaagagaagaagcaagtag

SEQ ID NO: 78343 - DNA, 1350 bp, Artificial Sequence
  Description of Artificial Sequence: Synthetic coding sequence
atgaagcacgagaagagccccccctacatcttcagccccatccccttcctgggccacgccatcgccttcggcaagagccccatcgagttcctggagaacgcctacgagaagtacggccccgtgttcagcttcaccatggtgggcaagaccttcacctacctgctgggcagcgacgccgccgccctgctgttcaacagcaagaacgaggacctgaacgccgaggacgtgtacagcagactgaccacccccgtgttcggcaagggcgtggcctacgacgtgcccaaccccgtgttcctggagcagaagaagatgctgaagagcggcctgaacatcgcccacttcaagcagcacgtgagcatcatcgagaaggagaccaaggagtacttcgagagctggggcgagagcggcgagaagaacgtgttcgaggccctgagcgagctgatcatcctgaccgccagccactgcctgcacggcaaggagatcagaagccagctgaacgagaaggtggcccagctgtacgccgacctggacggcggcttcagccacgccgcctggctgctgcccggctggctgcccctgcccagcttcagaagaagagacagagcccacagagagatcaaggacatcttctacaaggccatccagaagagaagacagagccaggagaagatcgacgacatcctgcagaccctgctggacgccacctacaaggacggcagacccctgaccgacgacgaggtggccggcatgctgatcggcctgctgctggccggccagcacaccagcagcaccaccagcgcctggatgggcttcttcctggccagagacaagaccctgcagaagaagtgctacctggagcagaagaccgtgtgcggcgagaacctgccccccctgacctacgaccagctgaaggacctgaacctgctggacagatgcatcaaggagaccctgagactgagaccccccatcatgatcatgatgagaatggccagaaccccccagaccgtggccggctacaccatcccccccggccaccaggtgtgcgtgagccccaccgtgaaccagagactgaaggacagctgggtggagagactggacttcaaccccgacagatacctgcaggacaaccccgccagcggcgagaagttcgcctacgtgcccttcggcgccggcagacacagatgcatcggcgagaacttcgcctacgtgcagatcaagaccatctggagcaccatgctgagactgtacgagttcgacctgatcgacggctacttccccaccgtgaactacaccaccatgatccacacccccgagaaccccgtgatcagatacaagagaagaagcaagtag

SEQ ID NO: 78344 - DNA, 1515 bp, Artificial Sequence
  Description of Artificial Sequence: Synthetic coding sequence
atgatgaccaccagcctgatctggggcatcgccatcgccgcctgctgctgcctgtggctgatcctgggcatcagaagaagacagaccggcgagccccccctggagaacggcctgatcccctacctgggctgcgccctgcagttcggcgccaaccccctggagttcctgagagccaaccagagaaagcacggccacgtgttcacctgcaagctgatgggcaagtacgtgcacttcatcaccaaccccctgagctaccacaaggtgctgtgccacggcaagtacttcgactggaagaagttccacttcgccaccagcgccaaggccttcggccacagaagcatcgaccccatggacggcaacaccaccgagaacatcaacgacaccttcatcaagaccctgcagggccacgccctgaacagcctgaccgagagcatgatggagaacctgcagagaatcatgagaccccccgtgagcagcaacagcaagaccgccgcctgggtgaccgagggcatgtacagcttctgctacagagtgatgttcgaggccggctacctgaccatcttcggcagagacctgaccagaagagacacccagaaggcccacatcctgaacaacctggacaacttcaagcagttcgacaaggtgttccccgccctggtggccggcctgcccatccacatgttcagaaccgcccacaacgccagagagaagctggccgagagcctgagacacgagaacctgcagaagagagagagcatcagcgagctgatcagcctgagaatgttcctgaacgacaccctgagcaccttcgacgacctggagaaggccaagacccacctggtggtgctgtgggccagccaggccaacaccatccccgccaccttctggagcctgttccagatgatcagaaaccccgaggccatgaaggccgccaccgaggaggtgaagagaaccctggagaacgccggccagaaggtgagcctggagggcaaccccatctgcctgagccaggccgagctgaacgacctgcccgtgctggacagcatcatcaaggagagcctgagactgagcagcgccagcctgaacatcagaaccgccaaggaggacttcaccctgcacctggaggacggcagctacaacatcagaaaggacgacatcatcgccctgtacccccagctgatgcacctggaccccgagatctaccccgaccccctgaccttcaagtacgacagatacctggacgagaacggcaagaccaagaccaccttctactgcaacggcctgaagctgaagtactactacatgcccttcggcagcggcgccaccatctgccccggcagactgttcgccatccacgagatcaagcagttcctgatcctgatgctgagctacttcgagctggagctgatcgagggccaggccaagtgcccccccctggaccagagcagagccggcctgggcatcctgccccccctgaacgacatcgagttcaagtacaagttcaagcacctgtag

SEQ ID NO: 78345 - DNA, 1521 bp, Artificial Sequence
  Description of Artificial Sequence: Synthetic coding sequence
atggccggcgaggtgagcgccgccaccggcagattcagcctggagagactgggcctgcccggcctggccctggccgccgccctgctgctgctggccctgtgcctgctggtgagaagaaccagaagacccggcgagccccccctgatcaagggctggctgccctacctgggcgtggtgctgaacctgagaaaggaccccctgagattcatgaagaccctgcagaagcagcacggcgacaccttcaccgtgctgctgggcggcaagtacatcaccttcatcctggaccccttccagtaccagctggtgatcaagaaccacaagcagctgagcttcagagtgttcagcaacaagctgctggagaaggccttcagcatcagccagctgcagaagaaccacgacatgaacgacgagctgcacctgtgctaccagttcctgcagggcaagagcctggacatcctgctggagagcatgatgcagaacctgaagcaggtgttcgagccccagctgctgaagaccaccagctgggacaccgccgagctgtaccccttctgcagcagcatcatcttcgagatcaccttcaccaccatctacggcaaggtgatcgtgtgcgacaacaacaagttcatcagcgagctgagagacgacttcctgaagttcgacgacaagttcgcctacctggtgagcaacatccccatcgagctgctgggcaacgtgaagagcatcagagagaagatcatcaagtgcttcagcagcgagaagctggccaagatgcagggctggagcgaggtgttccagagcagacaggacgtgctggagaagtactacgtgcacgaggacctggagatcggcgcccaccacctgggcttcctgtgggccagcgtggccaacaccatccccaccatgttctgggccatgtactacctgctgagacaccccgaggccatggccgccgtgagagacgagatcgacagactgctgcagagcaccggccagaagaagggcagcggcttccccatccacctgaccagagagcagctggacagcctgatctgcctggagagcagcatcttcgaggccctgagactgagcagctacagcaccaccatcagattcgtggaggaggacctgaccctgagcagcgagaccggcgactactgcgtgagaaagggcgacctggtggccatcttcccccccgtgctgcacggcgaccccgagatcttcgaggcccccgaggagttcagatacgacagattcatcgaggacggcaagaagaagaccaccttcttcaagagaggcaagaagctgaagtgctacctgatgcccttcggcaccggcaccagcaagtgccccggcagattcttcgccctgatggagatcaagcagctgctggtgatcctgctgacctacttcgacctggagatcatcgacgacaagcccatcggcctgaactacagcagactgctgttcggcatccagtaccccgacagcgacgtgctgttcagatacaaggtgaagagctag

SEQ ID NO: 78346 - DNA, 1506 bp, Artificial Sequence
  Description of Artificial Sequence: Synthetic coding sequence
atggtgctgtggggccccgtgctgggcgccctgctggtggtgatcgccggctacctgtgcctgcccggcatgctgagacagagaagaccctgggagccccccctggacaagggcaccgtgccctggctgggccacgccatggccttcagaaagaacatgttcgagttcctgaagagaatgagaaccaagcacggcgacgtgttcaccgtgcagctgggcggccagtacttcaccttcgtgatggaccccctgagcttcggcagcatcctgaaggacacccagagaaagctggacttcggccagtacgccaagaagctggtgctgaaggtgttcggctacagaagcgtgcagggcgaccacgagatgatccacagcgccagcaccaagcacctgagaggcgacggcctgaaggacctgaacgagaccatgctggacagcctgagcttcgtgatgctgaccagcaagggctggagcctggacgccagctgctggcacgaggacagcctgttcagattctgctactacatcctgttcaccgccggctacctgagcctgttcggctacaccaaggacaaggagcaggacctgctgcaggccggcgagctgttcatggagttcagaaagttcgacctgctgttccccagattcgtgtacagcctgctgtggcccagagagtggctggaggtgggcagactgcagagactgttccacaagatgctgagcgtgagccacagccaggagaaggagggcatcagcaactggctgggcaacatgctgcagttcctgagagagcagggcgtgcccagcgccatgcaggacaagttcaacttcatgatgctgtgggccagccagggcaacaccggccccaccagcttctgggccctgctgtacctgctgaagcaccccgaggccatcagagccgtgagagaggaggccacccaggtgctgggcgaggccagactggagaccaagcagagcttcgccttcaagctgggcgccctgcagcacacccccgtgctggacagcgtggtggaggagaccctgagactgagagccgcccccaccctgctgagactggtgcacgaggactacaccctgaagatgagcagcggccaggagtacctgttcagacacggcgacatcctggccctgttcccctacctgagcgtgcacatggaccccgacatccaccccgagcccaccgtgttcaagtacgacagattcctgaaccccaacggcagcagaaaggtggacttcttcaagaccggcaagaagatccaccactacaccatgccctggggcagcggcgtgagcatctgccccggcagattcttcgccctgagcgaggtgaagctgttcatcctgctgatggtgacccacttcgacctggagctggtggaccccgacacccccctgccccacgtggacccccagagatggggcttcggcaccatgcagcccagccacgacgtgagattcagatacagactgcaccccaccgagtag

SEQ ID NO: 78347 - DNA, 573 bp, Artificial Sequence
  Description of Artificial Sequence: Synthetic coding sequence
atggagaaggtgcccggcgagatggagatcgagagaagagagagaagcgaggagctgagcgaggccgagagaaaggccgtgcaggccatgtgggccagactgtacgccaactgcgaggacgtgggcgtggccatcctggtgagattcttcgtgaacttccccagcgccaagcagtacttcagccagttcaagcacatggaggaccccctggagatggagagaagcccccagctgagaaagcacgcctgcagagtgatgggcgccctgaacaccgtggtggagaacctgcacgaccccgacaaggtgagcagcgtgctggccctggtgggcaaggcccacgccctgaagcacaaggtggagcccgtgtacttcaagatcctgagcggcgtgatcctggaggtggtggccgaggagttcgccagcgacttcccccccgagacccagagagcctgggccaagctgagaggcctgatctacagccacgtgaccgccgcctacaaggaggtgggctgggtgcagcaggtgcccaacgccaccaccccccccgccaccctgcccagcagcggcccctag

SEQ ID NO: 78348 - DNA, 1194 bp, Artificial Sequence
  Description of Artificial Sequence: Synthetic coding sequence
atggaggaggacgacagctacgtgcccagcgacctgaccgccgaggagagacaggagctggagaacatcagaagaagaaagcaggagctgctggccgacatccagagactgaaggacgagatcgccgaggtggccaacgagatcgagaacctgggcagcaccgaggagagaaagaacatgcagagaaacaagcaggtggccatgggcagaaagaagttcaacatggaccccaagaagggcatccagttcctgatcgagaacgacctgctgaagaacacctgcgaggacatcgcccagttcctgtacaagggcgagggcctgaacaagaccgccatcggcgactacctgggcgagagagacgagttcaacatccaggtgctgcacgccttcgtggagctgcacgagttcaccgacctgaacctggtgcaggccctgagacagttcctgtggagcttcagactgcccggcgaggcccagaagatcgacagaatgatggaggccttcgcccagagatactgccagtgcaacaacggcgtgttccagagcaccgacacctgctacgtgctgagcttcgccatcatcatgctgaacaccagcctgcacaaccccaacgtgaaggacaagcccaccgtggagagattcatcgccatgaacagaggcatcaacgacggcggcgacctgcccgaggagctgctgagaaacctgtacgagagcatcaagaacgagcccttcaagatccccgaggacgacggcaacgacctgacccacaccttcttcaaccccgacagagagggctggctgctgaagctgggcggcagagtgaagacctggaagagaagatggttcatcctgaccgacaactgcctgtactacttcgagtacaccaccgacaaggagcccagaggcatcatccccctggagaacctgagcatcagagaggtggaggacagcaagaagcccaactgcttcgagctgtacatccccgacaacaaggaccaggtgatcaaggcctgcaagaccgaggccgacggcagagtggtggagggcaaccacaccgtgtacagaatcagcgcccccacccccgaggagaaggaggagtggatcaagtgcatcaaggccgccatcagcagagaccccttctacgagatgctggccgccagaaagaagaaggtgagcagcaccaagagacactag

SEQ ID NO: 78349 - DNA, 1197 bp, Artificial Sequence
  Description of Artificial Sequence: Synthetic coding sequence
atggaggaggacgacagctacgtgcccagcgacctgaccgccgaggagagacaggagctggagaacatcagaagaagaaagcaggagctgctggccgacatccagagactgaaggacgagatcgccgaggtggccaacgagatcgagaacctgggcagcaccgaggagagaaagaacatgcagagaaacaagcaggtggccatgggcagaaagaagttcaacatggaccccaagaagggcatccagttcctgatcgagaacgacctgctgaagaacacctgcgaggacatcgcccagttcctgtacaagggcgagggcctgaacaagaccgccatcggcgactacctgggcgagagagacgagttcaacatccaggtgctgcacgccttcgtggagctgcacgagttcaccgacctgaacctggtgcaggccctgagacagttcctgtggagcttcagactgcccggcgaggcccagaagatcgacagaatgatggaggccttcgcccagagatactgccagtgcaacaacggcgtgttccagagcaccgacacctgctacgtgctgagcttcgccatcatcatgctgaacaccagcctgcacaaccccaacgtgaaggacaagcccaccgtggagagattcatcgccatgaacagaggcatcaacgacggcggcgacctgcccgaggagctgctgagaaacctgtacgagagcatcaagaacgagcccttcaagatccccgaggacgacggcaacgacctgacccacaccttcttcaaccccgacagagagggctggctgctgaagctgggcggcggcagagtgaagacctggaagagaagatggttcatcctgaccgacaactgcctgtactacttcgagtacaccaccgacaaggagcccagaggcatcatccccctggagaacctgagcatcagagaggtggaggacagcaagaagcccaactgcttcgagctgtacatccccgacaacaaggaccaggtgatcaaggcctgcaagaccgaggccgacggcagagtggtggagggcaaccacaccgtgtacagaatcagcgcccccacccccgaggagaaggaggagtggatcaagtgcatcaaggccgccatcagcagagaccccttctacgagatgctggccgccagaaagaagaaggtgagcagcaccaagagacactag

SEQ ID NO: 78350 - DNA, 657 bp, Artificial Sequence
  Description of Artificial Sequence: Synthetic coding sequence
atgatggaggccttcgcccagagatactgccagtgcaacaacggcgtgttccagagcaccgacacctgctacgtgctgagcttcgccatcatcatgctgaacaccagcctgcacaaccccaacgtgaaggacaagcccaccgtggagagattcatcgccatgaacagaggcatcaacgacggcggcgacctgcccgaggagctgctgagaaacctgtacgagagcatcaagaacgagcccttcaagatccccgaggacgacggcaacgacctgacccacaccttcttcaaccccgacagagagggctggctgctgaagctggccggcggcagagtgaagacctggaagagaagatggttcatcctgaccgacaactgcctgtactacttcgagtacaccaccgacaaggagcccagaggcatcatccccctggagaacctgagcatcagagaggtggaggacagcaagaagcccaactgcttcgagctgtacatccccgacaacaaggaccaggtgatcaaggcctgcaagaccgaggccgacggcagagtggtggagggcaaccacaccgtgtacagaatcagcgcccccacccccgaggagaaggaggagtggatcaagtgcatcaagttccaggtgagccccggcgagccctag

SEQ ID NO: 78351 - DNA, 1197 bp, Artificial Sequence; identical to SEQ ID NO: 78349
  Description of Artificial Sequence: Synthetic coding sequence

SEQ ID NO: 78352 - DNA, 1020 bp, Artificial Sequence
  Description of Artificial Sequence: Synthetic coding sequence
atgcagagaaacaagcaggtggccatgggcagaaagaagttcaacatggaccccaagaagggcatccagttcctgatcgagaacgacctgctgaagaacacctgcgaggacatcgcccagttcctgtacaagggcgagggcctgaacaagaccgccatcggcgactacctgggcgagagagacgagttcaacatccaggtgctgcacgccttcgtggagctgcacgagttcaccgacctgaacctggtgcaggccctgagacagttcctgtggagcttcagactgcccggcgaggcccagaagatcgacagaatgatggaggccttcgcccagagatactgccagtgcaacaacggcgtgttccagagcaccgacacctgctacgtgctgagcttcgccatcatcatgctgaacaccagcctgcacaaccccaacgtgaaggacaagcccaccgtggagagattcatcgccatgaacagaggcatcaacgacggcggcgacctgcccgaggagctgctgagaaacctgtacgagagcatcaagaacgagcccttcaagatccccgaggacgacggcaacgacctgacccacaccttcttcaaccccgacagagagggctggctgctgaagctgggcggcggcagagtgaagacctggaagagaagatggttcatcctgaccgacaactgcctgtactacttcgagtacaccaccgacaaggagcccagaggcatcatccccctggagaacctgagcatcagagaggtggaggacagcaagaagcccaactgcttcgagctgtacatccccgacaacaaggaccaggtgatcaaggcctgcaagaccgaggccgacggcagagtggtggagggcaaccacaccgtgtacagaatcagcgcccccacccccgaggagaaggaggagtggatcaagtgcatcaaggccgccatcagcagagaccccttctacgagatgctggccgccagaaagaagaaggtgagcagcaccaagagacactag

SEQ ID NO: 78353 - DNA, 1020 bp, Artificial Sequence; identical to SEQ ID NO: 78352
  Description of Artificial Sequence: Synthetic coding sequence

SEQ ID NO: 78354 - DNA, 1080 bp, Artificial Sequence
  Description of Artificial Sequence: Synthetic coding sequence
atgagcctgcagagactgctgcagcacagcagcaacggcaacctggccgacttctgcgccggccccgcctacagcagctacagcaccctgaccggcagcctgaccatggacgacaacagaagaatccagatgctggccgacaccgtggccaccctgcccagaggcagaaagcagctggccctgaccagaagcagcagcctgagcgacttcagctggagccagagaaagctggtgaccgtggagaagcaggacaacgagaccttcggcttcgagatccagagctacagaccccagaaccagaacgcctgcagcagcgagatgttcaccctgatctgcaagatccaggaggacagccccgcccactgcgccggcctgcaggccggcgacgtgctggccaacatcaacggcgtgagcaccgagggcttcacctacaagcaggtggtggacctgatcagaagcagcggcaacctgctgaccatcgagaccctgaacggcaccatgatcctgaagagaaccgagctggaggccaagctgcaggtgctgaagcagaccctgaagcagaagtgggtggagtacagaagcctgcagctgcaggagcacagactgctgcacggcgacgccgccaactgccccagcctggagaacatggacctggacgagctgagcctgttcggccccctgcccggccccggccccgccctggtggacagaaacagactgagcagcgagagcagctgcaagagctggctgagcagcatgaccatggacagcgaggacggctaccagacctgcgtgagcgaggacagcagcagaggcgccttcagcagacagaccagcaccgacgacgagtgcttcatccccaaggagggcgacgacttcctgagaagaagcagcagcagaagaaacagaagcatcagcaacaccagcagcggcagcatgagccccctgtgggagggcaacctgagcagcatgttcggcaccctgcccagaaagagcagaaagggcagcgtgagaaagcagctgctgaagttcatccccggcctgcacagagccgtggaggaggaggagagcagattctag

SEQ ID NO: 78355 - DNA, 762 bp, Artificial Sequence
  Description of Artificial Sequence: Synthetic coding sequence
atgttcaccctgatctgcaagatccaggaggacagccccgcccactgcgccggcctgcaggccggcgacgtgctggccaacatcaacggcgtgagcaccgagggcttcacctacaagcaggtggtggacctgatcagaagcagcggcaacctgctgaccatcgagaccctgaacggcaccatgatcctgaagagaaccgagctggaggccaagctgcaggtgctgaagcagaccctgaagcagaagtgggtggagtacagaagcctgcagctgcaggagcacagactgctgcacggcgacgccgccaactgccccagcctggagaacatggacctggacgagctgagcctgttcggccccctgcccggccccggccccgccctggtggacagaaacagactgagcagcgagagcagctgcaagagctggctgagcagcatgaccatggacagcgaggacggctaccagacctgcgtgagcgaggacagcagcagaggcgccttcagcagacagaccagcaccgacgacgagtgcttcatccccaaggagggcgacgacttcctgagaagaagcagcagcagaagaaacagaagcatcagcaacaccagcagcggcagcatgagccccctgtgggagggcaacctgagcagcatgttcggcaccctgcccagaaagagcagaaagggcagcgtgagaaagcagctgctgaagttcatccccggcctgcacagagccgtggaggaggaggagagcagattctag

SEQ ID NO: 78356 - DNA, 1203 bp, Artificial Sequence
  Description of Artificial Sequence: Synthetic coding sequence
atggaggacggcgtgtacgagccccccgacctgacccccgaggagagaatggagctggagaacatcagaagaagaaagcaggagctgctggtggagatccagagactgagagaggagctgagcgaggccatgagcgaggtggagggcctggaggccaacgagggcagcaagaccctgcagagaaacagaaagatggccatgggcagaaagaagttcaacatggaccccaagaagggcatccagttcctggtggagaacgagctgctgcagaacacccccgaggagatcgccagattcctgtacaagggcgagggcctgaacaagaccgccatcggcgactacctgggcgagagagaggagctgaacctggccgtgctgcacgccttcgtggacctgcacgagttcaccgacctgaacctggtgcaggccctgagacagttcctgtggagcttcagactgcccggcgaggcccagaagatcgacagaatgatggaggccttcgcccagagatactgcctgtgcaaccccggcgtgttccagagcaccgacacctgctacgtgctgagcttcgccgtgatcatgctgaacaccagcctgcacaaccccaacgtgagagacaagcccggcctggagagattcgtggccatgaacagaggcatcaacgagggcggcgacctgcccgaggagctgctgagaaacctgtacgacagcatcagaaacgagcccttcaagatccccgaggacgacggcaacgacctgacccacaccttcttcaaccccgacagagagggctggctgctgaagctggccggcggcagagtgaagacctggaagagaagatggttcatcctgaccgacaactgcctgtactacttcgagtacaccaccgacaaggagcccagaggcatcatccccctggagaacctgagcatcagagaggtggacgaccccagaaagcccaactgcttcgagctgtacatccccaacaacaagggccagctgatcaaggcctgcaagaccgaggccgacggcagagtggtggagggcaaccacatggtgtacagaatcagcgcccccacccaggaggagaaggacgagtggatcaagagcatccaggccgccgtgagcgtggaccccttctacgagatgctggccgccagaaagaagagaatcagcgtgaagaagaagcaggagcagccctag

SEQ ID NO: 78357 - DNA, 1200 bp, Artificial Sequence
  Description of Artificial Sequence: Synthetic coding sequence
atggaggacggcgtgtacgagccccccgacctgacccccgaggagagaatggagctggagaacatcagaagaagaaagcaggagctgctggtggagatccagagactgagagaggagctgagcgaggccatgagcgaggtggagggcctggaggccaacgagggcagcaagaccctgcagagaaacagaaagatggccatgggcagaaagaagttcaacatggaccccaagaagggcatccagttcctggtggagaacgagctgctgcagaacacccccgaggagatcgccagattcctgtacaagggcgagggcctgaacaagaccgccatcggcgactacctgggcgagagagaggagctgaacctggccgtgctgcacgccttcgtggacctgcacgagttcaccgacctgaacctggtgcaggccctgagacagttcctgtggagcttcagactgcccggcgaggcccagaagatcgacagaatgatggaggccttcgcccagagatactgcctgtgcaaccccggcgtgttccagagcaccgacacctgctacgtgctgagcttcgccgtgatcatgctgaacaccagcctgcacaaccccaacgtgagagacaagcccggcctggagagattcgtggccatgaacagaggcatcaacgagggcggcgacctgcccgaggagctgctgagaaacctgtacgacagcatcagaaacgagcccttcaagatccccgaggacgacggcaacgacctgacccacaccttcttcaaccccgacagagagggctggctgctgaagctgggcggcagagtgaagacctggaagagaagatggttcatcctgaccgacaactgcctgtactacttcgagtacaccaccgacaaggagcccagaggcatcatccccctggagaacctgagcatcagagaggtggacgaccccagaaagcccaactgcttcgagctgtacatccccaacaacaagggccagctgatcaaggcctgcaagaccgaggccgacggcagagtggtggagggcaaccacatggtgtacagaatcagcgcccccacccaggaggagaaggacgagtggatcaagagcatccaggccgccgtgagcgtggaccccttctacgagatgctggccgccagaaagaagagaatcagcgtgaagaagaagcaggagcagccctag

SEQ ID NO: 78358 - DNA, 1200 bp, Artificial Sequence
  Description of Artificial Sequence: Synthetic coding sequence
atggacgaggacggcggcggcgagggcggcggcgtgcccgaggacctgagcctggaggagagagaggagctgctggacatcagaagaagaaagaaggagctgatcgacgacatcgagagactgaagtacgagatcgccgaggtgatgaccgagatcgacaacctgaccagcgtggaggagagcaagaccacccagagaaacaagcagatcgccatgggcagaaagaagttcaacatggaccccaagaagggcatccagttcctgatcgagaacgacctgctgcagagcagccccgaggacgtggcccagttcctgtacaagggcgagggcctgaacaagaccgtgatcggcgactacctgggcgagagagacgagttcaacatcaaggtgctgcaggccttcgtggagctgcacgagttcgccgacctgaacctggtgcaggccctgagacagttcctgtggagcttcagactgcccggcgaggcccagaagatcgacagaatgatggaggccttcgccagcagatactgcctgtgcaaccccggcgtgttccagagcaccgacacctgctacgtgctgagcttcgccatcatcatgctgaacaccagcctgcacaaccacaacgtgagagacaagcccaccgccgagagattcatcgccatgaacagaggcatcaacgagggcggcgacctgcccgaggagctgctgagaaacctgtacgagagcatcaagaacgagcccttcaagatccccgaggacgacggcaacgacctgacccacaccttcttcaaccccgacagagagggctggctgctgaagctgggcggcagagtgaagacctggaagagaagatggttcatcctgaccgacaactgcctgtactacttcgagtacaccaccgacaaggagcccagaggcatcatccccctggagaacctgagcatcagagaggtggaggaccccagaaagcccaactgcttcgagctgtacaaccccagccacaagggccaggtgatcaaggcctgcaagaccgaggccgacggcagagtggtggagggcaaccacgtggtgtacagaatcagcgcccccagccccgaggagaaggaggagtggatgaagagcatcaaggccagcatcagcagagaccccttctacgacatgctggccaccagaaagagaagaatcgccaacaagaagtag

SEQ ID NO: 78359 - DNA, 945 bp, Artificial Sequence
  Description of Artificial Sequence: Synthetic coding sequence
atggccctgccccagctgcagaccgccatgctggccgccttcctgtgggaccccagagacgtggtgctgaccgcccagcccggcgccgagcagtgcgccgagagcagccagcacatcagaatcctgcagccccagttcagactgatcagactgagattctggaagctgtacatccagagaagagtgcaggcctggcagttcctgtggagcttcagactgcccggcgaggcccagaagatcgacagaatgatggaggccttcgccagcagatactgcctgtgcaaccccggcgtgttccagagcaccgacacctgctacgtgctgagcttcgccatcatcatgctgaacaccagcctgcacaaccacaacgtgagagacaagcccaccgccgagagattcatcgccatgaacagaggcatcaacgagggcggcgacctgcccgaggagctgctgagaaacctgtacgagagcatcaagaacgagcccttcaagatccccgaggacgacggcaacgacctgacccacaccttcttcaaccccgacagagagggctggctgctgaagctgggcggcagagtgaagacctggaagagaagatggttcatcctgaccgacaactgcctgtactacttcgagtacaccaccgacaaggagcccagaggcatcatccccctggagaacctgagcatcagagaggtggaggaccccagaaagcccaactgcttcgagctgtacaaccccagccacaagggccaggtgatcaaggcctgcaagaccgaggccgacggcagagtggtggagggcaaccacgtggtgtacagaatcagcgcccccagccccgaggagaaggaggagtggatgaagagcatcaaggccagcatcagcagagaccccttctacgacatgctggccaccagaaagagaagaatcgccaacaagaagtag

SEQ ID NO: 78360 - DNA, 1185 bp, Artificial Sequence
  Description of Artificial Sequence: Synthetic coding sequence
atggacctgtgccaccccgagcccgccgagctgagcagcggcgagaccgaggagctgcagagaatcaagtggcacagaaagcagctgctggaggacatccagaagctgaaggacgagatcgccgacgtgttcgcccagatcgactgcttcgagagcgccgaggagagcagaatggcccagaaggagaaggagctgtgcatcggcagaaagaagttcaacatggaccccgccaagggcatccagtacttcatcgagcacaagctgctgacccccgacgtgcaggacatcgccagattcctgtacaagggcgagggcctgaacaagaccgccatcggcacctacctgggcgagagagaccccatcaacctgcaggtgctgcaggccttcgtggactgccacgagttcgccaacctgaacctggtgcaggccctgagacagttcctgtggagcttcagactgcccggcgaggcccagaagatcgacagaatgatggaggccttcgccaccagatactgcctgtgcaaccccggcgtgttccagagcaccgacacctgctacgtgctgagcttcagcatcatcatgctgaacaccagcctgcacaaccccaacgtgagagacagaccccccttcgagagattcgtgagcatgaacagaggcatcaacaacggcagcgacctgcccgaggaccagctgagaaacctgttcgacagcatcaagagcgagcccttcagcatccccgaggacgacggcaacgacctgacccacaccttcttcaaccccgacagagagggctggctgctgaagctgggcggcagagtgaagacctggaagagaagatggttcatcctgaccgacaactgcctgtactacttcgagttcaccaccgacaaggagcccagaggcatcatccccctggagaacctgagcgtgcagaaggtggacgaccccaagaagcccttctgcctggagctgtacaaccccagctgcagaggccagaagatcaaggcctgcaagaccgacggcgacggcagagtggtggagggcaagcacgagagctacagaatcagcgccaccagcgccgaggagagagaccagtggatcgagagcatcagagccagcatcaccagagtgcccttctacgacctggtgagcaccagaaagaagaagatcgccagcaagcagtag

SEQ ID NO: 78361 - DNA, 474 bp, Artificial Sequence
  Description of Artificial Sequence: Synthetic coding sequence
atggacctgtgccaccccgagcccgccgagctgagcagcggcgagaccgaggagctgcagagaatcaagtggcacagaaagcagctgctggaggacatccagaagctgaaggacgagatcgccgacgtgttcgcccagatcgactgcttcgagagcgccgaggagagcagaatggcccagaaggagaaggagctgtgcatcggcagaaagaagttcaacatggaccccgccaagggcatccagtacttcatcgagcacaagctgctgacccccgacgtgcaggacatcgccagattcctgtacaagggcgagggcctgaacaagaccgccatcggcacctacctgggcgagagagaccccatcaacctgcaggtgctgcaggccttcgtggactgccacgagttcgccaacctgaacctggtgcaggccctgagattcagagagggcgccagcgacctgggcttcggcggctag

SEQ ID NO: 78362 - DNA, 876 bp, Artificial Sequence
  Description of Artificial Sequence: Synthetic coding sequence
gacagaagcaccggccacctgttccccagaggcgtgggcatggacctgtgccaccccgagcccgccgagctgagcagcggcgagaccgaggagctgcagagaatcaagtggcacagaaagcagctgctggaggacatccagaagctgaaggacgagatcgccgacgtgttcgcccagatcgactgcttcgagagcgccgaggagagcagaatggcccagaaggagaaggagctgtgcatcggcagaaagaagttcaacatggaccccgccaagggcatccagtacttcatcgagcacaagctgctgacccccgacgtgcaggacatcgccagattcctgtacaagggcgagggcctgaacaagaccgccatcggcacctacctgggcgagagagaccccatcaacctgcaggtgctgcaggccttcgtggactgccacgagttcgccaacctgaacctggtgcaggccctgagacagttcctgtggagcttcagactgcccggcgaggcccagaagatcgacagaatgatggaggccttcgccaccagatactgcctgtgcaaccccggcgtgttccagagcaccgacacctgctacgtgctgagcttcagcatcatcatgctgaacaccagcctgcacaaccccaacgtgagagacagaccccccttcgagagattcgtgagcatgaacagaggcatcaacaacggcagcgacctgcccgaggaccagctgagagtgacctgggagtgcagccagagaagaagcagagagagaaccttccagaaggaggaggtggccagaaccgaggcctgccccgactgggagagaagaggcgtgcagtgcggcagagagcccctgagacagcaccaggagtag

SEQ ID NO: 78363 - DNA, 444 bp, Artificial Sequence
  Description of Artificial Sequence: Synthetic coding sequence
tgaacccacaccagcggcagcctgagcagcagagacagccaggccggcgacagcgccagcagagccggcggcagagtgaagacctggaagagaagatggttcatcctgaccgacaactgcctgtactacttcgagttcaccaccgacaaggagcccagaggcatcatccccctggagaacctgagcgtgcagaaggtggacgaccccaagaagcccttctgcctggagctgtacaaccccagctgcagaggccagaagatcaaggcctgcaagaccgacggcgacggcagagtggtggagggcaagcacgagagctacagaatcagcgccaccagcgccgaggagagagaccagtggatcgagagcatcagagccagcatcaccagagtgcccttctacgacctggtgagcaccagaaagaagaagatcgccagcaagcagtag

SEQ ID NO: 78364 - DNA, 354 bp, Artificial Sequence
  Description of Artificial Sequence: Synthetic coding sequence
atggacctgtgccaccccgagcccgccgagctgagcagcggcgagaccgaggagctgcagagaatcaagtggcacagaaagcagctgctggaggacatccagaagctgaaggacgagatcgccgacgtgttcgcccagatcgactgcttcgagagcgccgaggagagcagaatggcccagaaggagaaggagctgtgcatcggcagaaagaagttcaacatggaccccgccaagggcatccagtacttcatcgagcacaagctgctgacccccgacgtgcaggacatcgccagattcctgtacaagggcgagggcctgaacaagaccgccatcggcacctacctgggcgagtag

SEQ ID NO: 78365 - DNA, 777 bp, Artificial Sequence
  Description of Artificial Sequence: Synthetic coding sequence
atggtgctgtgcgtgcagggccccagacccctgctggccgtggagagaaccggccagagacccctgtgggcccccagcctggagctgcccaagcccgtgatgcagcccctgcccgccggcgccttcctggaggaggtggccgagggcacccccgcccagaccgagagcgagcccaaggtgctggaccccgaggaggacctgctgtgcatcgccaagaccttcagctacctgagagagagcggctggtactggggcagcatcaccgccagcgaggccagacagcacctgcagaagatgcccgagggcaccttcctggtgagagacagcacccaccccagctacctgttcaccctgagcgtgaagaccaccagaggccccaccaacgtgagaatcgagtacgccgacagcagcttcagactggacagcaactgcctgagcagacccagaatcctggccttccccgacgtggtgagcctggtgcagcactacgtggccagctgcaccgccgacaccagaagcgacagccccgaccccgcccccacccccgccctgcccatgcccaaggaggacgcccccagcgaccccgccctgcccgcccccccccccgccaccgccgtgcacctgaagctggtgcagcccttcgtgagaagaagcagcgccagaagcctgcagcacctgtgcagactggtgatcaacagactggtggccgacgtggactgcctgcccctgcccagaagaatggccgactacctgagacagtaccccttccagctgtag

SEQ ID NO: 78366 - DNA, 828 bp, Artificial Sequence
  Description of Artificial Sequence: Synthetic coding sequence
atgtacctggagcacaccagccactgcccccaccacgacgacgacaccgccatggacacccccctgcccagacccagacccctgctggccgtggagagaaccggccagagacccctgtgggcccccagcctggagctgcccaagcccgtgatgcagcccctgcccgccggcgccttcctggaggaggtggccgagggcacccccgcccagaccgagagcgagcccaaggtgctggaccccgaggaggacctgctgtgcatcgccaagaccttcagctacctgagagagagcggctggtactggggcagcatcaccgccagcgaggccagacagcacctgcagaagatgcccgagggcaccttcctggtgagagacagcacccaccccagctacctgttcaccctgagcgtgaagaccaccagaggccccaccaacgtgagaatcgagtacgccgacagcagcttcagactggacagcaactgcctgagcagacccagaatcctggccttccccgacgtggtgagcctggtgcagcactacgtggccagctgcaccgccgacaccagaagcgacagccccgaccccgcccccacccccgccctgcccatgcccaaggaggacgcccccagcgaccccgccctgcccgcccccccccccgccaccgccgtgcacctgaagctggtgcagcccttcgtgagaagaagcagcgccagaagcctgcagcacctgtgcagactggtgatcaacagactggtggccgacgtggactgcctgcccctgcccagaagaatggccgactacctgagacagtaccccttccagctgtag

SEQ ID NO: 78367 - DNA, 1269 bp, Artificial Sequence
  Description of Artificial Sequence: Synthetic coding sequence
atgcccgccggcagaagaggccccgccgcccagagcgccagaagacccccccccctgctgcccctgctgctgctgctgtgcgtgctgggcgcccccagagccggcagcggcgcccacaccgccgtgatcagcccccaggaccccaccctgctgatcggcagcagcctgctggccacctgcagcgtgcacggcgacccccccggcgccaccgccgagggcctgtactggaccctgaacggcagaagactgccccccgagctgagcagagtgctgaacgccagcaccctggccctggccctggccaacctgaacggcagcagacagagaagcggcgacaacctggtgtgccacgccagagacggcagcatcctggccggcagctgcctgtacgtgggcctgccccccgagaagcccgtgaacatcagctgctggagcaagaacatgaaggacctgacctgcagatggacccccggcgcccacggcgagaccttcctgcacaccaactacagcctgaagtacaagctgagatggtacggccaggacaacacctgcgaggagtaccacaccgtgggcccccacagctgccacatccccaaggacctggccctgttcaccccctacgagatctgggtggaggccaccaacagactgggcagcgccagaagcgacgtgctgaccctggacatcctggacgtggtgaccaccgaccccccccccgacgtgcacgtgagcagagtgggcggcctggaggaccagctgagcgtgagatgggtgagcccccccgccctgaaggacttcctgttccaggccaagtaccagatcagatacagagtggaggacagcgtggactggaaggtggtggacgacgtgagcaaccagaccagctgcagactggccggcctgaagcccggcaccgtgtacttcgtgcaggtgagatgcaaccccttcggcatctacggcagcaagaaggccggcatctggagcgagtggagccaccccaccgccgccagcacccccagaagcgagagacccggccccggcggcggcgcctgcgagcccagaggcggcgagcccagcagcggccccgtgagaagagagctgaagcagttcctgggctggctgaagaagcacgcctactgcagcaacctgagcttcagactgtacgaccagtggagagcctggatgcagaagagccacaagaccagaaaccaggacgagggcatcctgcccagcggcagaagaggcaccgccagaggccccgccagatag

SEQ ID NO: 78368 - DNA, 702 bp, Artificial Sequence
  Description of Artificial Sequence: Synthetic coding sequence
atgggcagactggtgctgctgtggggcgccgccgtgttcctgctgggcggctggatggccctgggccagggcggcgccgccgagggcgtgcagatccagatcatctacttcaacctggagaccgtgcaggtgacctggaacgccagcaagtacagcagaaccaacctgaccttccactacagattcaacggcgacgaggcctacgaccagtgcaccaactacctgctgcaggagggccacaccagcggctgcctgctggacgccgagcagagagacgacatcctgtacttcagcatcagaaacggcacccaccccgtgttcaccgccagcagatggatggtgtactacctgaagcccagcagccccaagcacgtgagattcagctggcaccaggacgccgtgaccgtgacctgcagcgacctgagctacggcgacctgctgtacgaggtgcagtacagaagccccttcgacaccgagtggcagacccagagcagaagcgtgacccaggccggcgtgcagtggtgcgacctgtgcctgctgcagcccagcccccccagattcaagagattcagctgcctgagcctgcccagcagctgggactacagacaccccccccccagactggccaacttctgcatcatcagcagagacggcgtgagcccctgctggcccggctggagcagaacctgcgacctgagatag

SEQ ID NO: 78369 - DNA, 771 bp, Artificial Sequence
  Description of Artificial Sequence: Synthetic coding sequence
atgggcagactggtgctgctgtggggcgccgccgtgttcctgctgggcggctggatggccctgggccagggcggcgccgccgagggcgtgcagatccagatcatctacttcaacctggagaccgtgcaggtgacctggaacgccagcaagtacagcagaaccaacctgaccttccactacagattcaacggcgacgaggcctacgaccagtgcaccaactacctgctgcaggagggccacaccagcggctgcctgctggacgccgagcagagagacgacatcctgtacttcagcatcagaaacggcacccaccccgtgttcaccgccagcagatggatggtgtactacctgaagcccagcagccccaagcacgtgagattcagctggcaccaggacgccgtgaccgtgacctgcagcgacctgagctacggcgacctgctgtacgaggtgcagtacagaagccccttcgacaccgagtggcagagcaagcaggagaacacctgcaacgtgaccatcgagggcctggacgccgagaagtgctacagcttctgggtgagagtgaaggccatggaggacgtgtacggccccgacacctaccccagcgactggagcgaggtgacctgctggcagagaggcgagatcagagacgcctgcgccgagacccccaccccccccaagcccaagctgagcaagttcatcctgatcagcagcctggccatcctgctgatggtgagcctgctgctgctgagcctgtggaagctgtggagatag

SEQ ID NO: 78370 - DNA, 768 bp, Artificial Sequence
  Description of Artificial Sequence: Synthetic coding sequence
atgggcagactggtgctgctgtggggcgccgccgtgttcctgctgggcggctggatggccctgggccagggcggcgccgccgagggcgtgcagatccagatcatctacttcaacctggagaccgtgcaggtgacctggaacgccagcaagtacagcagaaccaacctgaccttccactacagattcaacggcgacgaggcctacgaccagtgcaccaactacctgctgcaggagggccacaccagcggctgcctgctggacgccgagcagagagacgacatcctgtacttcagcatcagaaacggcacccaccccgtgttcaccgccagcagatggatggtgtactacctgaagcccagcagccccaagcacgtgagattcagctggcaccaggacgccgtgaccgtgacctgcagcgacctgagctacggcgacctgctgtacgaggtgcagtacagaagccccttcgacaccgagtggcagagcaagcaggagaacacctgcaacgtgaccatcgagggcctggacgccgagaagtgctacagcttctgggtgagagtgaaggccatggaggacgtgtacggccccgacacctaccccagcgactggagcgaggtgacctgctggcagagaggcgagatcagagacgcctgcgccgagacccccaccccccccaagcccaagctgagcaagttcatcctgatcagcagcctggccatcctgctgatggtgagcctgctgctgctgagcctgtggaagctgtggtag

SEQ ID NO: 78371 - DNA, 411 bp, Artificial Sequence
  Description of Artificial Sequence: Synthetic coding sequence
atgagaacccccggccccctgcccgtgctgctgctgctgctggccggcgcccccgccgccagacccaccccccccacctgctacagcagaatgagagccctgagccaggagatcaccagagacttcaacctgctgcaggtgagcgagcccagcgagccctgcgtgagatacctgcccagactgtacctggacatccacaactactgcgtgctggacaagctgagagacttcgtggccagccccccctgctggaaggtggcccaggtggacagcctgaaggacaaggccagaaagctgtacaccatcatgaacagcttctgcagaagagacctggtgttcctgctggacgactgcaacgccctggagtaccccatccccgtgaccaccgtgctgcccgacagacagagatag

SEQ ID NO: 78372 - DNA, 3762 bp, Artificial Sequence
  Description of Artificial Sequence: Synthetic coding sequence
atggccgcccaggtgaccctggaggacgccctgagcaacgtggacctgctggaggagctgcccctgcccgaccagcagccctgcatcgagcccccccccagcagcctgctgtaccagcccaacttcaacaccaacttcgaggacagaaacgccttcgtgaccggcatcgccagatacatcgagcaggccaccgtgcacagcagcatgaacgagatgctggaggagggccaggagtacgccgtgatgctgtacacctggagaagctgcagcagagccatcccccaggtgaagtgcaacgagcagcccaacagagtggagatctacgagaagaccgtggaggtgctggagcccgaggtgaccaagctgatgaacttcatgtacttccagagaaacgccatcgagagattctgcggcgaggtgagaagactgtgccacgccgagagaagaaaggacttcgtgagcgaggcctacctgatcaccctgggcaagttcatcaacatgttcgccgtgctggacgagctgaagaacatgaagtgcagcgtgaagaacgaccacagcgcctacaagagagccgcccagttcctgagaaagatggccgacccccagagcatccaggagagccagaacctgagcatgttcctggccaaccacaacaagatcacccagagcctgcagcagcagctggaggtgatcagcggctacgaggagctgctggccgacatcgtgaacctgtgcgtggactactacgagaacagaatgtacctgacccccagcgagaagcacatgctgctgaaggtgatgggcttcggcctgtacctgatggacggcagcgtgagcaacatctacaagctggacgccaagaagagaatcaacctgagcaagatcgacaagtacttcaagcagctgcaggtggtgcccctgttcggcgacatgcagatcgagctggccagatacatcaagaccagcgcccactacgaggagaacaagagcagatggacctgcaccagcagcggcagcagcccccagtacaacatctgcgagcagatgatccagatcagagaggaccacatgagattcatcagcgagctggccagatacagcaacagcgaggtggtgaccggcagcggcagacaggaggcccagaagaccgacgccgagtacagaaagctgttcgacctggccctgcagggcctgcagctgctgagccagtggagcgcccacgtgatggaggtgtacagctggaagctggtgcaccccaccgacaagtacagcaacaaggactgccccgacagcgccgaggagtacgagagagccaccagatacaactacaccagcgaggagaagttcgccctggtggaggtgatcgccatgatcaagggcctgcaggtgctgatgggcagaatggagagcgtgttcaaccacgccatcagacacaccgtgtacgccgccctgcaggacttcagccaggtgaccctgagagagcccctgagacaggccatcaagaagaagaagaacgtgatccagagcgtgctgcaggccatcagaaagaccgtgtgcgactgggagaccggccacgagcccttcaacgaccccgccctgagaggcgagaaggaccccaagagcggcttcgacatcaaggtgcccagaagagccgtgggccccagcagcacccagctgtacatggtgagaaccatgctggagagcctgatcgccgacaagagcggcagcaagaagaccctgagaagcagcctggagggccccaccatcctggacatcgagaagttccacagagagagcttcttctacacccacctgatcaacttcagcgagaccctgcagcagtgctgcgacctgagccagctgtggttcagagagttcttcctggagctgaccatgggcagaagaatccagttccccatcgagatgagcatgccctggatcctgaccgaccacatcctggagaccaaggaggccagcatgatggagtacgtgctgtacagcctggacctgtacaacgacagcgcccactacgccctgaccagattcaacaagcagttcctgtacgacgagatcgaggccgaggtgaacctgtgcttcgaccagttcgtgtacaagctggccgaccagatcttcgcctactacaaggtgatggccggcagcctgctgctggacaagagactgagaagcgagtgcaagaaccagggcgccaccatccacctgccccccagcaacagatacgagaccctgctgaagcagagacacgtgcagctgctgggcagaagcatcgacctgaacagactgatcacccagagagtgagcgccgccatgtacaagagcctggagctggccatcggcagattcgagagcgaggacctgaccagcatcgtggagctggacggcctgctggagatcaacagaatgacccacaagctgctgagcagatacctgaccctggacggcttcgacgccatgttcagagaggccaaccacaacgtgagcgccccctacggcagaatcaccctgcacgtgttctgggagctgaactacgacttcctgcccaactactgctacaacggcagcaccaacagattcgtgagaaccgtgctgcccttcagccaggagttccagagagacaagcagcccaacgcccagccccagtacctgcacggcagcaaggccctgaacctggcctacagcagcatctacggcagctacagaaacttcgtgggccccccccacttccaggtgatctgcagactgctgggctaccagggcatcgccgtggtgatggaggagctgctgaaggtggtgaagagcctgctgcagggcaccatcctgcagtacgtgaagaccctgatggaggtgatgcccaagatctgcagactgcccagacacgagtacggcagccccggcatcctggagttcttccaccaccagctgaaggacatcgtggagtacgccgagctgaagaccgtgtgcttccagaacctgagagaggtgggcaacgccatcctgttctgcctgctgatcgagcagagcctgagcctggaggaggtgtgcgacctgctgcacgccgcccccttccagaacatcctgcccagagtgcacgtgaaggagggcgagagactggacgccaagatgaagagactggagagcaagtacgcccccctgcacctggtgcccctgatcgagagactgggcaccccccagcagatcgccatcgccagagagggcgacctgctgaccaaggagagactgtgctgcggcctgagcatgttcgaggtgatcctgaccagaatcagaagcttcctggacgaccccatctggagaggccccctgcccagcaacggcgtgatgcacgtggacgagtgcgtggagttccacagactgtggagcgccatgcagttcgtgtactgcatccccgtgggcacccacgagttcaccgtggagcagtgcttcggcgacggcctgcactgggccggctgcatgatcatcgtgctgctgggccagcagagaagattcgccgtgctggacttctgctaccacctgctgaaggtgcagaagcacgacggcaaggacgagatcatcaagaacgtgcccctgaagaagatggtggagagaatcagaaagttccagatcctgaacgacgagatcatcaccatcctggacaagtacctgaagagcggcgacggcgagggcacccccgtggagcacgtgagatgcttccagccccccatccaccagagcctggccagcagctag

SEQ ID NO: 78373 - DNA, 3768 bp, Artificial Sequence
  Description of Artificial Sequence: Synthetic coding sequence
atgggccccaagcacgtgctgagacagcccggccccagcgagagacaccaccccgaggtgcccgcctggacccccagagccggccccccctgctggctgtgcagacagagatggggctggaccctgcacccccccggcagaggctgccccgccctgctgctgagcgagcccagaatggccgcccaggtgaccctggaggacgccctgagcaacgtggacctgctggaggagctgcccctgcccgaccagcagccctgcatcgagcccccccccagcagcctgctgtaccagaacgagatgctggaggagggccaggagtacgccgtgatgctgtacacctggagaagctgcagcagagccatcccccaggtgaagtgcaacgagcagcccaacagagtggagatctacgagaagaccgtggaggtgctggagcccgaggtgaccaagctgatgaacttcatgtacttccagagaaacgccatcgagagattctgcggcgaggtgagaagactgtgccacgccgagagaagaaaggacttcgtgagcgaggcctacctgatcaccctgggcaagttcatcaacatgttcgccgtgctggacgagctgaagaacatgaagtgcagcgtgaagaacgaccacagcgcctacaagagagccgcccagttcctgagaaagatggccgacccccagagcatccaggagagccagaacctgagcatgttcctggccaaccacaacaagatcacccagagcctgcagcagcagctggaggtgatcagcggctacgaggagctgctggccgacatcgtgaacctgtgcgtggactactacgagaacagaatgtacctgacccccagcgagaagcacatgctgctgaaggtgatgggcttcggcctgtacctgatggacggcagcgtgagcaacatctacaagctggacgccaagaagagaatcaacctgagcaagatcgacaagtacttcaagcagctgcaggtggtgcccctgttcggcgacatgcagatcgagctggccagatacatcaagaccagcgcccactacgaggagaacaagagcagatggacctgcaccagcagcggcagcagcccccagtacaacatctgcgagcagatgatccagatcagagaggaccacatgagattcatcagcgagctggccagatacagcaacagcgaggtggtgaccggcagcggcagacaggaggcccagaagaccgacgccgagtacagaaagctgttcgacctggccctgcagggcctgcagctgctgagccagtggagcgcccacgtgatggaggtgtacagctggaagctggtgcaccccaccgacaagtacagcaacaaggactgccccgacagcgccgaggagtacgagagagccaccagatacaactacaccagcgaggagaagttcgccctggtggaggtgatcgccatgatcaagggcctgcaggtgctgatgggcagaatggagagcgtgttcaaccacgccatcagacacaccgtgtacgccgccctgcaggacttcagccaggtgaccctgagagagcccctgagacaggccatcaagaagaagaagaacgtgatccagagcgtgctgcaggccatcagaaagaccgtgtgcgactgggagaccggccacgagcccttcaacgaccccgccctgagaggcgagaaggaccccaagagcggcttcgacatcaaggtgcccagaagagccgtgggccccagcagcacccagctgtacatggtgagaaccatgctggagagcctgatcgccgacaagagcggcagcaagaagaccctgagaagcagcctggagggccccaccatcctggacatcgagaagttccacagagagagcttcttctacacccacctgatcaacttcagcgagaccctgcagcagtgctgcgacctgagccagctgtggttcagagagttcttcctggagctgaccatgggcagaagaatccagttccccatcgagatgagcatgccctggatcctgaccgaccacatcctggagaccaaggaggccagcatgatggagtacgtgctgtacagcctggacctgtacaacgacagcgcccactacgccctgaccagattcaacaagcagttcctgtacgacgagatcgaggccgaggtgaacctgtgcttcgaccagttcgtgtacaagctggccgaccagatcttcgcctactacaaggtgatggccggcagcctgctgctggacaagagactgagaagcgagtgcaagaaccagggcgccaccatccacctgccccccagcaacagatacgagaccctgctgaagcagagacacgtgcagctgctgggcagaagcatcgacctgaacagactgatcacccagagagtgagcgccgccatgtacaagagcctggagctggccatcggcagattcgagagcgaggacctgaccagcatcgtggagctggacggcctgctggagatcaacagaatgacccacaagctgctgagcagatacctgaccctggacggcttcgacgccatgttcagagaggccaaccacaacgtgagcgccccctacggcagaatcaccctgcacgtgttctgggagctgaactacgacttcctgcccaactactgctacaacggcagcaccaacagattcgtgagaaccgtgctgcccttcagccaggagttccagagagacaagcagcccaacgcccagccccagtacctgcacggcagcaaggccctgaacctggcctacagcagcatctacggcagctacagaaacttcgtgggccccccccacttccaggtgatctgcagactgctgggctaccagggcatcgccgtggtgatggaggagctgctgaaggtggtgaagagcctgctgcagggcaccatcctgcagtacgtgaagaccctgatggaggtgatgcccaagatctgcagactgcccagacacgagtacggcagccccggcatcctggagttcttccaccaccagctgaaggacatcgtggagtacgccgagctgaagaccgtgtgcttccagaacctgcacgccgcccccttccagaacatcctgcccagagtgcacgtgaaggagggcgagagactggacgccaagatgaagagactggagagcaagtacgcccccctgcacctggtgcccctgatcgagagactgggcaccccccagcagatcgccatcgccagagagggcgacctgctgaccaaggagagactgtgctgcggcctgagcatgttcgaggtgatcctgaccagaatcagaagcttcctggacgaccccatctggagaggccccctgcccagcaacggcgtgatgcacgtggacgagtgcgtggagttccacagactgtggagcgccatgcagttcgtgtactgcatccccgtgggcacccacgagttcaccgtggagcagtgcttcggcgacggcctgcactgggccggctgcatgatcatcgtgctgctgggccagcagagaagattcgccgtgctggacttctgctaccacctgctgaaggtgcagaagcacgacggcaaggacgagatcatcaagaacgtgcccctgaagaagatggtggagagaatcagaaagttccagatcctgaacgacgagatcatcaccatcctggacaagtacctgaagagcggcgacggcgagggcacccccgtggagcacgtgagatgcttccagccccccatccaccagagcctggccagcagctag

SEQ ID NO: 78374 - DNA, 2469 bp, Artificial Sequence
  Description of Artificial Sequence: Synthetic coding sequence
atggccgagagcctgggcagcgccgagctgctgagacagctgaagagcctgggcatggagagactgctgcacgccgtgaacaccttcctgagacagagctgcacctacctgcccctgctgaccttcggcggcaagaccagcttcgtgagcctggacgtgtacggcaccgaggccaactgcagcgccaccagctgcagcttccccaaggccgccgccacctggcccagaagacaggcccccggccccctgggcgagctggtgagaggcccccccgaccagggcgtggccgagcagagcttcagccacggcctgttcgagttcggcatcaccaacgtgccctgcatcttcagccccccccagatgttcccctggatcatccagctgtacatggtgagaaccatgctggagagcctgatcgccgacaagagcggcagcaagaagaccctgagaagcagcctggagggccccaccatcctggacatcgagaagttccacagagagagcttcttctacacccacctgatcaacttcagcgagaccctgcagcagtgctgcgacctgagccagctgtggttcagagagttcttcctggagctgaccatgggcagaagaatccagttccccatcgagatgagcatgccctggatcctgaccgaccacatcctggagaccaaggaggccagcatgatggagtacgtgctgtacagcctggacctgtacaacgacagcgcccactacgccctgaccagattcaacaagcagttcctgtacgacgagatcgaggccgaggtgaacctgtgcttcgaccagttcgtgtacaagctggccgaccagatcttcgcctactacaaggtgatggccggcagcctgctgctggacaagagactgagaagcgagtgcaagaaccagggcgccaccatccacctgccccccagcaacagatacgagaccctgctgaagcagagacacgtgcagctgctgggcagaagcatcgacctgaacagactgatcacccagagagtgagcgccgccatgtacaagagcctggagctggccatcggcagattcgagagcgaggacctgaccagcatcgtggagctggacggcctgctggagatcaacagaatgacccacaagctgctgagcagatacctgaccctggacggcttcgacgccatgttcagagaggccaaccacaacgtgagcgccccctacggcagaatcaccctgcacgtgttctgggagctgaactacgacttcctgcccaactactgctacaacggcagcaccaacagattcgtgagaaccgtgctgcccttcagccaggagttccagagagacaagcagcccaacgcccagccccagtacctgcacggcagcaaggccctgaacctggcctacagcagcatctacggcagctacagaaacttcgtgggccccccccacttccaggtgatctgcagactgctgggctaccagggcatcgccgtggtgatggaggagctgctgaaggtggtgaagagcctgctgcagggcaccatcctgcagtacgtgaagaccctgatggaggtgatgcccaagatctgcagactgcccagacacgagtacggcagccccggcatcctggagttcttccaccaccagctgaaggacatcgtggagtacgccgagctgaagaccgtgtgcttccagaacctgagagaggtgggcaacgccatcctgttctgcctgctgatcgagcagagcctgagcctggaggaggtgtgcgacctgctgcacgccgcccccttccagaacatcctgcccagagtgcacgtgaaggagggcgagagactggacgccaagatgaagagactggagagcaagtacgcccccctgcacctggtgcccctgatcgagagactgggcaccccccagcagatcgccatcgccagagagggcgacctgctgaccaaggagagactgtgctgcggcctgagcatgttcgaggtgatcctgaccagaatcagaagcttcctggacgaccccatctggagaggccccctgcccagcaacggcgtgatgcacgtggacgagtgcgtggagttccacagactgtggagcgccatgcagttcgtgtactgcatccccgtgggcacccacgagttcaccgtggagcagtgcttcggcgacggcctgcactgggccggctgcatgatcatcgtgctgctgggccagcagagaagattcgccgtgctggacttctgctaccacctgctgaaggtgcagaagcacgacggcaaggacgagatcatcaagaacgtgcccctgaagaagatggtggagagaatcagaaagttccagatcctgaacgacgagatcatcaccatcctggacaagtacctgaagagcggcgacggcgagggcacccccgtggagcacgtgagatgcttccagccccccatccaccagagcctggccagcagctag

SEQ ID NO: 78375 - DNA, 3762 bp, Artificial Sequence; identical to SEQ ID NO: 78372
  Description of Artificial Sequence: Synthetic coding sequence

SEQ ID NO: 78376 - DNA, 486 bp, Artificial Sequence
  Description of Artificial Sequence: Synthetic coding sequence
atggccgcccaggtgaccctggaggacgccctgagcaacgtggacctgctggaggagctgcccctgcccgaccagcagccctgcatcgagcccccccccagcagcctgctgtaccagcccaacttcaacaccaacttcgaggacagaaacgccttcgtgaccggcatcgccagatacatcgagcaggccaccgtgcacagcagcatgaacgagatgctggaggagggccaggagtacgccgtgatgctgtacacctggagaagctgcagcagagccatcccccaggtgaagtgcaacgagcagcccaacagagtggagatctacgagaagaccgtggaggtgctggagcccgaggtgaccaagctgatgaacttcatgtacttccagagaaacgccatcgagagattctgcggcgaggtgagaagactgtgccacgccgagagaagaaaggacttcgtgagcgaggcctacctgatcaccctgtag

SEQ ID NO: 78377 - DNA, 456 bp, Artificial Sequence
  Description of Artificial Sequence: Synthetic coding sequence
atggccgcccaggtgaccctggaggacgccctgagcaacgtggacctgctggaggagctgcccctgcccgaccagcagccctgcatcgagcccccccccagcagcctgctgtaccagcccaacttcaacaccaacttcgaggacagaaacgccttcgtgaccggcatcgccagatacatcgagcaggccaccgtgcacagcagcatgaacgagatgctggaggagggccaggagtacgccgtgatgctgtacacctggagaagctgcagcagagccatcccccaggtgaagtgcaacgagcagcccaacagagtggagatctacgagaagaccgtggaggtgctggagcccgaggtgaccaagctgatgaacttcatgtacttccagagaaacgccatcgagagattctgcggcgaggtgagaagactgtgccacgccgagagaagaaaggactag

SEQ ID NO: 78378 - DNA, 3837 bp, Artificial Sequence
  Description of Artificial Sequence: Synthetic coding sequence
atgaccacccacgtgaccctggaggacgccctgagcaacgtggacctgctggaggagctgcccctgcccgaccagcagccctgcatcgagcccccccccagcagcatcatgtaccaggccaacttcgacaccaacttcgaggacagaaacgccttcgtgaccggcatcgccagatacatcgagcaggccaccgtgcacagcagcatgaacgagatgctggaggagggccacgagtacgccgtgatgctgtacacctggagaagctgcagcagagccatccccagagtgaagtgcaacgagcagcccaacagagtggagatctacgagaagaccgtggaggtgctggagcccgaggtgaccaagctgatgaagttcatgtacttccagagaaaggccatcgagagattctgcagcgaggtgaagagactgtgccacgccgagagaagaaaggacttcgtgagcgaggcctacctgctgaccctgggcaagttcatcaacatgttcgccgtgctggacgagctgaagaacatgaagtgcagcgtgaagaacgaccacagcgcctacaagagagccgcccagttcctgagaaagatggccgacccccagagcatccaggagagccagaacctgagcatgttcctggccaaccacaacagaatcacccagtgcctgcaccagcagctggaggtgatccccggctacgaggagctgctggccgacatcgtgaacatctgcgtggactactacgagaacaagatgtacctgacccccagcgagaagcacatgctgctgaaggtgatgggcttcggcctgtacctgatggacggcaacgtgagcaacatctacaagctggacgccaagaagagaatcaacctgagcaagatcgacaagttcttcaagcagctgcaggtggtgcccctgttcggcgacatgcagatcgagctggccagatacatcaagaccagcgcccactacgaggagaacaagagcaagtggacctgcacccagagcagcatcagcccccagtacaacatctgcgagcagatggtgcagatcagagacgaccacatcagattcatcagcgagctggccagatacagcaacagcgaggtggtgaccggcagcggcctggacagccagaagagcgacgaggagtacagagagctgttcgacctggccctgagaggcctgcagctgctgagcaagtggagcgcccacgtgatggaggtgtacagctggaagctggtgcaccccaccgacaagttctgcaacaaggactgccccggcaccgccgaggagtacgagagagccaccagatacaactacaccagcgaggagaagttcgccttcgtggaggtgatcgccatgatcaagggcctgcaggtgctgatgggcagaatggagagcgtgttcaaccaggccatcagaaacaccatctacgccgccctgcaggacttcgcccaggtgaccctgagagagcccctgagacaggccgtgagaaagaagaagaacgtgctgatcagcgtgctgcaggccatcagaaagaccatctgcgactgggagggcggcagagagccccccaacgacccctgcctgagaggcgagaaggaccccaagggcggcttcgacatcaaggtgcccagaagagccgtgggccccagcagcacccaggcctgccagtggagccccagagccctgttccaccccaccggcggcacccagggcagaagaggctgcagaagcctgctgtacatggtgagaaccatgctggagagcctgatcgccgacaagagcggcagcaagaagaccctgagaagcagcctggacggccccatcgtgctggccatcgaggacttccacaagcagagcttcttcttcacccacctgctgaacatcagcgaggccctgcagcagtgctgcgacctgagccagctgtggttcagagagttcttcctggagctgaccatgggcagaagaatccagttccccatcgagatgagcatgccctggatcctgaccgaccacatcctggagaccaaggagcccagcatgatggagtacgtgctgtaccccctggacctgtacaacgacagcgcctactacgccctgaccaagttcaagaagcagttcctgtacgacgagatcgaggccgaggtgaacctgtgcttcgaccagttcgtgtacaagctggccgaccagatcttcgcctactacaaggccatggccggcagcgtgctgctggacaagagattcagagccgagtgcaagaactacggcgtgatcatcccctacccccccagcaacagatacgagaccctgctgaagcagagacacgtgcagctgctgggcagaagcatcgacctgaacagactgatcacccagagaatcagcgccgccatgtacaagagcctggaccaggccatcagcagattcgagagcgaggacctgaccagcatcgtggagctggagtggctgctggagatcaacagactgacccacagactgctgtgcaagcacatgaccctggacagcttcgacgccatgttcagagaggccaaccacaacgtgagcgccccctacggcagaatcaccctgcacgtgttctgggagctgaacttcgacttcctgcccaactactgctacaacggcagcaccaacagattcgtgagaaccgccatccccttcacccaggagccccagagagacaagcccgccaacgtgcagccctactacctgtacggcagcaagcccctgaacatcgcctacagccacatctacagcagctacagaaacttcgtgggccccccccacttcaagaccatctgcagactgctgggctaccagggcatcgccgtggtgatggaggagctgctgaagatcgtgaagagcctgctgcagggcaccatcctgcagtacgtgaagaccctgatcgaggtgatgcccaagatctgcagactgcccagacacgagtacggcagccccggcatcctggagttcttccaccaccagctgaaggacatcatcgagtacgccgagctgaagaccgacgtgttccagagcctgagagaggtgggcaacgccatcctgttctgcctgctgatcgagcaggccctgagccaggaggaggtgtgcgacctgctgcacgccgcccccttccagaacatcctgcccagagtgtacatcaaggagggcgagagactggaggtgagaatgaagagactggaggccaagtacgcccccctgcacctggtgcccctgatcgagagactgggcaccccccagcagatcgccatcgccagagagggcgacctgctgaccaaggagagactgtgctgcggcctgagcatgttcgaggtgatcctgaccagaatcagaagctacctgcaggaccccatctggagaggccccccccccaccaacggcgtgatgcacgtggacgagtgcgtggagttccacagactgtggagcgccatgcagttcgtgtactgcatccccgtgggcaccaacgagttcaccgccgagcagtgcttcggcgacggcctgaactgggccggctgcagcatcatcgtgctgctgggccagcagagaagattcgacctgttcgacttctgctaccacctgctgaaggtgcagagacaggacggcaaggacgagatcatcaagaacgtgcccctgaagaagatggccgacagaatcagaaagtaccagatcctgaacaacgaggtgttcgccatcctgaacaagtacatgaagagcgtggagaccgacagcagcaccgtggagcacgtgagatgcttccagccccccatccaccagagcctggccaccacctgctag

SEQ ID NO: 78379 - DNA, 3762 bp, Artificial Sequence
  Description of Artificial Sequence: Synthetic coding sequence
atgaccacccacgtgaccctggaggacgccctgagcaacgtggacctgctggaggagctgcccctgcccgaccagcagccctgcatcgagcccccccccagcagcatcatgtaccaggccaacttcgacaccaacttcgaggacagaaacgccttcgtgaccggcatcgccagatacatcgagcaggccaccgtgcacagcagcatgaacgagatgctggaggagggccacgagtacgccgtgatgctgtacacctggagaagctgcagcagagccatccccaaggtgaagtgcaacgagcagcccaacagagtggagatctacgagaagaccgtggaggtgctggagcccgaggtgaccaagctgatgaagttcatgtacttccagagaaaggccatcgagagattctgcagcgaggtgaagagactgtgccacgccgagagaagaaaggacttcgtgagcgaggcctacctgctgaccctgggcaagttcatcaacatgttcgccgtgctggacgagctgaagaacatgaagtgcagcgtgaagaacgaccacagcgcctacaagagagccgcccagttcctgagaaagatggccgacccccagagcatccaggagagccagaacctgagcatgttcctggccaaccacaacagaatcacccagtgcctgcaccagcagctggaggtgatccccggctacgaggagctgctggccgacatcgtgaacatctgcgtggactactacgagaacaagatgtacctgacccccagcgagaagcacatgctgctgaaggtgatgggcttcggcctgtacctgatggacggcaacgtgagcaacatctacaagctggacgccaagaagagaatcaacctgagcaagatcgacaagttcttcaagcagctgcaggtggtgcccctgttcggcgacatgcagatcgagctggccagatacatcaagaccagcgcccactacgaggagaacaagagcaagtggacctgcacccagagcagcatcagcccccagtacaacatctgcgagcagatggtgcagatcagagacgaccacatcagattcatcagcgagctggccagatacagcaacagcgaggtggtgaccggcagcggcctggacagccagaagagcgacgaggagtacagagagctgttcgacctggccctgagaggcctgcagctgctgagcaagtggagcgcccacgtgatggaggtgtacagctggaagctggtgcaccccaccgacaagttctgcaacaaggactgccccggcaccgccgaggagtacgagagagccaccagatacaactacaccagcgaggagaagttcgccttcgtggaggtgatcgccatgatcaagggcctgcaggtgctgatgggcagaatggagagcgtgttcaaccaggccatcagaaacaccatctacgccgccctgcaggacttcgcccaggtgaccctgagagagcccctgagacaggccgtgagaaagaagaagaacgtgctgatcagcgtgctgcaggccatcagaaagaccatctgcgactgggagggcggcagagagccccccaacgacccctgcctgagaggcgagaaggaccccaagggcggcttcgacatcaaggtgcccagaagagccgtgggccccagcagcacccagctgtacatggtgagaaccatgctggagagcctgatcgccgacaagagcggcagcaagaagaccctgagaagcagcctggacggccccatcgtgctggccatcgaggacttccacaagcagagcttcttcttcacccacctgctgaacatcagcgaggccctgcagcagtgctgcgacctgagccagctgtggttcagagagttcttcctggagctgaccatgggcagaagaatccagttccccatcgagatgagcatgccctggatcctgaccgaccacatcctggagaccaaggagcccagcatgatggagtacgtgctgtaccccctggacctgtacaacgacagcgcctactacgccctgaccaagttcaagaagcagttcctgtacgacgagatcgaggccgaggtgaacctgtgcttcgaccagttcgtgtacaagctggccgaccagatcttcgcctactacaaggccatggccggcagcgtgctgctggacaagagattcagagccgagtgcaagaactacggcgtgatcatcccctacccccccagcaacagatacgagaccctgctgaagcagagacacgtgcagctgctgggcagaagcatcgacctgaacagactgatcacccagagaatcagcgccgccatgtacaagagcctggaccaggccatcagcagattcgagagcgaggacctgaccagcatcgtggagctggagtggctgctggagatcaacagactgacccacagactgctgtgcaagcacatgaccctggacagcttcgacgccatgttcagagaggccaaccacaacgtgagcgccccctacggcagaatcaccctgcacgtgttctgggagctgaacttcgacttcctgcccaactactgctacaacggcagcaccaacagattcgtgagaaccgccatccccttcacccaggagccccagagagacaagcccgccaacgtgcagccctactacctgtacggcagcaagcccctgaacatcgcctacagccacatctacagcagctacagaaacttcgtgggccccccccacttcaagaccatctgcagactgctgggctaccagggcatcgccgtggtgatggaggagctgctgaagatcgtgaagagcctgctgcagggcaccatcctgcagtacgtgaagaccctgatcgaggtgatgcccaagatctgcagactgcccagacacgagtacggcagccccggcatcctggagttcttccaccaccagctgaaggacatcatcgagtacgccgagctgaagaccgacgtgttccagagcctgagagaggtgggcaacgccatcctgttctgcctgctgatcgagcaggccctgagccaggaggaggtgtgcgacctgctgcacgccgcccccttccagaacatcctgcccagagtgtacatcaaggagggcgagagactggaggtgagaatgaagagactggaggccaagtacgcccccctgcacctggtgcccctgatcgagagactgggcaccccccagcagatcgccatcgccagagagggcgacctgctgaccaaggagagactgtgctgcggcctgagcatgttcgaggtgatcctgaccagaatcagaagctacctgcaggaccccatctggagaggccccccccccaccaacggcgtgatgcacgtggacgagtgcgtggagttccacagactgtggagcgccatgcagttcgtgtactgcatccccgtgggcaccaacgagttcaccgccgagcagtgcttcggcgacggcctgaactgggccggctgcagcatcatcgtgctgctgggccagcagagaagattcgacctgttcgacttctgctaccacctgctgaaggtgcagagacaggacggcaaggacgagatcatcaagaacgtgcccctgaagaagatggccgacagaatcagaaagtaccagatcctgaacaacgaggtgttcgccatcctgaacaagtacatgaagagcgtggagaccgacagcagcaccgtggagcacgtgagatgcttccagccccccatccaccagagcctggccaccacctgctag

SEQ ID NO: 78380 - DNA, 3762 bp, Artificial Sequence; identical to SEQ ID NO: 78379
  Description of Artificial Sequence: Synthetic coding sequence

SEQ ID NO: 78381 - DNA, 2859 bp, Artificial Sequence
  Description of Artificial Sequence: Synthetic coding sequence
gagaagagaagaagatggacctgcacccagagcagcatcagcccccagtacaacatctgcgagcagatggtgcagatcagagacgaccacatcagattcatcagcgagctggccagatacagcaacagcgaggtggtgaccggcagcggcctggacagccagaagagcgacgaggagtacagagagctgttcgacctggccctgagaggcctgcagctgctgagcaagtggagcgcccacgtgatggaggtgtacagctggaagctggtgcaccccaccgacaagttctgcaacaaggactgccccggcaccgccgaggagtacgagagagccaccagatacaactacaccagcgaggagaagttcgccttcgtggaggtgatcgccatgatcaagggcctgcaggtgctgatgggcagaatggagagcgtgttcaaccaggccatcagaaacaccatctacgccgccctgcaggacttcgcccaggtgaccctgagagagcccctgagacaggccgtgagaaagaagaagaacgtgctgatcagcgtgctgcaggccatcagaaagaccatctgcgactgggagggcggcagagagccccccaacgacccctgcctgagaggcgagaaggaccccaagggcggcttcgacatcaaggtgcccagaagagccgtgggccccagcagcacccaggcctgccagtggagccccagagccctgttccaccccaccggcggcacccagggcagaagaggctgcagaagcctgctgtacatggtgagaaccatgctggagagcctgatcgccgacaagagcggcagcaagaagaccctgagaagcagcctggacggccccatcgtgctggccatcgaggacttccacaagcagagcttcttcttcacccacctgctgaacatcagcgaggccctgcagcagtgctgcgacctgagccagctgtggttcagagagttcttcctggagctgaccatgggcagaagaatccagttccccatcgagatgagcatgccctggatcctgaccgaccacatcctggagaccaaggagcccagcatgatggagtacgtgctgtaccccctggacctgtacaacgacagcgcctactacgccctgaccaagttcaagaagcagttcctgtacgacgagatcgaggccgaggtgaacctgtgcttcgaccagttcgtgtacaagctggccgaccagatcttcgcctactacaaggccatggccggcagcgtgctgctggacaagagattcagagccgagtgcaagaactacggcgtgatcatcccctacccccccagcaacagatacgagaccctgctgaagcagagacacgtgcagctgctgggcagaagcatcgacctgaacagactgatcacccagagaatcagcgccgccatgtacaagagcctggaccaggccatcagcagattcgagagcgaggacctgaccagcatcgtggagctggagtggctgctggagatcaacagactgacccacagactgctgtgcaagcacatgaccctggacagcttcgacgccatgttcagagaggccaaccacaacgtgagcgccccctacggcagaatcaccctgcacgtgttctgggagctgaacttcgacttcctgcccaactactgctacaacggcagcaccaacagattcgtgagaaccgccatccccttcacccaggagccccagagagacaagcccgccaacgtgcagccctactacctgtacggcagcaagcccctgaacatcgcctacagccacatctacagcagctacagaaacttcgtgggccccccccacttcaagaccatctgcagactgctgggctaccagggcatcgccgtggtgatggaggagctgctgaagatcgtgaagagcctgctgcagggcaccatcctgcagtacgtgaagaccctgatcgaggtgatgcccaagatctgcagactgcccagacacgagtacggcagccccggcatcctggagttcttccaccaccagctgaaggacatcatcgagtacgccgagctgaagaccgacgtgttccagagcctgagagaggtgggcaacgccatcctgttctgcctgctgatcgagcaggccctgagccaggaggaggtgtgcgacctgctgcacgccgcccccttccagaacatcctgcccagagtgtacatcaaggagggcgagagactggaggtgagaatgaagagactggaggccaagtacgcccccctgcacctggtgcccctgatcgagagactgggcaccccccagcagatcgccatcgccagagagggcgacctgctgaccaaggagagactgtgctgcggcctgagcatgttcgaggtgatcctgaccagaatcagaagctacctgcaggaccccatctggagaggccccccccccaccaacggcgtgatgcacgtggacgagtgcgtggagttccacagactgtggagcgccatgcagttcgtgtactgcatccccgtgggcaccaacgagttcaccgccgagcagtgcttcggcgacggcctgaactgggccggctgcagcatcatcgtgctgctgggccagcagagaagattcgacctgttcgacttctgctaccacctgctgaaggtgcagagacaggacggcaaggacgagatcatcaagaacgtgcccctgaagaagatggccgacagaatcagaaagtaccagatcctgaacaacgaggtgttcgccatcctgaacaagtacatgaagagcgtggagaccgacagcagcaccgtggagcacgtgagatgcttccagccccccatccaccagagcctggccaccacctgctag

SEQ ID NO: 78382 - DNA, 651 bp, Artificial Sequence
  Description of Artificial Sequence: Synthetic coding sequence
atggccggcagcgtgctgctggacaagagattcagagccgagtgcaagaactacggcgtgatcatcccctacccccccagcaacagatacgagaccctgctgaagcagagacacgtgcagctgctgggcagaagcatcgacctgaacagactgatcacccagagaatcagcgccgccatgtacaagagcctggaccaggccatcagcagattcgagagcgaggacctgaccagcatcgtggagctggagtggctgctggagatcaacagactgacccacagactgctgtgcaagcacatgaccctggacagcttcgacgccatgttcagagaggccaaccacaacgtgagcgccccctacggcagaatcaccctgcacgtgttctgggagctgaacttcgacttcctgcccaactactgctacaacggcagcaccaacagattcgtgagaaccgccagcttccaccccagaaccaccaccagacagacctgccagagacccgccctgctgcccctgtggatccaggccagccagcactgcctgcagccccacctgcagctgctgcaggagttcagaggcgccaccagcttccaggactacgccgacagctgggtgatcagagccagcctgtggagctggagaaactgctag

SEQ ID NO: 78383 - DNA, 3537 bp, Artificial Sequence
  Description of Artificial Sequence: Synthetic coding sequence
atgaccacccacgtgaccctggaggacgccctgagcaacgtggacctgctggaggagctgcccctgcccaacgagcagcccaacagagtggagatctacgagaagaccgtggaggtgctggagcccgaggtgaccaagctgatgaagttcatgtacttccagagaaaggccatcgagagattctgcagcgaggtgaagagactgtgccacgccgagagaagaaaggacttcgtgagcgaggcctacctgctgaccctgggcaagttcatcaacatgttcgccgtgctggacgagctgaagaacatgaagtgcagcgtgaagaacgaccacagcgcctacaagagagccgcccagttcctgagaaagatggccgacccccagagcatccaggagagccagaacctgagcatgttcctggccaaccacaacagaatcacccagtgcctgcaccagcagctggaggtgatccccggctacgaggagctgctggccgacatcgtgaacatctgcgtggactactacgagaacaagatgtacctgacccccagcgagaagcacatgctgctgaaggtgatgggcttcggcctgtacctgatggacggcaacgtgagcaacatctacaagctggacgccaagaagagaatcaacctgagcaagatcgacaagttcttcaagcagctgcaggtggtgcccctgttcggcgacatgcagatcgagctggccagatacatcaagaccagcgcccactacgaggagaacaagagcaagtggacctgcacccagagcagcatcagcccccagtacaacatctgcgagcagatggtgcagatcagagacgaccacatcagattcatcagcgagctggccagatacagcaacagcgaggtggtgaccggcagcggcctggacagccagaagagcgacgaggagtacagagagctgttcgacctggccctgagaggcctgcagctgctgagcaagtggagcgcccacgtgatggaggtgtacagctggaagctggtgcaccccaccgacaagttctgcaacaaggactgccccggcaccgccgaggagtacgagagagccaccagatacaactacaccagcgaggagaagttcgccttcgtggaggtgatcgccatgatcaagggcctgcaggtgctgatgggcagaatggagagcgtgttcaaccaggccatcagaaacaccatctacgccgccctgcaggacttcgcccaggtgaccctgagagagcccctgagacaggccgtgagaaagaagaagaacgtgctgatcagcgtgctgcaggccatcagaaagaccatctgcgactgggagggcggcagagagccccccaacgacccctgcctgagaggcgagaaggaccccaagggcggcttcgacatcaaggtgcccagaagagccgtgggccccagcagcacccagctgtacatggtgagaaccatgctggagagcctgatcgccgacaagagcggcagcaagaagaccctgagaagcagcctggacggccccatcgtgctggccatcgaggacttccacaagcagagcttcttcttcacccacctgctgaacatcagcgaggccctgcagcagtgctgcgacctgagccagctgtggttcagagagttcttcctggagctgaccatgggcagaagaatccagttccccatcgagatgagcatgccctggatcctgaccgaccacatcctggagaccaaggagcccagcatgatggagtacgtgctgtaccccctggacctgtacaacgacagcgcctactacgccctgaccaagttcaagaagcagttcctgtacgacgagatcgaggccgaggtgaacctgtgcttcgaccagttcgtgtacaagctggccgaccagatcttcgcctactacaaggccatggccggcagcgtgctgctggacaagagattcagagccgagtgcaagaactacggcgtgatcatcccctacccccccagcaacagatacgagaccctgctgaagcagagacacgtgcagctgctgggcagaagcatcgacctgaacagactgatcacccagagaatcagcgccgccatgtacaagagcctggaccaggccatcagcagattcgagagcgaggacctgaccagcatcgtggagctggagtggctgctggagatcaacagactgacccacagactgctgtgcaagcacatgaccctggacagcttcgacgccatgttcagagaggccaaccacaacgtgagcgccccctacggcagaatcaccctgcacgtgttctgggagctgaacttcgacttcctgcccaactactgctacaacggcagcaccaacagattcgtgagaaccgccatccccttcacccaggagccccagagagacaagcccgccaacgtgcagccctactacctgtacggcagcaagcccctgaacatcgcctacagccacatctacagcagctacagaaacttcgtgggccccccccacttcaagaccatctgcagactgctgggctaccagggcatcgccgtggtgatggaggagctgctgaagatcgtgaagagcctgctgcagggcaccatcctgcagtacgtgaagaccctgatcgaggtgatgcccaagatctgcagactgcccagacacgagtacggcagccccggcatcctggagttcttccaccaccagctgaaggacatcatcgagtacgccgagctgaagaccgacgtgttccagagcctgagagaggtgggcaacgccatcctgttctgcctgctgatcgagcaggccctgagccaggaggaggtgtgcgacctgctgcacgccgcccccttccagaacatcctgcccagagtgtacatcaaggagggcgagagactggaggtgagaatgaagagactggaggccaagtacgcccccctgcacctggtgcccctgatcgagagactgggcaccccccagcagatcgccatcgccagagagggcgacctgctgaccaaggagagactgtgctgcggcctgagcatgttcgaggtgatcctgaccagaatcagaagctacctgcaggaccccatctggagaggccccccccccaccaacggcgtgatgcacgtggacgagtgcgtggagttccacagactgtggagcgccatgcagttcgtgtactgcatccccgtgggcaccaacgagttcaccgccgagcagtgcttcggcgacggcctgaactgggccggctgcagcatcatcgtgctgctgggccagcagagaagattcgacctgttcgacttctgctaccacctgctgaaggtgcagagacaggacggcaaggacgagatcatcaagaacgtgcccctgaagaagatggccgacagaatcagaaagtaccagatcctgaacaacgaggtgttcgccatcctgaacaagtacatgaagagcgtggagaccgacagcagcaccgtggagcacgtgagatgcttccagccccccatccaccagagcctggccaccacctgctag

SEQ ID NO: 78384 - DNA, 4617 bp, Artificial Sequence
  Description of Artificial Sequence: Synthetic coding sequence
atggagcccagaatggagagctgcctggcccaggtgctgcagaaggacgtgggcaagagactgcaggtgggccaggagctgatcgactacttcagcgacaagcagaagagcgccgacctggagcacgaccagaccatgctggacaagctggtggacggcctggccaccagctgggtgaacagcagcaactacaaggtggtgctgctgggcatggacatcctgagcgccctggtgaccagactgcaggacagattcaaggcccagatcggcaccgtgctgcccagcctgatcgacagactgggcgacgccaaggacagcgtgagagagcaggaccagaccctgctgctgaagatcatggaccaggccgccaacccccagtacgtgtgggacagaatgctgggcggcttcaagcacaagaacttcagaaccagagagggcatctgcctgtgcctgatcgccaccctgaacgccagcggcgcccagaccctgaccctgagcaagatcgtgccccacatctgcaacctgctgggcgaccccaacagccaggtgagagacgccgccatcaacagcctggtggagatctacagacacgtgggcgagagagtgagagccgacctgagcaagaagggcctgccccagagcagactgaacgtgatcttcaccaagttcgacgaggtgcagaagagcggcaacatgatccagagcgccaacgacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctgggcagaatcagaaccagaagacagagcagcggcagcgccaccaacgtggccagcacccccgacaacagaggcagaagcagagccaaggtggtgagccagagccagagaagcagaagcgccaaccccgccggcgccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggccagaagcagcagaatccccagacccagcatgagccagggctgcagcagagacaccagcagagagagcagcagagacaccagccccgccagaggcttcccccccctggacagattcggcctgggccagcccggcagaatccccggcagcgtgaacgccatgagagtgctgagcaccagcaccgacctggaggccgccgtggccgacgccctgaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaagagagtgttcagcatgttcctggagaccctggtggacttcatcatcatccacaaggacgacctgcaggactggctgttcgtgctgctgacccagctgctgaagaagatgggcgccgacctgctgggcagcgtgcaggccaaggtgcagaaggccctggacgtgaccagagacagcttccccttcgaccagcagttcaacatcctgatgagattcatcgtggaccagacccagacccccaacctgaaggtgaaggtggccatcctgaagtacatcgagagcctggccagacagatggaccccaccgacttcgtgaacagcagcgagaccagactggccgtgagcagaatcatcacctggaccaccgagcccaagagcagcgacgtgagaaaggccgcccagatcgtgctgatcagcctgttcgagctgaacacccccgagttcaccatgctgctgggcgccctgcccaagaccttccaggacggcgccaccaagctgctgcacaaccacctgaagaacagcagcaacaccagcgtgggcagccccagcaacaccatcggcagaacccccagcagacacaccagcagcagaaccagccccctgaccagccccaccaactgcagccacggcggcctgagccccagcagactgtggggctggagcgccgacggcctggccaagcaccccccccccttcagccagcccaacagcatccccaccgcccccagccacaaggccctgagaagaagctacagccccagcatgctggactacgacaccgagaacctgaacagcgaggagatctacagcagcctgagaggcgtgaccgaggccatcgagaagttcagcttcagaagccaggaggacctgaacgagcccatcaagagagacggcaagaaggagtgcgacatcgtgagcagagacggcggcgccgccagccccgccaccgagggcagaggcggcagcgaggtggagggcggcagaaccgccctggacaacaagaccagcctgctgaacacccagccccccagagccttccccggccccagagccagagactacaacccctacccctacagcgacgccatcaacacctacgacaagaccgccctgaaggaggccgtgttcgacgacgacatggagcagctgagagacgtgcccatcgaccacagcgacctggtggccgacctgctgaaggagctgagcaaccacaacgagagagtggaggagagaaagggcgccctgctggagctgctgaagatcaccagagaggacagcctgggcgtgtgggaggagcacttcaagaccatcctgctgctgctgctggagaccctgggcgacaaggaccacagcatcagagccctggccctgagagtgctgagagagatcctgagaaaccagcccgccagattcaagaactacgccgagctgaccatcatgaagaccctggaggcccacaaggacagccacaaggaggtggtgagagccgccgaggaggccgccagcaccctggccagcagcatccaccccgagcagtgcatcaaggtgctgtgccccatcatccagaccgccgactaccccatcaacctggccgccatcaagatgcagaccaaggtggtggagagaatcgccaaggagagcctgctgcagctgctggtggacatcatccccggcctgctgcagggctacgacaacaccgagagcagcgtgagaaaggccagcgtgttctgcctggtggccatctacagcgtgatcggcgaggacctgaagccccacctggcccagctgaccggcagcaagatgaagctgctgaacctgtacatcaagagagcccagaccaccaacagcaacagcagcagcagcagcgacgtgagcacccacagctag

SEQ ID NO: 78385 - DNA, 4437 bp, Artificial Sequence
  Description of Artificial Sequence: Synthetic coding sequence
atggagcccagaatggagagctgcctggcccaggtgctgcagaaggacgtgggcaagagactgcaggtgggccaggagctgatcgactacttcagcgacaagcagaagagcgccgacctggagcacgaccagaccatgctggacaagctggtggacggcctggccaccagctgggtgaacagcagcaactacaaggtggtgctgctgggcatggacatcctgagcgccctggtgaccagactgcaggacagattcaaggcccagatcggcaccgtgctgcccagcctgatcgacagactgggcgacgccaaggacagcgtgagagagcaggaccagaccctgctgctgaagatcatggaccaggccgccaacccccagtacgtgtgggacagaatgctgggcggcttcaagcacaagaacttcagaaccagagagggcatctgcctgtgcctgatcgccaccctgaacgccagcggcgcccagaccctgaccctgagcaagatcgtgccccacatctgcaacctgctgggcgaccccaacagccaggtgagagacgccgccatcaacagcctggtggagatctacagacacgtgggcgagagagtgagagccgacctgagcaagaagggcctgccccagagcagactgaacgtgatcttcaccaagttcgacgaggtgcagaagagcggcaacatgatccagagcgccaacgacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctggacggcaccaccaccaaggccgagggcagaatcagaaccagaagacagagcagcggcagcgccaccaacgtggccagcacccccgacaacagaggcagaagcagagccaaggtggtgagccagagccagagaagcagaagcgccaaccccgccggcgccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggacagattcggcctgggccagcccggcagaatccccggcagcgtgaacgccatgagagtgctgagcaccagcaccgacctggaggccgccgtggccgacgccctgctgctgggcgacagcagaagcaagaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaaggtgttcagcatgttcctggagaccctggtggacttcatcatcatccacaaggacgacctgcaggactggctgttcgtgctgctgacccagctgctgaagaagatgggcgccgacctgctgggcagcgtgcaggccaaggtgcagaaggccctggacgtgaccagagacagcttccccttcgaccagcagttcaacatcctgatgagattcatcgtggaccagacccagacccccaacctgaaggtgaaggtggccatcctgaagtacatcgagagcctggccagacagatggaccccaccgacttcgtgaacagcagcgagaccagactggccgtgagcagaatcatcacctggaccaccgagcccaagagcagcgacgtgagaaaggccgcccagatcgtgctgatcagcctgttcgagctgaacacccccgagttcaccatgctgctgggcgccctgcccaagaccttccaggacggcgccaccaagctgctgcacaaccacctgaagaacagcagcaacaccagcgtgggcagccccagcaacaccatcggcagaacccccagcagacacaccagcagcagaaccagccccctgaccagccccaccaactgcagccacggcggcctgagccccagcatgctggactacgacaccgagaacctgaacagcgaggagatctacagcagcctgagaggcgtgaccgaggccatcgagaagttcagcttcagaagccaggaggacctgaacgagcccatcaagagagacggcaagaaggagtgcgacatcgtgagcagagacggcggcgccgccagccccgccaccgagggcagaggcggcagcgaggtggagggcggcagaaccgccctggacaacaagaccagcctgctgaacacccagccccccagagccttccccggccccagagccagagactacaacccctacccctacagcgacgccatcaacacctacgacaagaccgccctgaaggaggccgtgttcgacgacgacatggagcagctgagagacgtgcccatcgaccacagcgacctggtggccgacctgctgaaggagctgagcaaccacaacgagagagtggaggagagaaagggcgccctgctggagctgctgaagatcaccagagaggacagcctgggcgtgtgggaggagcacttcaagaccatcctgctgctgctgctggagaccctgggcgacaaggaccacagcatcagagccctggccctgagagtgctgagagagatcctgagaaaccagcccgccagattcaagaactacgccgagctgaccatcatgaagaccctggaggcccacaaggacagccacaaggaggtggtgagagccgccgaggaggccgccagcaccctggccagcagcatccaccccgagcagtgcatcaaggtgctgtgccccatcatccagaccgccgactaccccatcaacctggccgccatcaagatgcagaccaaggtggtggagagaatcgccaaggagagcctgctgcagctgctggtggacatcatccccggcctgctgcagggctacgacaacaccgagagcagcgtgagaaaggccagcgtgttctgcctggtggccatctacagcgtgatcggcgaggacctgaagccccacctggcccagctgaccggcagcaagatgaagctgctgaacctgtacatcaagagagcccagaccaccaacagcaacagcagcagcagcagcgacgtgagcacccacagctag

SEQ ID NO: 78386 - DNA, 4416 bp, Artificial Sequence
  Description of Artificial Sequence: Synthetic coding sequence
atggagcccagaatggagagctgcctggcccaggtgctgcagaaggacgtgggcaagagactgcaggtgggccaggagctgatcgactacttcagcgacaagcagaagagcgccgacctggagcacgaccagaccatgctggacaagctggtggacggcctggccaccagctgggtgaacagcagcaactacaaggtggtgctgctgggcatggacatcctgagcgccctggtgaccagactgcaggacagattcaaggcccagatcggcaccgtgctgcccagcctgatcgacagactgggcgacgccaaggacagcgtgagagagcaggaccagaccctgctgctgaagatcatggaccaggccgccaacccccagtacgtgtgggacagaatgctgggcggcttcaagcacaagaacttcagaaccagagagggcatctgcctgtgcctgatcgccaccctgaacgccagcggcgcccagaccctgaccctgagcaagatcgtgccccacatctgcaacctgctgggcgaccccaacagccaggtgagagacgccgccatcaacagcctggtggagatctacagacacgtgggcgagagagtgagagccgacctgagcaagaagggcctgccccagagcagactgaacgtgatcttcaccaagttcgacgaggtgcagaagagcggcaacatgatccagagcgccaacgacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctgggcagaatcagaaccagaagacagagcagcggcagcgccaccaacgtggccagcacccccgacaacagaggcagaagcagagccaaggtggtgagccagagccagagaagcagaagcgccaaccccgccggcgccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggacagattcggcctgggccagcccggcagaatccccggcagcgtgaacgccatgagagtgctgagcaccagcaccgacctggaggccgccgtggccgacgccctgctgctgggcgacagcagaagcaagaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaagctggtgttcagcatgttcctggagaccctggtggacttcatcatcatccacaaggacgacctgcaggactggctgttcgtgctgctgacccagctgctgaagaagatgggcgccgacctgctgggcagcgtgcaggccaaggtgcagaaggccctggacgtgaccagagacagcttccccttcgaccagcagttcaacatcctgatgagattcatcgtggaccagacccagacccccaacctgaaggtgaaggtggccatcctgaagtacatcgagagcctggccagacagatggaccccaccgacttcgtgaacagcagcgagaccagactggccgtgagcagaatcatcacctggaccaccgagcccaagagcagcgacgtgagaaaggccgcccagatcgtgctgatcagcctgttcgagctgaacacccccgagttcaccatgctgctgggcgccctgcccaagaccttccaggacggcgccaccaagctgctgcacaaccacctgaagaacagcagcaacaccagcgtgggcagccccagcaacaccatcggcagaacccccagcagacacaccagcagcagaaccagccccctgaccagccccaccaactgcagccacggcggcctgagccccagcatgctggactacgacaccgagaacctgaacagcgaggagatctacagcagcctgagaggcgtgaccgaggccatcgagaagttcagcttcagaagccaggaggacctgaacgagcccatcaagagagacggcaagaaggagtgcgacatcgtgagcagagacggcggcgccgccagccccgccaccgagggcagaggcggcagcgaggtggagggcggcagaaccgccctggacaacaagaccagcctgctgaacacccagccccccagagccttccccggccccagagccagagactacaacccctacccctacagcgacgccatcaacacctacgacaagaccgccctgaaggaggccgtgttcgacgacgacatggagcagctgagagacgtgcccatcgaccacagcgacctggtggccgacctgctgaaggagctgagcaaccacaacgagagagtggaggagagaaagggcgccctgctggagctgctgaagatcaccagagaggacagcctgggcgtgtgggaggagcacttcaagaccatcctgctgctgctgctggagaccctgggcgacaaggaccacagcatcagagccctggccctgagagtgctgagagagatcctgagaaaccagcccgccagattcaagaactacgccgagctgaccatcatgaagaccctggaggcccacaaggacagccacaaggaggtggtgagagccgccgaggaggccgccagcaccctggccagcagcatccaccccgagcagtgcatcaaggtgctgtgccccatcatccagaccgccgactaccccatcaacctggccgccatcaagatgcagaccaaggtggtggagagaatcgccaaggagagcctgctgcagctgctggtggacatcatccccggcctgctgcagggctacgacaacaccgagagcagcgtgagaaaggccagcgtgttctgcctggtggccatctacagcgtgatcggcgaggacctgaagccccacctggcccagctgaccggcagcaagatgaagctgctgaacctgtacatcaagagagcccagaccaccaacagcaacagcagcagcagcagcgacgtgagcacccacagctag

SEQ ID NO: 78387 - DNA, 2115 bp, Artificial Sequence
  Description of Artificial Sequence: Synthetic coding sequence
tgaaccaagttcgacgaggtgcagaagagcggcaacatgatccagagcgccaacgacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctgggcagaatcagaaccagaagacagagcagcggcagcgccaccaacgtggccagcacccccgacaacagaggcagaagcagagccaaggtggtgagccagagccagagaagcagaagcgccaaccccgccggcgccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggacagattcggcctgggccagcccggcagaatccccggcagcgtgaacgccatgagagtgctgagcaccagcaccgacctggaggccgccgtggccgacgccctgctgctgggcgacagcagaagcaagaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaagatcgccgacagcgaggccgagtgcgaggacaaggagggcaacctgttccccagcgaggtgagctgcaccgtgagcttccagtacgtgttcggcgacagctgcggcttctacaacaacagctag

SEQ ID NO: 78388 - DNA, 4485 bp, Artificial Sequence
  Description of Artificial Sequence: Synthetic coding sequence
atggagcccagaatggagagctgcctggcccaggtgctgcagaaggacgtgggcaagagactgcaggtgggccaggagctgatcgactacttcagcgacaagcagaagagcgccgacctggagcacgaccagaccatgctggacaagctggtggacggcctggccaccagctgggtgaacagcagcaactacaaggtggtgctgctgggcatggacatcctgagcgccctggtgaccagactgcaggacagattcaaggcccagatcggcaccgtgctgcccagcctgatcgacagactgggcgacgccaaggacagcgtgagagagcaggaccagaccctgctgctgaagatcatggaccaggccgccaacccccagtacgtgtgggacagaatgctgggcggcttcaagcacaagaacttcagaaccagagagggcatctgcctgtgcctgatcgccaccctgaacgccagcggcgcccagaccctgaccctgagcaagatcgtgccccacatctgcaacctgctgggcgaccccaacagccaggtgagagacgccgccatcaacagcctggtggagatctacagacacgtgggcgagagagtgagagccgacctgagcaagaagggcctgccccagagcagactgaacgtgatcttcaccaagttcgacgaggtgcagaagagcggcaacatgatccagagcgccaacgacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctgggcagaatcagaaccagaagacagagcagcggcagcgccaccaacgtggccagcacccccgacaacagaggcagaagcagagccaaggtggtgagccagagccagagaagcagaagcgccaaccccgccggcgccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggacagattcggcctgggccagcccggcagaatccccggcagcgtgaacgccatgagagtgctgagcaccagcaccgacctggaggccgccgtggccgacgccctggtgagaggcaccagcaccggcaagaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaagatcgccgacagcgaggccgagtgcgaggacaaggagggcaacctgttccccagcgaggtgagctgcaccagagtgttcagcatgttcctggagaccctggtggacttcatcatcatccacaaggacgacctgcaggactggctgttcgtgctgctgacccagctgctgaagaagatgggcgccgacctgctgggcagcgtgcaggccaaggtgcagaaggccctggacgtgaccagagacagcttccccttcgaccagcagttcaacatcctgatgagattcatcgtggaccagacccagacccccaacctgaaggtgaaggtggccatcctgaagtacatcgagagcctggccagacagatggaccccaccgacttcgtgaacagcagcgagaccagactggccgtgagcagaatcatcacctggaccaccgagcccaagagcagcgacgtgagaaaggccgcccagatcgtgctgatcagcctgttcgagctgaacacccccgagttcaccatgctgctgggcgccctgcccaagaccttccaggacggcgccaccaagctgctgcacaaccacctgaagaacagcagcaacaccagcgtgggcagccccagcaacaccatcggcagaacccccagcagacacaccagcagcagaaccagccccctgaccagccccaccaactgcagccacggcggcctgagccccagcatgctggactacgacaccgagaacctgaacagcgaggagatctacagcagcctgagaggcgtgaccgaggccatcgagaagttcagcttcagaagccaggaggacctgaacgagcccatcaagagagacggcaagaaggagtgcgacatcgtgagcagagacggcggcgccgccagccccgccaccgagggcagaggcggcagcgaggtggagggcggcagaaccgccctggacaacaagaccagcctgctgaacacccagccccccagagccttccccggccccagagccagagactacaacccctacccctacagcgacgccatcaacacctacgacaagaccgccctgaaggaggccgtgttcgacgacgacatggagcagctgagagacgtgcccatcgaccacagcgacctggtggccgacctgctgaaggagctgagcaaccacaacgagagagtggaggagagaaagggcgccctgctggagctgctgaagatcaccagagaggacagcctgggcgtgtgggaggagcacttcaagaccatcctgctgctgctgctggagaccctgggcgacaaggaccacagcatcagagccctggccctgagagtgctgagagagatcctgagaaaccagcccgccagattcaagaactacgccgagctgaccatcatgaagaccctggaggcccacaaggacagccacaaggaggtggtgagagccgccgaggaggccgccagcaccctggccagcagcatccaccccgagcagtgcatcaaggtgctgtgccccatcatccagaccgccgactaccccatcaacctggccgccatcaagatgcagaccaaggtggtggagagaatcgccaaggagagcctgctgcagctgctggtggacatcatccccggcctgctgcagggctacgacaacaccgagagcagcgtgagaaaggccagcgtgttctgcctggtggccatctacagcgtgatcggcgaggacctgaagccccacctggcccagctgaccggcagcaagatgaagctgctgaacctgtacatcaagagagcccagaccaccaacagcaacagcagcagcagcagcgacgtgagcacccacagctag

SEQ ID NO: 78389 - DNA, 4434 bp, Artificial Sequence
  Description of Artificial Sequence: Synthetic coding sequence
atggagcccagaatggagagctgcctggcccaggtgctgcagaaggacgtgggcaagagactgcaggtgggccaggagctgatcgactacttcagcgacaagcagaagagcgccgacctggagcacgaccagaccatgctggacaagctggtggacggcctggccaccagctgggtgaacagcagcaactacaaggtggtgctgctgggcatggacatcctgagcgccctggtgaccagactgcaggacagattcaaggcccagatcggcaccgtgctgcccagcctgatcgacagactgggcgacgccaaggacagcgtgagagagcaggaccagaccctgctgctgaagatcatggaccaggccgccaacccccagtacgtgtgggacagaatgctgggcggcttcaagcacaagaacttcagaaccagagagggcatctgcctgtgcctgatcgccaccctgaacgccagcggcgcccagaccctgaccctgagcaagatcgtgccccacatctgcaacctgctgggcgaccccaacagccaggtgagagacgccgccatcaacagcctggtggagatctacagacacgtgggcgagagagtgagagccgacctgagcaagaagggcctgccccagagcagactgaacgtgatcttcaccaagttcgacgaggtgcagaagagcggcaacatgatccagagcgccaacgacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctggagagcagacacatgagagaggacatggagtacatcggcctggacagcggcagaatcagaaccagaagacagagcagcggcagcgccaccaacgtggccagcacccccgacaacagaggcagaagcagagccaaggtggtgagccagagccagcccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggacagattcggcctgggccagcccggcagaatccccggcagcgtgaacgccatgagagtgctgagcaccagcaccgacctggaggccgccgtggccgacgccctgctgctgggcgacagcagaagcaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaagagagtgttcagcatgttcctggagaccctggtggacttcatcatcatccacaaggacgacctgcaggactggctgttcgtgctgctgacccagctgctgaagaagatgggcgccgacctgctgggcagcgtgcaggccaaggtgcagaaggccctggacgtgaccagagacagcttccccttcgaccagcagttcaacatcctgatgagattcatcgtggaccagacccagacccccaacctgaaggtgaaggtggccatcctgaagtacatcgagagcctggccagacagatggaccccaccgacttcgtgaacagcagcgagaccagactggccgtgagcagaatcatcacctggaccaccgagcccaagagcagcgacgtgagaaaggccgcccagatcgtgctgatcagcctgttcgagctgaacacccccgagttcaccatgctgctgggcgccctgcccaagaccttccaggacggcgccaccaagctgctgcacaaccacctgaagaacagcagcaacaccagcgtgggcagccccagcaacaccatcggcagaacccccagcagacacaccagcagcagaaccagccccctgaccagccccaccaactgcagccacggcggcctgagccccagcatgctggactacgacaccgagaacctgaacagcgaggagatctacagcagcctgagaggcgtgaccgaggccatcgagaagttcagcttcagaagccaggaggacctgaacgagcccatcaagagagacggcaagaaggagtgcgacatcgtgagcagagacggcggcgccgccagccccgccaccgagggcagaggcggcagcgaggtggagggcggcagaaccgccctggacaacaagaccagcctgctgaacacccagccccccagagccttccccggccccagagccagagactacaacccctacccctacagcgacgccatcaacacctacgacaagaccgccctgaaggaggccgtgttcgacgacgacatggagcagctgagagacgtgcccatcgaccacagcgacctggtggccgacctgctgaaggagctgagcaaccacaacgagagagtggaggagagaaagggcgccctgctggagctgctgaagatcaccagagaggacagcctgggcgtgtgggaggagcacttcaagaccatcctgctgctgctgctggagaccctgggcgacaaggaccacagcatcagagccctggccctgagagtgctgagagagatcctgagaaaccagcccgccagattcaagaactacgccgagctgaccatcatgaagaccctggaggcccacaaggacagccacaaggaggtggtgagagccgccgaggaggccgccagcaccctggccagcagcatccaccccgagcagtgcatcaaggtgctgtgccccatcatccagaccgccgactaccccatcaacctggccgccatcaagatgcagaccaaggtggtggagagaatcgccaaggagagcctgctgcagctgctggtggacatcatccccggcctgctgcagggctacgacaacaccgagagcagcgtgagaaaggccagcgtgttctgcctggtggccatctacagcgtgatcggcgaggacctgaagccccacctggcccagctgaccggcagcaagatgaagctgctgaacctgtacatcaagagagcccagaccaccaacagcaacagcagcagcagcagcgacgtgagcacccacagctag

SEQ ID NO: 78390 - DNA, 3768 bp, Artificial Sequence
  Description of Artificial Sequence: Synthetic coding sequence
atgctgcagaactgcagcgacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctgggcagaatcagaaccagaagacagagcagcggcagcgccaccaacgtggccagcacccccgacaacagaggcagaagcagagccaaggtggtgagccagagccagagaagcagaagcgccaaccccgccggcgccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggacagattcggcctgggccagcccggcagaatccccggcagcgtgaacgccatgagagtgctgagcaccagcaccgacctggaggccgccgtggccgacgccctgaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaagatcgccgacagcgaggccgagtgcgaggacaaggagggcaacctgttccccagcgaggtgagctgcaccagagtgttcagcatgttcctggagaccctggtggacttcatcatcatccacaaggacgacctgcaggactggctgttcgtgctgctgacccagctgctgaagaagatgggcgccgacctgctgggcagcgtgcaggccaaggtgcagaaggccctggacgtgaccagagacagcttccccttcgaccagcagttcaacatcctgatgagattcatcgtggaccagacccagacccccaacctgaaggtgaaggtggccatcctgaagtacatcgagagcctggccagacagatggaccccaccgacttcgtgaacagcagcgagaccagactggccgtgagcagaatcatcacctggaccaccgagcccaagagcagcgacgtgagaaaggccgcccagatcgtgctgatcagcctgttcgagctgaacacccccgagttcaccatgctgctgggcgccctgcccaagaccttccaggacggcgccaccaagctgctgcacaaccacctgaagaacagcagcaacaccagcgtgggcagccccagcaacaccatcggcagaacccccagcagacacaccagcagcagaaccagccccctgaccagccccaccaactgcagccacggcggcctgagccccagcatgctggactacgacaccgagaacctgaacagcgaggagatctacagcagcctgagaggcgtgaccgaggccatcgagaagttcagcttcagaagccaggaggacctgaacgagcccatcaagagagacggcaagaaggagtgcgacatcgtgagcagagacggcggcgccgccagccccgccaccgagggcagaggcggcagcgaggtggagggcggcagaaccgccctggacaacaagaccagcctgctgaacacccagccccccagagccttccccggccccagagccagagactacaacccctacccctacagcgacgccatcaacacctacgacaagaccgccctgaaggaggccgtgttcgacgacgacatggagcagctgagagacgtgcccatcgaccacagcgacctggtggccgacctgctgaaggagctgagcaaccacaacgagagagtggaggagagaaagggcgccctgctggagctgctgaagatcaccagagaggacagcctgggcgtgtgggaggagcacttcaagaccatcctgctgctgctgctggagaccctgggcgacaaggaccacagcatcagagccctggccctgagagtgctgagagagatcctgagaaaccagcccgccagattcaagaactacgccgagctgaccatcatgaagaccctggaggcccacaaggacagccacaaggaggtggtgagagccgccgaggaggccgccagcaccctggccagcagcatccaccccgagcagtgcatcaaggtgctgtgccccatcatccagaccgccgactaccccatcaacctggccgccatcaagatgcagaccaaggtggtggagagaatcgccaaggagagcctgctgcagctgctggtggacatcatccccggcctgctgcagggctacgacaacaccgagagcagcgtgagaaaggccagcgtgttctgcctggtggccatctacagcgtgatcggcgaggacctgaagccccacctggcccagctgaccggcagcaagatgaagctgctgaacctgtacatcaagagagcccagaccaccaacagcaacagcagcagcagcagcgacgtgagcacccacagctag

SEQ ID NO: 78391 - DNA, 3738 bp, Artificial Sequence
  Description of Artificial Sequence: Synthetic coding sequence
atgaccaccggcaaggacaagaacttcgacgacgaggacagcgtggacggcaacagacccagcagcgccagcagcaccagcagcaaggccccccccagcagcagaagaaacgtgggcatgggcaccaccagaagactgggcagcagcaccctgggcagcaagagcagcgccgccaaggagggcgccggcgccgtggacgaggaggacttcatcaaggccttcgacgacgtgcccgtggtgcagatctacagcagcagagacctggaggagagcatcaacaagatcagagagatcctgagcgacgacaagcacgactgggagcagagagtgaacgccctgaagaagatcagaagcctgctgctggccggcgccgccgagtacgacaacttcttccagcacctgagactgctggacggcgccttcaagctgagcgccaaggacctgagaagccaggtggtgagagaggcctgcatcaccctgggccacctgagcagcgtgctgggcaacaagttcgaccacggcgccgaggccatcatgcccaccatcttcaacctgatccccaacagcgccaagatcatggccaccagcggcgtggtggccgtgagactgatcatcagacacacccacatccccagactgatccccgtgatcaccagcaactgcaccagcaagagcgtggccgtgagaagaagatgcttcgagttcctggacctgctgctgcaggagtggcagacccacagcctggagagacacatcagcgtgctggccgagaccatcaagaagggcatccacgacgccgacagcgaggccagaatcgaggccagaaagtgctactggggcttccacagccacttcagcagagaggccgagcacctgtaccacaccctggagagcagctaccagaaggccctgcagagccacctgaagaacagcgacagcatcgtgagcctgccccagagcgacagaagcagcagcagcagccaggagagcctgaacagacccctgagcgccaagagaagccccaccggcagcaccaccagcagagccagcaccgtgagcaccaagagcgtgagcaccaccggcagcctgcagagaagcagaagcgacatcgacgtgaacgccgccgccagcgccaagagcaaggtgagcagcagcagcggcaccacccccttcagcagcgccgccgccctgccccccggcagctacgccagcctggacggcaccaccaccaaggccgagggcagaatcagaaccagaagacagagcagcggcagcgccaccaacgtggccagcacccccgacaacagaggcagaagcagagccaaggtggtgagccagagccagagaagcagaagcgccaaccccgccggcgccggcagcagaagcagcagccccggcaagctgctgggcagcggctacggcggcctgaccggcggcagcagcagaggcccccccgtgacccccagcagcgagaagagaagcaagatccccagaagccagggctgcagcagagagaccagccccaacagaatcggcctggacagattcggcctgggccagcccggcagaatccccggcagcgtgaacgccatgagagtgctgagcaccagcaccgacctggaggccgccgtggccgacgccctgctgctgggcgacagcagaagcaagaagcccgtgagaagaagatacgagccctacggcatgtacagcgacgacgacgccaacagcgacgccagcagcgtgtgcagcgagagaagctacggcagcagaaacggcggcatcccccactacctgagacagaccgaggacgtggccgaggtgctgaaccactgcgccagcagcaactggagcgagagaaaggagggcctgctgggcctgcagaacctgctgaagagccagagaaccctgagcagagtggagctgaagagactgtgcgagatcttcaccagaatgttcgccgacccccacagcaaggtgttcagcatgttcctggagaccctggtggacttcatcatcatccacaaggacgacctgcaggactggctgttcgtgctgctgacccagctgctgaagaagatgggcgccgacctgctgggcagcgtgcaggccaaggtgcagaaggccctggacgtgaccagagacagcttccccttcgaccagcagttcaacatcctgatgagattcatcgtggaccagacccagacccccaacctgaaggtgaaggtggccatcctgaagtacatcgagagcctggccagacagatggaccccaccgacttcgtgaacagcagcgagaccagactggccgtgagcagaatcatcacctggaccaccgagcccaagagcagcgacgtgagaaaggccgcccagatcgtgctgatcagcctgttcgagctgaacacccccgagttcaccatgctgctgggcgccctgcccaagaccttccaggacggcgccaccaagctgctgcacaaccacctgaagaacagcagcaacaccagcgtgggcagccccagcaacaccatcggcagaacccccagcagacacaccagcagcagaaccagccccctgaccagccccaccaactgcagccacggcggcctgagccccagcatgctggactacgacaccgagaacctgaacagcgaggagatctacagcagcctgagaggcgtgaccgaggccatcgagaagttcagcttcagaagccaggaggacctgaacgagcccatcaagagagacggcaagaaggagtgcgacatcgtgagcagagacggcggcgccgccagccccgccaccgagggcagaggcggcagcgaggtggagggcggcagaaccgccctggacaacaagaccagcctgctgaacacccagccccccagagccttccccggccccagagccagagactacaacccctacccctacagcgacgccatcaacacctacgacaagaccgccctgaaggaggccgtgttcgacgacgacatggagcagctgagagacgtgcccatcgaccacagcgacctggtggccgacctgctgaaggagctgagcaaccacaacgagagagtggaggagagaaagggcgccctgctggagctgctgaagatcaccagagaggacagcctgggcgtgtgggaggagcacttcaagaccatcctgctgctgctgctggagaccctgggcgacaaggaccacagcatcagagccctggccctgagagtgctgagagagatcctgagaaaccagcccgccagattcaagaactacgccgagctgaccatcatgaagaccctggaggcccacaaggacagccacaaggaggtggtgagagccgccgaggaggccgccagcaccctggccagcagcatccaccccgagcagtgcatcaaggtgctgtgccccatcatccagaccgccgactaccccatcaacctggccgccatcaagatgcagaccaaggtggtggagagaatcgccaaggagagcctgctgcagctgctggtggacatcatccccggcctgctgcagggctacgacaacaccgagagcagcgtgagaaaggccagcgtgttctgcctggtggccatctacagcgtgatcggcgaggacctgaagccccacctggcccagctgaccggcagcaagatgaagctgctgaacctgtacatcaagagagcccagaccaccaacagcaacagcagcagcagcagcgacgtgagcacccacagctag

SEQ ID NO: 78392 - DNA, 2988 bp, Artificial Sequence
  Description of Artificial Sequence: Synthetic coding sequence
atgggcctgagaaaccacttccccggcgaggccgagaccctgtacaacagcctggagcccagctaccagaagagcctgcagacctacctgaagagcagcggcagcgtggccagcctgccccagagcgacagaagcagcagcagcagccaggagagcctgaacagacccttcagcagcaagtggagcaccgccaaccccagcaccgtggccggcagagtgagcgccggcagcagcaaggccagcagcctgcccggcagcctgcagagaagcagaagcgacatcgacgtgaacgccgccgccggcgccaaggcccaccacgccgccggccagagcgtgagaagcggcagactgggcgccggcgccctgaacgccggcagctacgccagcctggaggacaccagcgacaagctggacggcaccgccagcgaggacggcagagtgagagccaagctgagcgcccccctggccggcatgggcaacgccaaggccgacagcagaggcagaagcagaaccaagatggtgagccagagccagcccggcagcagaagcggcagccccggcagagtgctgaccaccaccgccctgagcaccgtgagcagcggcgtgcagagagtgctggtgaacagcgccagcgcccagaagagaagcaagatccccagaagccagggctgcagcagagaggccagccccagcagactgagcgtggccagaagcagcagaatccccagacccagcgtgagccagggctgcagcagagaggccagcagagagagcagcagagacaccagccccgtgagaagcttccagcccctgggccccggctacggcatcagccagagcagcagactgagcagcagcgtgagcgccatgagagtgctgaacaccggcagcgacgtggaggaggccgtggccgacgccctgaagaagcccgccagaagaagatacgagagctacggcatgcacagcgacgacgacgccaacagcgacgccagcagcgcctgcagcgagagaagctacagcagcagaaacggcagcatccccacctacatgagacagaccgaggacgtggccgaggtgctgaacagatgcgccagcagcaactggagcgagagaaaggagggcctgctgggcctgcagaacctgctgaagaaccagagaaccctgagcagagtggagctgaagagactgtgcgagatcttcaccagaatgttcgccgacccccacggcaagagagtgttcagcatgttcctggagaccctggtggacttcatccaggtgcacaaggacgacctgcaggactggctgttcgtgctgctgacccagctgctgaagaagatgggcgccgacctgctgggcagcgtgcaggccaaggtgcagaaggccctggacgtgaccagagagagcttccccaacgacctgcagttcaacatcctgatgagattcaccgtggaccagacccagacccccagcctgaaggtgaaggtggccatcctgaagtacatcgagaccctggccaagcagatggaccccggcgacttcatcaacagcagcgagaccagactggccgtgagcagagtgatcacctggaccaccgagcccaagagcagcgacgtgagaaaggccgcccagagcgtgctgatcagcctgttcgagctgaacacccccgagttcaccatgctgctgggcgccctgcccaagaccttccaggacggcgccaccaagctgctgcacaaccacctgagaaacaccggcaacggcacccagagcagcatgggcagccccctgaccagacccacccccagaagccccgccaactggagcagccccctgaccagccccaccaacaccagccagaacaccctgagccccagcgccttcgactacgacaccgagaacatgaacagcgaggacatctacagcagcctgagaggcgtgaccgaggccatccagaacttcagcttcagaagccaggaggacatgaacgagcccctgaagagagacagcaagaaggacgacggcgacagcatgtgcggcggccccggcatgagcgaccccagagccggcggcgacgccaccgacagcagccagaccgccctggacaacaaggccagcctgctgcacagcatgcccacccacagcagccccagaagcagagactacaacccctacaactacagcgacagcatcagccccttcaacaagagcgccctgaaggaggccatgttcgacgacgacgccgaccagttccccgacgacctgagcctggaccacagcgacctggtggccgagctgctgaaggagctgagcaaccacaacgagagagtggaggagagaaagatcgccctgtacgagctgatgaagctgacccaggaggagagcttcagcgtgtgggacgagcacttcaagaccatcctgctgctgctgctggagaccctgggcgacaaggagcccaccatcagagccctggccctgaaggtgctgagagagatcctgagacaccagcccgccagattcaagaactacgccgagctgaccgtgatgaagaccctggaggcccacaaggacccccacaaggaggtggtgagaagcgccgaggaggccgccagcgtgctggccaccagcatcagccccgagcagtgcatcaaggtgctgtgccccatcatccagaccgccgactaccccatcaacctggccgccatcaagatgcagaccaaggtgatcgagagagtgagcaaggagaccctgaacctgctgctgcccgagatcatgcccggcctgatccagggctacgacaacagcgagagcagcgtgagaaaggcctgcgtgttctgcctggtggccgtgcacgccgtgatcggcgacgagctgaagccccacctgagccagctgaccggcagcaagatgaagctgctgaacctgtacatcaagagagcccagaccggcagcggcggcgccgaccccaccaccgacgtgagcggccagagctag

SEQ ID NO: 78393 - DNA, 1296 bp, Artificial Sequence
  Description of Artificial Sequence: Synthetic coding sequence
atgagaagactgatctgcaagagaatctgcgactacaagagcttcgacgacgaggagagcgtggacggcaacagacccagcagcgccgccagcgccttcaaggtgcccgcccccaagaccagcggcaaccccgccaacagcgccagaaagcccggcagcgccggcggccccaaggtgggcggcgccagcaaggagggcggcgccggcgccgtggacgaggacgacttcatcaaggccttcaccgacgtgcccagcatccagatctacagcagcagagagctggaggagaccctgaacaagatcagagagatcctgagcgacgacaagcacgactgggaccagagagccaacgccctgaagaagatcagaagcctgctggtggccggcgccgcccagtacgactgcttcttccagcacctgagactgctggacggcgccctgaagctgagcgccaaggacctgagaagccaggtggtgagagaggcctgcatcaccgtggcccacctgagcaccgtgctgggcaacaagttcgaccacggcgccgaggccatcgtgcccaccctgttcaacctggtgcccaacagcgccaaggtgatggccaccagcggctgcgccgccatcagattcatcatcagacacacccacgtgcccagactgatccccctgatcaccagcaactgcaccagcaagagcgtgcccgtgagaagaagaagcttcgagttcctggacctgctgctgcaggagtggcagacccacagcctggagagacacgccgccgtgctggtggagaccatcaagaagggcatccacgacgccgacgccgaggccagagtggaggccagaaagacctacatgggcctgagaaaccacttccccggcgaggccgagaccctgtacaacagcctggagcccagctaccagaagagcctgcagacctacctgaagagcagcggcagcgtggccagcctgccccagagcgacagaagcagcagcagcagccaggagagcctgaacagacccttcagcagcaagtggagcaccgccaaccccagcaccgtggccggcagagtgagcgccggcagcagcaaggccagcagcctgcccggcagcctgcagagaagcagaagcgacatcgacgtgaacgccgccgccggcgccaaggcccaccacgccgccggccagagcgtgagaagcggcagactgggcgccggcgccctgaacgccggcagctacgccagcctggagtgcgaggccttctggagaagcggcagaaccgccaagctgtacagcgtgtag

SEQ ID NO: 78394 - DNA, 4518 bp, Artificial Sequence
  Description of Artificial Sequence: Synthetic coding sequence
atggagcccagaagcatggagtacttctgcgcccaggtgcagcagaaggacgtgggcggcagactgcaggtgggccaggagctgctgctgtacctgggcgcccccggcgccatcagcgacctggaggaggacctgggcagactgggcaagaccgtggacgccctgaccggctgggtgggcagcagcaactacagagtgagcctgatgggcctggagatcctgagcgccttcgtggacagactgagcaccagattcaagagctacgtggccatggtgatcgtggccctgatcgacagaatgggcgacgccaaggacaaggtgagagacgaggcccagaccctgatcctgaagctgatggaccaggtggccccccccatgtacatctgggagcagctggccagcggcttcaagcacaagaacttcagaagcagagagggcgtgtgcctgtgcctgatcgagaccctgaacatcttcggcgcccagcccctggtgatcagcaagctgatcccccacctgtgcatcctgttcggcgacagcaacagccaggtgagagacgccgccatcctggccatcgtggagatctacagacacgtgggcgagaaggtgagaatggacctgtacaagagaggcatcccccccgccagactggagatgatcttcgccaagttcgacgaggtgcagagcagcggcggcatgatcctgagcgtgtgcaaggacaagagcttcgacgacgaggagagcgtggacggcaacagacccagcagcgccgccagcgccttcaaggtgcccgcccccaagaccagcggcaaccccgccaacagcgccagaaagcccggcagcgccggcggccccaaggtgggcggcgccagcaaggagggcggcgccggcgccgtggacgaggacgacttcatcaaggccttcaccgacgtgcccagcatccagatctacagcagcagagagctggaggagaccctgaacaagatcagagagatcctgagcgacgacaagcacgactgggaccagagagccaacgccctgaagaagatcagaagcctgctggtggccggcgccgcccagtacgactgcttcttccagcacctgagactgctggacggcgccctgaagctgagcgccaaggacctgagaagccaggtggtgagagaggcctgcatcaccgtggcccacctgagcaccgtgctgggcaacaagttcgaccacggcgccgaggccatcgtgcccaccctgttcaacctggtgcccaacagcgccaaggtgatggccaccagcggctgcgccgccatcagattcatcatcagacacacccacgtgcccagactgatccccctgatcaccagcaactgcaccagcaagagcgtgcccgtgagaagaagaagcttcgagttcctggacctgctgctgcaggagtggcagacccacagcctggagagacacgccgccgtgctggtggagaccatcaagaagggcatccacgacgccgacgccgaggccagagtggaggccagaaagacctacatgggcctgagaaaccacttccccggcgaggccgagaccctgtacaacagcctggagcccagctaccagaagagcctgcagacctacctgaagagcagcggcagcgtggccagcctgccccagagcgacagaagcagcagcagcagccaggagagcctgaacagacccttcagcagcaagtggagcaccgccaaccccagcaccgtggccggcagagtgagcgccggcagcagcaaggccagcagcctgcccggcagcctgcagagaagcagaagcgacatcgacgtgaacgccgccgccggcgccaaggcccaccacgccgccggccagagcgtgagaagcggcagactgggcgccggcgccctgaacgccggcagctacgccagcctggaggacaccagcgacaagctggacggcaccgccagcgaggacggcagagtgagagccaagctgagcgcccccctggccggcatgggcaacgccaaggccgacagcagaggcagaagcagaaccaagatggtgagccagagccagcccggcagcagaagcggcagccccggcagagtgctgaccaccaccgccctgagcaccgtgagcagcggcgtgcagagagtgctggtgaacagcgccagcgcccagaagagaagcaagatccccagaagccagggctgcagcagagaggccagccccagcagactgagcgtggccagaagcagcagaatccccagacccagcgtgagccagggctgcagcagagaggccagcagagagagcagcagagacaccagccccgtgagaagcttccagcccctgggccccggctacggcatcagccagagcagcagactgagcagcagcgtgagcgccatgagagtgctgaacaccggcagcgacgtggaggaggccgtggccgacgccctgaagaagcccgccagaagaagatacgagagctacggcatgcacagcgacgacgacgccaacagcgacgccagcagcgcctgcagcgagagaagctacagcagcagaaacggcagcatccccacctacatgagacagaccgaggacgtggccgaggtgctgaacagatgcgccagcagcaactggagcgagagaaaggagggcctgctgggcctgcagaacctgctgaagaaccagagaaccctgagcagagtggagctgaagagactgtgcgagatcttcaccagaatgttcgccgacccccacggcaaggtgttcagcatgttcctggagaccctggtggacttcatccaggtgcacaaggacgacctgcaggactggctgttcgtgctgctgacccagctgctgaagaagatgggcgccgacctgctgggcagcgtgcaggccaaggtgcagaaggccctggacgtgaccagagagagcttccccaacgacctgcagttcaacatcctgatgagattcaccgtggaccagacccagacccccagcctgaaggtgaaggtggccatcctgaagtacatcgagaccctggccaagcagatggaccccggcgacttcatcaacagcagcgagaccagactggccgtgagcagagtgatcacctggaccaccgagcccaagagcagcgacgtgagaaaggccgcccagagcgtgctgatcagcctgttcgagctgaacacccccgagttcaccatgctgctgggcgccctgcccaagaccttccaggacggcgccaccaagctgctgcacaaccacctgagaaacaccggcaacggcacccagagcagcatgggcagccccctgaccagacccacccccagaagccccgccaactggagcagccccctgaccagccccaccaacaccagccagaacaccctgagccccagcgccttcgactacgacaccgagaacatgaacagcgaggacatctacagcagcctgagaggcgtgaccgaggccatccagaacttcagcttcagaagccaggaggacatgaacgagcccctgaagagagacagcaagaaggacgacggcgacagcatgtgcggcggccccggcatgagcgaccccagagccggcggcgacgccaccgacagcagccagaccgccctggacaacaaggccagcctgctgcacagcatgcccacccacagcagccccagaagcagagactacaacccctacaactacagcgacagcatcagccccttcaacaagagcgccctgaaggaggccatgttcgacgacgacgccgaccagttccccgacgacctgagcctggaccacagcgacctggtggccgagctgctgaaggagctgagcaaccacaacgagagagtggaggagagaaagatcgccctgtacgagctgatgaagctgacccaggaggagagcttcagcgtgtgggacgagcacttcaagaccatcctgctgctgctgctggagaccctgggcgacaaggagcccaccatcagagccctggccctgaaggtgctgagagagatcctgagacaccagcccgccagattcaagaactacgccgagctgaccgtgatgaagaccctggaggcccacaaggacccccacaaggaggtggtgagaagcgccgaggaggccgccagcgtgctggccaccagcatcagccccgagcagtgcatcaaggtgctgtgccccatcatccagaccgccgactaccccatcaacctggccgccatcaagatgcagaccaaggtgatcgagagagtgagcaaggagaccctgaacctgctgctgcccgagatcatgcccggcctgatccagggctacgacaacagcgagagcagcgtgagaaaggcctgcgtgttctgcctggtggccgtgcacgccgtgatcggcgacgagctgaagccccacctgagccagctgaccggcagcaagatgaagctgctgaacctgtacatcaagagagcccagaccggcagcggcggcgccgaccccaccaccgacgtgagcggccagagctag

SEQ ID NO: 78395 - DNA, 4542 bp, Artificial Sequence
  Description of Artificial Sequence: Synthetic coding sequence
atggagcccagaagcatggagtacttctgcgcccaggtgcagcagaaggacgtgggcggcagactgcaggtgggccaggagctgctgctgtacctgggcgcccccggcgccatcagcgacctggaggaggacctgggcagactgggcaagaccgtggacgccctgaccggctgggtgggcagcagcaactacagagtgagcctgatgggcctggagatcctgagcgccttcgtggacagactgagcaccagattcaagagctacgtggccatggtgatcgtggccctgatcgacagaatgggcgacgccaaggacaaggtgagagacgaggcccagaccctgatcctgaagctgatggaccaggtggccccccccatgtacatctgggagcagctggccagcggcttcaagcacaagaacttcagaagcagagagggcgtgtgcctgtgcctgatcgagaccctgaacatcttcggcgcccagcccctggtgatcagcaagctgatcccccacctgtgcatcctgttcggcgacagcaacagccaggtgagagacgccgccatcctggccatcgtggagatctacagacacgtgggcgagaaggtgagaatggacctgtacaagagaggcatcccccccgccagactggagatgatcttcgccaagttcgacgaggtgcagagcagcggcggcatgatcctgagcgtgtgcaaggacaagagcttcgacgacgaggagagcgtggacggcaacagacccagcagcgccgccagcgccttcaaggtgcccgcccccaagaccagcggcaaccccgccaacagcgccagaaagcccggcagcgccggcggccccaaggtgggcggcgccagcaaggagggcggcgccggcgccgtggacgaggacgacttcatcaaggccttcaccgacgtgcccagcatccagatctacagcagcagagagctggaggagaccctgaacaagatcagagagatcctgagcgacgacaagcacgactgggaccagagagccaacgccctgaagaagatcagaagcctgctggtggccggcgccgcccagtacgactgcttcttccagcacctgagactgctggacggcgccctgaagctgagcgccaaggacctgagaagccaggtggtgagagaggcctgcatcaccgtggcccacctgagcaccgtgctgggcaacaagttcgaccacggcgccgaggccatcgtgcccaccctgttcaacctggtgcccaacagcgccaaggtgatggccaccagcggctgcgccgccatcagattcatcatcagacacacccacgtgcccagactgatccccctgatcaccagcaactgcaccagcaagagcgtgcccgtgagaagaagaagcttcgagttcctggacctgctgctgcaggagtggcagacccacagcctggagagacacgccgccgtgctggtggagaccatcaagaagggcatccacgacgccgacgccgaggccagagtggaggccagaaagacctacatgggcctgagaaaccacttccccggcgaggccgagaccctgtacaacagcctggagcccagctaccagaagagcctgcagacctacctgaagagcagcggcagcgtggccagcctgccccagagcgacagaagcagcagcagcagccaggagagcctgaacagacccttcagcagcaagtggagcaccgccaaccccagcaccgtggccggcagagtgagcgccggcagcagcaaggccagcagcctgcccggcagcctgcagagaagcagaagcgacatcgacgtgaacgccgccgccggcgccaaggcccaccacgccgccggccagagcgtgagaagcggcagactgggcgccggcgccctgaacgccggcagctacgccagcctggaggacaccagcgacaagctggacggcaccgccagcgaggacggcagagtgagagccaagctgagcgcccccctggccggcatgggcaacgccaaggccgacagcagaggcagaagcagaaccaagatggtgagccagagccagcccggcagcagaagcggcagccccggcagagtgctgaccaccaccgccctgagcaccgtgagcagcggcgtgcagagagtgctggtgaacagcgccagcgcccagaagagaagcaagatccccagaagccagggctgcagcagagaggccagccccagcagactgagcgtggccagaagcagcagaatccccagacccagcgtgagccagggctgcagcagagaggccagcagagagagcagcagagacaccagccccgtgagaagcttccagcccctgggccccggctacggcatcagccagagcagcagactgagcagcagcgtgagcgccatgagagtgctgaacaccggcagcgacgtggaggaggccgtggccgacgccctgctgctgggcgacatcagaaccaagaagaagcccgccagaagaagatacgagagctacggcatgcacagcgacgacgacgccaacagcgacgccagcagcgcctgcagcgagagaagctacagcagcagaaacggcagcatccccacctacatgagacagaccgaggacgtggccgaggtgctgaacagatgcgccagcagcaactggagcgagagaaaggagggcctgctgggcctgcagaacctgctgaagaaccagagaaccctgagcagagtggagctgaagagactgtgcgagatcttcaccagaatgttcgccgacccccacggcaaggtgttcagcatgttcctggagaccctggtggacttcatccaggtgcacaaggacgacctgcaggactggctgttcgtgctgctgacccagctgctgaagaagatgggcgccgacctgctgggcagcgtgcaggccaaggtgcagaaggccctggacgtgaccagagagagcttccccaacgacctgcagttcaacatcctgatgagattcaccgtggaccagacccagacccccagcctgaaggtgaaggtggccatcctgaagtacatcgagaccctggccaagcagatggaccccggcgacttcatcaacagcagcgagaccagactggccgtgagcagagtgatcacctggaccaccgagcccaagagcagcgacgtgagaaaggccgcccagagcgtgctgatcagcctgttcgagctgaacacccccgagttcaccatgctgctgggcgccctgcccaagaccttccaggacggcgccaccaagctgctgcacaaccacctgagaaacaccggcaacggcacccagagcagcatgggcagccccctgaccagacccacccccagaagccccgccaactggagcagccccctgaccagccccaccaacaccagccagaacaccctgagccccagcgccttcgactacgacaccgagaacatgaacagcgaggacatctacagcagcctgagaggcgtgaccgaggccatccagaacttcagcttcagaagccaggaggacatgaacgagcccctgaagagagacagcaagaaggacgacggcgacagcatgtgcggcggccccggcatgagcgaccccagagccggcggcgacgccaccgacagcagccagaccgccctggacaacaaggccagcctgctgcacagcatgcccacccacagcagccccagaagcagagactacaacccctacaactacagcgacagcatcagccccttcaacaagagcgccctgaaggaggccatgttcgacgacgacgccgaccagttccccgacgacctgagcctggaccacagcgacctggtggccgagctgctgaaggagctgagcaaccacaacgagagagtggaggagagaaagatcgccctgtacgagctgatgaagctgacccaggaggagagcttcagcgtgtgggacgagcacttcaagaccatcctgctgctgctgctggagaccctgggcgacaaggagcccaccatcagagccctggccctgaaggtgctgagagagatcctgagacaccagcccgccagattcaagaactacgccgagctgaccgtgatgaagaccctggaggcccacaaggacccccacaaggaggtggtgagaagcgccgaggaggccgccagcgtgctggccaccagcatcagccccgagcagtgcatcaaggtgctgtgccccatcatccagaccgccgactaccccatcaacctggccgccatcaagatgcagaccaaggtgatcgagagagtgagcaaggagaccctgaacctgctgctgcccgagatcatgcccggcctgatccagggctacgacaacagcgagagcagcgtgagaaaggcctgcgtgttctgcctggtggccgtgcacgccgtgatcggcgacgagctgaagccccacctgagccagctgaccggcagcaagatgaagctgctgaacctgtacatcaagagagcccagaccggcagcggcggcgccgaccccaccaccgacgtgagcggccagagctag

SEQ ID NO: 78396 - DNA, 4545 bp, Artificial Sequence
  Description of Artificial Sequence: Synthetic coding sequence
atggagcccagaagcatggagtacttctgcgcccaggtgcagcagaaggacgtgggcggcagactgcaggtgggccaggagctgctgctgtacctgggcgcccccggcgccatcagcgacctggaggaggacctgggcagactgggcaagaccgtggacgccctgaccggctgggtgggcagcagcaactacagagtgagcctgatgggcctggagatcctgagcgccttcgtggacagactgagcaccagattcaagagctacgtggccatggtgatcgtggccctgatcgacagaatgggcgacgccaaggacaaggtgagagacgaggcccagaccctgatcctgaagctgatggaccaggtggccccccccatgtacatctgggagcagctggccagcggcttcaagcacaagaacttcagaagcagagagggcgtgtgcctgtgcctgatcgagaccctgaacatcttcggcgcccagcccctggtgatcagcaagctgatcccccacctgtgcatcctgttcggcgacagcaacagccaggtgagagacgccgccatcctggccatcgtggagatctacagacacgtgggcgagaaggtgagaatggacctgtacaagagaggcatcccccccgccagactggagatgatcttcgccaagttcgacgaggtgcagagcagcggcggcatgatcctgagcgtgtgcaaggacaagagcttcgacgacgaggagagcgtggacggcaacagacccagcagcgccgccagcgccttcaaggtgcccgcccccaagaccagcggcaaccccgccaacagcgccagaaagcccggcagcgccggcggccccaaggtgggcgccggcgccagcaaggagggcggcgccggcgccgtggacgaggacgacttcatcaaggccttcaccgacgtgcccagcatccagatctacagcagcagagagctggaggagaccctgaacaagatcagagagatcctgagcgacgacaagcacgactgggaccagagagccaacgccctgaagaagatcagaagcctgctggtggccggcgccgcccagtacgactgcttcttccagcacctgagactgctggacggcgccctgaagctgagcgccaaggacctgagaagccaggtggtgagagaggcctgcatcaccgtggcccacctgagcaccgtgctgggcaacaagttcgaccacggcgccgaggccatcgtgcccaccctgttcaacctggtgcccaacagcgccaaggtgatggccaccagcggctgcgccgccatcagattcatcatcagacacacccacgtgcccagactgatccccctgatcaccagcaactgcaccagcaagagcgtgcccgtgagaagaagaagcttcgagttcctggacctgctgctgcaggagtggcagacccacagcctggagagacacgccgccgtgctggtggagaccatcaagaagggcatccacgacgccgacgccgaggccagagtggaggccagaaagacctacatgggcctgagaaaccacttccccggcgaggccgagaccctgtacaacagcctggagcccagctaccagaagagcctgcagacctacctgaagagcagcggcagcgtggccagcctgccccagagcgacagaagcagcagcagcagccaggagagcctgaacagacccttcagcagcaagtggagcaccgccaaccccagcaccgtggccggcagagtgagcgccggcagcagcaaggccagcagcctgcccggcagcctgcagagaagcagaagcgacatcgacgtgaacgccgccgccggcgccaaggcccaccacgccgccggccagagcgtgagaagcggcagactgggcgccggcgccctgaacgccggcagctacgccagcctggaggacaccagcgacaagctggacggcaccgccagcgaggacggcagagtgagagccaagctgagcgcccccctggccggcatgggcaacgccaaggccgacagcagaggcagaagcagaaccaagatggtgagccagagccagcccggcagcagaagcggcagccccggcagagtgctgaccaccaccgccctgagcaccgtgagcagcggcgtgcagagagtgctggtgaacagcgccagcgcccagaagagaagcaagatccccagaagccagggctgcagcagagaggccagccccagcagactgagcgtggccagaagcagcagaatccccagacccagcgtgagccagggctgcagcagagaggccagcagagagagcagcagagacaccagccccgtgagaagcttccagcccctgggccccggctacggcatcagccagagcagcagactgagcagcagcgtgagcgccatgagagtgctgaacaccggcagcgacgtggaggaggccgtggccgacgccctgctgctgggcgacatcagaaccaagaagaagcccgccagaagaagatacgagagctacggcatgcacagcgacgacgacgccaacagcgacgccagcagcgcctgcagcgagagaagctacagcagcagaaacggcagcatccccacctacatgagacagaccgaggacgtggccgaggtgctgaacagatgcgccagcagcaactggagcgagagaaaggagggcctgctgggcctgcagaacctgctgaagaaccagagaaccctgagcagagtggagctgaagagactgtgcgagatcttcaccagaatgttcgccgacccccacggcaaggtgttcagcatgttcctggagaccctggtggacttcatccaggtgcacaaggacgacctgcaggactggctgttcgtgctgctgacccagctgctgaagaagatgggcgccgacctgctgggcagcgtgcaggccaaggtgcagaaggccctggacgtgaccagagagagcttccccaacgacctgcagttcaacatcctgatgagattcaccgtggaccagacccagacccccagcctgaaggtgaaggtggccatcctgaagtacatcgagaccctggccaagcagatggaccccggcgacttcatcaacagcagcgagaccagactggccgtgagcagagtgatcacctggaccaccgagcccaagagcagcgacgtgagaaaggccgcccagagcgtgctgatcagcctgttcgagctgaacacccccgagttcaccatgctgctgggcgccctgcccaagaccttccaggacggcgccaccaagctgctgcacaaccacctgagaaacaccggcaacggcacccagagcagcatgggcagccccctgaccagacccacccccagaagccccgccaactggagcagccccctgaccagccccaccaacaccagccagaacaccctgagccccagcgccttcgactacgacaccgagaacatgaacagcgaggacatctacagcagcctgagaggcgtgaccgaggccatccagaacttcagcttcagaagccaggaggacatgaacgagcccctgaagagagacagcaagaaggacgacggcgacagcatgtgcggcggccccggcatgagcgaccccagagccggcggcgacgccaccgacagcagccagaccgccctggacaacaaggccagcctgctgcacagcatgcccacccacagcagccccagaagcagagactacaacccctacaactacagcgacagcatcagccccttcaacaagagcgccctgaaggaggccatgttcgacgacgacgccgaccagttccccgacgacctgagcctggaccacagcgacctggtggccgagctgctgaaggagctgagcaaccacaacgagagagtggaggagagaaagatcgccctgtacgagctgatgaagctgacccaggaggagagcttcagcgtgtgggacgagcacttcaagaccatcctgctgctgctgctggagaccctgggcgacaaggagcccaccatcagagccctggccctgaaggtgctgagagagatcctgagacaccagcccgccagattcaagaactacgccgagctgaccgtgatgaagaccctggaggcccacaaggacccccacaaggaggtggtgagaagcgccgaggaggccgccagcgtgctggccaccagcatcagccccgagcagtgcatcaaggtgctgtgccccatcatccagaccgccgactaccccatcaacctggccgccatcaagatgcagaccaaggtgatcgagagagtgagcaaggagaccctgaacctgctgctgcccgagatcatgcccggcctgatccagggctacgacaacagcgagagcagcgtgagaaaggcctgcgtgttctgcctggtggccgtgcacgccgtgatcggcgacgagctgaagccccacctgagccagctgaccggcagcaagatgaagctgctgaacctgtacatcaagagagcccagaccggcagcggcggcgccgaccccaccaccgacgtgagcggccagagctag

SEQ ID NO: 78397 - DNA, 3882 bp, Artificial Sequence
  Description of Artificial Sequence: Synthetic coding sequence
atggccatgggcgacgacaagagcttcgacgacgaggagagcgtggacggcaacagacccagcagcgccgccagcgccttcaaggtgcccgcccccaagaccagcggcaaccccgccaacagcgccagaaagcccggcagcgccggcggccccaaggtgggcggcgccagcaaggagggcggcgccggcgccgtggacgaggacgacttcatcaaggccttcaccgacgtgcccagcatccagatctacagcagcagagagctggaggagaccctgaacaagatcagagagatcctgagcgacgacaagcacgactgggaccagagagccaacgccctgaagaagatcagaagcctgctggtggccggcgccgcccagtacgactgcttcttccagcacctgagactgctggacggcgccctgaagctgagcgccaaggacctgagaagccaggtggtgagagaggcctgcatcaccgtggcccacctgagcaccgtgctgggcaacaagttcgaccacggcgccgaggccatcgtgcccaccctgttcaacctggtgcccaacagcgccaaggtgatggccaccagcggctgcgccgccatcagattcatcatcagacacacccacgtgcccagactgatccccctgatcaccagcaactgcaccagcaagagcgtgcccgtgagaagaagaagcttcgagttcctggacctgctgctgcaggagtggcagacccacagcctggagagacacgccgccgtgctggtggagaccatcaagaagggcatccacgacgccgacgccgaggccagagtggaggccagaaagacctacatgggcctgagaaaccacttccccggcgaggccgagaccctgtacaacagcctggagcccagctaccagaagagcctgcagacctacctgaagagcagcggcagcgtggccagcctgccccagagcgacagaagcagcagcagcagccaggagagcctgaacagacccttcagcagcaagtggagcaccgccaaccccagcaccgtggccggcagagtgagcgccggcagcagcaaggccagcagcctgcccggcagcctgcagagaagcagaagcgacatcgacgtgaacgccgccgccggcgccaaggcccaccacgccgccggccagagcgtgagaagcggcagactgggcgccggcgccctgaacgccggcagctacgccagcctggaggacaccagcgacaagctggacggcaccgccagcgaggacggcagagtgagagccaagctgagcgcccccctggccggcatgggcaacgccaaggccgacagcagaggcagaagcagaaccaagatggtgagccagagccagcccggcagcagaagcggcagccccggcagagtgctgaccaccaccgccctgagcaccgtgagcagcggcgtgcagagagtgctggtgaacagcgccagcgcccagaagagaagcaagatccccagaagccagggctgcagcagagaggccagccccagcagactgagcgtggccagaagcagcagaatccccagacccagcgtgagccagggctgcagcagagaggccagcagagagagcagcagagacaccagccccgtgagaagcttccagcccctggccagcagacaccacagcagaagcaccggcgccctgtacgcccccgaggtgtacggcgccagcggccccggctacggcatcagccagagcagcagactgagcagcagcgtgagcgccatgagagtgctgaacaccggcagcgacgtggaggaggccgtggccgacgccctgaagaagcccgccagaagaagatacgagagctacggcatgcacagcgacgacgacgccaacagcgacgccagcagcgcctgcagcgagagaagctacagcagcagaaacggcagcatccccacctacatgagacagaccgaggacgtggccgaggtgctgaacagatgcgccagcagcaactggagcgagagaaaggagggcctgctgggcctgcagaacctgctgaagaaccagagaaccctgagcagagtggagctgaagagactgtgcgagatcttcaccagaatgttcgccgacccccacggcaaggtgttcagcatgttcctggagaccctggtggacttcatccaggtgcacaaggacgacctgcaggactggctgttcgtgctgctgacccagctgctgaagaagatgggcgccgacctgctgggcagcgtgcaggccaaggtgcagaaggccctggacgtgaccagagagagcttccccaacgacctgcagttcaacatcctgatgagattcaccgtggaccagacccagacccccagcctgaaggtgaaggtggccatcctgaagtacatcgagaccctggccaagcagatggaccccggcgacttcatcaacagcagcgagaccagactggccgtgagcagagtgatcacctggaccaccgagcccaagagcagcgacgtgagaaaggccgcccagagcgtgctgatcagcctgttcgagctgaacacccccgagttcaccatgctgctgggcgccctgcccaagaccttccaggacggcgccaccaagctgctgcacaaccacctgagaaacaccggcaacggcacccagagcagcatgggcagccccctgaccagacccacccccagaagccccgccaactggagcagccccctgaccagccccaccaacaccagccagaacaccctgagccccagcgccttcgactacgacaccgagaacatgaacagcgaggacatctacagcagcctgagaggcgtgaccgaggccatccagaacttcagcttcagaagccaggaggacatgaacgagcccctgaagagagacagcaagaaggacgacggcgacagcatgtgcggcggccccggcatgagcgaccccagagccggcggcgacgccaccgacagcagccagaccgccctggacaacaaggccagcctgctgcacagcatgcccacccacagcagccccagaagcagagactacaacccctacaactacagcgacagcatcagccccttcaacaagagcgccctgaaggaggccatgttcgacgacgacgccgaccagttccccgacgacctgagcctggaccacagcgacctggtggccgagctgctgaaggagctgagcaaccacaacgagagagtggaggagagaaagatcgccctgtacgagctgatgaagctgacccaggaggagagcttcagcgtgtgggacgagcacttcaagaccatcctgctgctgctgctggagaccctgggcgacaaggagcccaccatcagagccctggccctgaaggtgctgagagagatcctgagacaccagcccgccagattcaagaactacgccgagctgaccgtgatgaagaccctggaggcccacaaggacccccacaaggaggtggtgagaagcgccgaggaggccgccagcgtgctggccaccagcatcagccccgagcagtgcatcaaggtgctgtgccccatcatccagaccgccgactaccccatcaacctggccgccatcaagatgcagaccaaggtgatcgagagagtgagcaaggagaccctgaacctgctgctgcccgagatcatgcccggcctgatccagggctacgacaacagcgagagcagcgtgagaaaggcctgcgtgttctgcctggtggccgtgcacgccgtgatcggcgacgagctgaagccccacctgagccagctgaccggcagcaagatgaagctgctgaacctgtacatcaagagagcccagaccggcagcggcggcgccgaccccaccaccgacgtgagcggccagagctag

SEQ ID NO: 78398 - DNA, 3192 bp, Artificial Sequence
  Description of Artificial Sequence: Synthetic coding sequence
atgagaagactgatctgcaagagaatctgcgactacaagagcttcgacgacgaggagagcgtggacggcaacagacccagcagcgccgccagcgccttcaaggtgcccgcccccaagaccagcggcaaccccgccaacagcgccagaaagcccggcagcgccggcggccccaaggtgggcgagctgctgagcatcatgatctacagcagcagagagctggaggagaccctgaacaagatcagagagatcctgagcgacgacaagcacgactgggaccagagagccaacgccctgaagaagatcagaagcctgctggtggccggcgccgcccagtacgactgcttcttccagcacctgagactgctggacggcgccctgaagctgagcgccaaggacctgagaagccaggtggtgagagaggcctgcatcaccgtggcccacctgagcaccgtgctgggcaacaagttcgaccacggcgccgaggccatcgtgcccaccctgttcaacctggtgcccaacagcgccaaggtgatggccaccagcggctgcgccgccatcagattcatcatcagacacacccacgtgcccagactgatccccctgatcaccagcaactgcaccagcaagagcgtgcccgtgagaagaagaagcttcgagttcctggacctgctgctgcaggagtggcagacccacagcctggagagacacgccgccgtgctggtggagaccatcaagaagggcatccacgacgccgacgccgaggccagagtggaggccagaaagacctacatgggcctgagaaaccacttccccggcgaggccgagaccctgtacaacagcctggagcccagctaccagaagagcctgcagacctacctgaagagcagcggcagcgtggccagcctgccccagagcgacagaagcagcagcagcagccaggagagcctgaacagacccttcagcagcaagtggagcaccgccaaccccagcaccgtggccggcagagtgagcgccggcagcagcaaggccagcagcctgcccggcagcctgcagagaagcagaagcgacatcgacgtgaacgccgccgccggcgccaaggcccaccacgccgccggccagagcgtgagaagcggcagactgggcgccggcgccctgaacgccggcagctacgccagcctggaggacaccagcgacaagctggacgacctgttcagcgacaacggcagagtgagagccaagctgagcgcccccctggccggcatgggcaacgccaaggccgacagcagaggcagaagcagaaccaagatggtgagccagagccagagaagcagcagccccgacaagaacgagggcagccagagcgccaacaccatcggcgccggcagcagaagcggcagccccggcagagtgctgaccaccaccgccctgagcaccgtgagcagcggcgtgcagagagtgctggtgaacagcgccagcgcccagaagagaagcaagatccccagaagccagggctgcagcagagaggccagccccagcagactgagcgtggccagaagcagcagaatccccagacccagcgtgagccagggctgcagcagagaggccagcagagagagcagcagagacaccagccccgtgagaagcttccagcccctgggccccggctacggcatcagccagagcagcagactgagcagcagcgtgagcgccatgagagtgctgaacaccggcagcgacgtggaggaggccgtggccgacgccctggtgctgttcgacttcaagaccaagaagaagcccgccagaagaagatacgagagctacggcatgcacagcgacgacgacgccaacagcgacgccagcagcgcctgcagcgagagaagctacagcagcagaaacggcagcatccccacctacatgagacagaccgaggacgtggccgaggtgctgaacagatgcgccagcagcaactggagcgagagaaaggagggcctgctgggcctgcagaacctgctgaagaaccagagaaccctgagcagagtggagctgaagagactgtgcgagatcttcaccagaatgttcgccgacccccacggcaaggtgttcagcatgttcctggagaccctggtggacttcatccaggtgcacaaggacgacctgcaggactggctgttcgtgctgctgacccagctgctgaagaagatgggcgccgacctgctgggcagcgtgcaggccaaggtgcagaaggccctggacgtgaccagagagagcttccccaacgacctgcagttcaacatcctgatgagattcaccgtggaccagacccagacccccagcctgaaggtgaaggtggccatcctgaagtacatcgagaccctggccaagcagatggaccccggcgacttcatcaacagcagcgagaccagactggccgtgagcagagtgatcacctggaccaccgagcccaagagcagcgacgtgagaaaggccgcccagagcgtgctgatcagcctgttcgagctgaacacccccgagttcaccatgctgctgggcgccctgcccaagaccttccaggacggcgccaccaagctgctgcacaaccacctgagaaacaccggcaacggcacccagagcagcatgggcagccccctgaccagacccacccccagaagccccgccaactggagcagccccctgaccagccccaccaacaccagccagaacaccctgagccccagcgccttcgactacgacaccgagaacatgaacagcgaggacatctacagcagcctgagaggcgtgaccgaggccatccagaacttcagcttcagaagccaggaggacatgaacgagcccctgaagagagacagcaagaaggacgacggcgacagcatgtgcggcggccccggcatgagcgaccccagagccggcggcgacgccaccgacagcagccagaccgccctggacaacaaggccagcctgctgcacagcatgcccacccacagcagccccagaagcagagactacaacccctacaactacagcgacagcatcagccccttcaacaagagcgccctgaaggaggccatgttcgacgacgacgccgaccagttccccgacgacctgagcctggaccacagcgacctggtggccgagctgctgaaggagctgagcaaccacaacgagagagtgtag

SEQ ID NO: 78399 - DNA, 1680 bp, Artificial Sequence
  Description of Artificial Sequence: Synthetic coding sequence
atgcccccccccagccccgacagcgagaacggcttctaccccggcctgcccagcagcatgaaccccgccttcttccccagcttcagccccgtgagcccccacggctgcaccggcctgagcgtgcccaccagcggcggcggcggcggcggcttcggcggccccttcagcgccaccgccgtgccccccccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggacagaagcagaatgtacgacagcctgaacatgcacagcctggagaacagcctgatcgacatcatgagagccgagcacgaccccctgaagggcagactgagctacccccaccccggcaccgacaacctgctgatgctgaacggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78400 - DNA, 1731 bp, Artificial Sequence
  Description of Artificial Sequence: Synthetic coding sequence
atgcccccccccagccccgacagcgagaacggcttctaccccggcctgcccagcagcatgaaccccgccttcttccccagcttcagccccgtgagcccccacggctgcaccggcctgagcgtgccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggtgagaagcagcctgcagctgcccgcctggggcagcgacagcctgcaggacagctggtgcaccgccgccggcaccagcagaatcgaccaggacagaagcagaatgtacgacagcctgaacatgcacagcctggagaacagcctgatcgacatcatgagagccgagcacgaccccctgaagggcagactgagctacccccaccccggcaccgacaacctgctgatgctgaacgccagaagctacggcagaagaagaggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78401 - DNA, 1704 bp, Artificial Sequence
  Description of Artificial Sequence: Synthetic coding sequence
atgcccccccccagccccgacagcgagaacggcttctaccccggcctgcccagcagcatgaaccccgccttcttccccagcttcagccccgtgagcccccacggctgcaccggcctgagcgtgcccaccagcggcggcggcggcggcggcttcggcggccccttcagcgccaccgccgtgccccccccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggacagaagcagaatgtacgacagcctgaacatgcacagcctggagaacagcctgatcgacatcatgagagccgagcacgaccccctgaagggcagactgagctacccccaccccggcaccgacaacctgctgatgctgaacgccagaagctacggcagaagaagaggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78402 - DNA, 1689 bp, Artificial Sequence
  Description of Artificial Sequence: Synthetic coding sequence
atgcccccccccagccccgacagcgagaacggcttctaccccggcctgcccagcagcatgaaccccgccttcttccccagcttcagccccgtgagcccccacggctgcaccggcctgagcgtgcccaccagcggcggcggcggcggcggcttcggcggccccttcagcgccaccgccgtgccccccccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggtgagaatggacagaagcagaatgtacgacagcctgaacatgcacagcctggagaacagcctgatcgacatcatgagagccgagcacgaccccctgaagggcagactgagctacccccaccccggcaccgacaacctgctgatgctgaacggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78403 - DNA, 3024 bp, Artificial Sequence
  Description of Artificial Sequence: Synthetic coding sequence
atgagagacttcggcttcggcgtgctgcagaccgcccccctgagaagcagcagccccggccccctgttctgcggcgaggcctacggcccctacgccgtgggcagcgtgaaccccctgcccagcgccacccccttcggccccctgagccccccccccctgcccgtgaccggcttcctggaggccgccagccccttcagcgtgcccctgggcggcggcgccggcagccccgccgccgccgccagcagcagcagccccttcctggcccaccagcagaccatgcaggacgagctgctgctgggcctgacccagcagcccgccagacccctgagcggcgccgccgccaccgagaagctgcccgaccaccaccccggcggcggcaccatcgccggcgtgacccacctgctgcccagccaggacttcaagcccagcctgcaccaccccagcagcagcagcgccagcagctgctgctgctgcagaaccagcagcccccaggacttcagcaagagacagcagcagcagctgagcagccagaagagaaaggagttcagccccccccacctgccccacccccccgacagcaagcccccccccccccccccccccctgcactgccccggcagattcagccccccccccccccccgccggccccctgctgcagcccgcccagctggcccagagacagcagcagcagcccccccagcagttcagcctgctgcaccagcagcacctgagcccccaggacttcgcccccagacagagacccgccgacctgccccccctgccccagctgccccccagcccccccgccgcccccagaagaagacacggcggcgccggcagccccagaaagacccccgccgccggcgagggcagcgccgccgagagccccaacgccggcctggccagcagcacccccgtgaaccccgcccccggcagcatggagagccccaaccaccccctgctgaacagccccagcaacctgctgcccggcggcgccctgggcgccggcgccttcagcagcctgcagagccccgacctgccccaccccggcggcggcggcggcggcggcggcggcggcccccccggcggcggcggcggcggcggcagcgccagccccccccccctgcccggcttcggcaccccctggagcgtgcagaccgccagcccccccccccagccccagcagcccccccccacccagccccagcagcagcccccccccccccagcagcccccccagccccagccccagccccccggcagcagcgccaccacccccggcggcggcagcggcggcagcctgagcgccatgcccccccccagccccgacagcgagaacggcttctaccccggcctgcccagcagcatgaaccccgccttcttccccagcttcagccccgtgagcccccacggctgcaccggcctgagcgtgcccaccagcggcggcggcggcggcggcttcggcggccccttcagcgccaccgccgtgccccccccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggtgagaatggacagaagcagaatgtacgacagcctgaacatgcacagcctggagaacagcctgatcgacatcatgagagccgagcacgaccccctgaagggcagactgagctacccccaccccggcaccgacaacctgctgatgctgaacgccagaagctacggcagaagaagaggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78404 - DNA, 1770 bp, Artificial Sequence
  Description of Artificial Sequence: Synthetic coding sequence
atgcccccccccagccccgacagcgagaacggcttctaccccggcctgcccagcagcatgaaccccgccttcttccccagcttcagccccgtgagcccccacggctgcaccggcctgagcgtgcccaccagcggcggcggcggcggcggcttcggcggccccttcagcgccaccgccgtgccccccccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggtgagaagcagcctgcagctgcccgcctggggcagcgacagcctgcaggacagctggtgcaccgccgccggcaccagcagaatcgaccaggacagaagcagaatgtacgacagcctgaacatgcacagcctggagaacagcctgatcgacatcatgagagccgagcacgaccccctgaagggcagactgagctacccccaccccggcaccgacaacctgctgatgctgaacggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78405 - DNA, 3105 bp, Artificial Sequence
  Description of Artificial Sequence: Synthetic coding sequence
atgagagacttcggcttcggcgtgctgcagaccgcccccctgagaagcagcagccccggccccctgttctgcggcgaggcctacggcccctacgccgtgggcagcgtgaaccccctgcccagcgccacccccttcggccccctgagccccccccccctgcccgtgaccggcttcctggaggccgccagccccttcagcgtgcccctgggcggcggcgccggcagccccgccgccgccgccagcagcagcagccccttcctggcccaccagcagaccatgcaggacgagctgctgctgggcctgacccagcagcccgccagacccctgagcggcgccgccgccaccgagaagctgcccgaccaccaccccggcggcggcaccatcgccggcgtgacccacctgctgcccagccaggacttcaagcccagcctgcaccaccccagcagcagcagcgccagcagctgctgctgctgcagaaccagcagcccccaggacttcagcaagagacagcagcagcagctgagcagccagaagagaaaggagttcagccccccccacctgccccacccccccgacagcaagcccccccccccccccccccccctgcactgccccggcagattcagccccccccccccccccgccggccccctgctgcagcccgcccagctggcccagagacagcagcagcagcccccccagcagttcagcctgctgcaccagcagcacctgagcccccaggacttcgcccccagacagagacccgccgacctgccccccctgccccagctgccccccagcccccccgccgcccccagaagaagacacggcggcgccggcagccccagaaagacccccgccgccggcgagggcagcgccgccgagagccccaacgccggcctggccagcagcacccccgtgaaccccgcccccggcagcatggagagccccaaccaccccctgctgaacagccccagcaacctgctgcccggcggcgccctgggcgccggcgccttcagcagcctgcagagccccgacctgccccaccccggcggcggcggcggcggcggcggcggcggcccccccggcggcggcggcggcggcggcagcgccagccccccccccctgcccggcttcggcaccccctggagcgtgcagaccgccagcccccccccccagccccagcagcccccccccacccagccccagcagcagcccccccccccccagcagcccccccagccccagccccagccccccggcagcagcgccaccacccccggcggcggcagcggcggcagcctgagcgccatgcccccccccagccccgacagcgagaacggcttctaccccggcctgcccagcagcatgaaccccgccttcttccccagcttcagccccgtgagcccccacggctgcaccggcctgagcgtgcccaccagcggcggcggcggcggcggcttcggcggccccttcagcgccaccgccgtgccccccccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggtgagaagcagcctgcagctgcccgcctggggcagcgacagcctgcaggacagctggtgcaccgccgccggcaccagcagaatcgaccaggacagaagcagaatgtacgacagcctgaacatgcacagcctggagaacagcctgatcgacatcatgagagccgagcacgaccccctgaagggcagactgagctacccccaccccggcaccgacaacctgctgatgctgaacgccagaagctacggcagaagaagaggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78406 - DNA, 3081 bp, Artificial Sequence
  Description of Artificial Sequence: Synthetic coding sequence
atgagagacttcggcttcggcgtgctgcagaccgcccccctgagaagcagcagccccggccccctgttctgcggcgaggcctacggcccctacgccgtgggcagcgtgaaccccctgcccagcgccacccccttcggccccctgagccccccccccctgcccgtgaccggcttcctggaggccgccagccccttcagcgtgcccctgggcggcggcgccggcagccccgccgccgccgccagcagcagcagccccttcctggcccaccagcagaccatgcaggacgagctgctgctgggcctgacccagcagcccgccagacccctgagcggcgccgccgccaccgagaagctgcccgaccaccaccccggcggcggcaccatcgccggcgtgacccacctgctgcccagccaggacttcaagcccagcctgcaccaccccagcagcagcagcgccagcagctgctgctgctgcagaaccagcagcccccaggacttcagcaagagacagcagcagcagctgagcagccagaagagaaaggagttcagccccccccacctgccccacccccccgacagcaagcccccccccccccccccccccctgcactgccccggcagattcagccccccccccccccccgccggccccctgctgcagcccgcccagctggcccagagacagcagcagcagcccccccagcagttcagcctgctgcaccagcagcacctgagcccccaggacttcgcccccagacagagacccgccgacctgccccccctgccccagctgccccccagcccccccgccgcccccagaagaagacacggcggcgccggcagccccagaaagacccccgccgccggcgagggcagcgccgccgagagccccaacgccggcctggccagcagcacccccgtgaaccccgcccccggcagcatggagagccccaaccaccccctgctgaacagccccagcaacctgctgcccggcggcgccctgggcgccggcgccttcagcagcctgcagagccccgacctgccccaccccggcggcggcggcggcggcggcggcggcggcccccccggcggcggcggcggcggcggcagcgccagccccccccccctgcccggcttcggcaccccctggagcgtgcagaccgccagcccccccccccagccccagcagcccccccccacccagccccagcagcagcccccccccccccagcagcccccccagccccagccccagccccccggcagcagcgccaccacccccggcggcggcagcggcggcagcctgagcgccatgcccccccccagccccgacagcgagaacggcttctaccccggcctgcccagcagcatgaaccccgccttcttccccagcttcagccccgtgagcccccacggctgcaccggcctgagcgtgcccaccagcggcggcggcggcggcggcttcggcggccccttcagcgccaccgccgtgccccccccccccccccccgccatgaacatcccccagcagcagccccccccccccgccgccccccagcagccccagagcagaagaagccccgtgagcccccagctgcagcagcagcaccaggccgccgccgccgccttcctgcagcagagaaacagctacaaccaccaccagcccctgctgaagcagagcccctggagcaaccaccagagcagcggctggggcaccggcagcatgagctggggcgccatgcacggcagagaccacagaagaaccggcaacatgggcatccccggcaccatgaaccagatcagccccctgaagaagcccttcagcggcaacgtgatcgccccccccaagttcaccagaagcacccccagcctgacccccaagagctggatcgaggacaacgtgttcagaaccgacaacaacagcaacaccctgctgcccctgcaggtgagaagcagcctgcagctgcccgcctggggcagcgacagcctgcaggacagctggtgcaccgccgccggcaccagcagaatcgaccaggacagaagcagaatgtacgacagcctgaacatgcacagcctggagaacagcctgatcgacatcatgagagccgagcacgaccccctgaagggcagactgagctacccccaccccggcaccgacaacctgctgatgctgaacggcagaagcagcctgttccccatcgacgacggcctgctggacgacggccacagcgaccaggtgggcgtgctgaacagccccacctgctacagcgcccaccagaacggcgagagaatcgagagattcagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgacatcgacaagagagtggaggtgaagccctacgtgctggacgaccagatgtgcgacgagtgccagggcgccagatgcggcggcaagttcgcccccttcttctgcgccaacgtgacctgcctgcagtactactgcgagttctgctgggccaacatccacagcagagccggcagagagttccacaagcccctggtgaaggagggcgccgacagacccagacagatccacttcagatggaactag

SEQ ID NO: 78407 - DNA, 2097 bp, Artificial Sequence
  Description of Artificial Sequence: Synthetic coding sequence
atgcaggacgacctgctgatggacaagagcaagacccagccccagccccagcagcagcagagacagcagcagcagccccagcccgagagcagcgtgagcgaggcccccagcacccccctgagcagcgagacccccaagcccgaggagaacagcgccgtgcccgccctgagccccgccgccgccccccccgcccccaacggccccgacaagatgcagatggagagccccctgctgcccggcctgagcttccaccagcccccccagcagcccccccccccccaggagcccgccgcccccggcgccagcctgagccccagcttcggcagcacctggagcaccggcaccaccaacgccgtggaggacagcttcttccagggcatcacccccgtgaacggcaccatgctgttccagaacttcccccaccacgtgaaccccgtgttcggcggcaccttcagcccccagatcggcctggcccagacccagcaccaccagcagccccccccccccgcccccgccccccagcccgcccagcccgcccagcccccccaggcccagcccccccagcagagaagaagccccgccagccccagccaggccccctacgcccagagaagcgccgccgccgcctacggccaccagcccatcatgaccagcaagcccagcagcagcagcgccgtggccgccgccgccgccgccgccgccgccagcagcgccagcagcagctggaacacccaccagagcgtgaacgccgcctggagcgcccccagcaacccctggggcggcctgcaggccggcagagaccccagaagagccgtgggcgtgggcgtgggcgtgggcgtgggcgtgcccagccccctgaaccccatcagccccctgaagaagcccttcagcagcaacgtgatcgccccccccaagttccccagagccgcccccctgaccagcaagagctggatggaggacaacgccttcagaaccgacaacggcaacaacctgctgcccttccaggacagaagcagaccctacgacaccttcaacctgcacagcctggagaacagcctgatggacatgatcagaaccgaccacgagcccctgaagggcaagcactacccccccagcggcccccccatgagcttcgccgacatcatgtggagaaaccacttcgccggcagaatgggcatcaacttccaccaccccggcaccgacaacatcatggccctgaacaacgccttcctggacgacagccacggcgaccaggccctgagcagcggcctgagcagccccaccagatgccagaacggcgagagagtggagagatacagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcctggaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacaacgacatcgacaagagagtggaggtgaagccctacgtgctggacgaccagatgtgcgacgagtgccagggcaccagatgcggcggcaagttcgcccccttcttctgcgccaacgtgacctgcctgcagtactactgcgagtactgctgggccagcatccacagcagagccggcagagagttccacaagcccctggtgaaggagggcggcgacagacccagacacgtgcccttcagatggagctag

SEQ ID NO: 78408 - DNA, 2055 bp, Artificial Sequence
  Description of Artificial Sequence: Synthetic coding sequence
atgcaggacgacctgctgatggacaagagcaagacccagccccagccccagcagcagcagagacagcagcagcagccccagcccgagagcagcgtgagcgaggcccccagcacccccctgagcagcgagacccccaagcccgaggagaacagcgccgtgcccgccctgagccccgccgccgccccccccgcccccaacggccccgacaagatgcagatggagagccccctgctgcccggcctgagcttccaccagcccccccagcagcccccccccccccaggagcccgccgcccccggcgccagcctgagccccagcttcggcagcacctggagcaccggcaccaccaacgccgtggaggacagcttcttccagggcatcacccccgtgaacggcaccatgctgttccagaacttcccccaccacgtgaaccccgtgttcggcggcaccttcagcccccagatcggcctggcccagacccagcaccaccagcagccccccccccccgcccccgccccccagcccgcccagcccgcccagcccccccaggcccagcccccccagcagagaagaagccccgccagccccagccaggccccctacgcccagagaagcgccgccgccgcctacggccaccagcccatcatgaccagcaagcccagcagcagcagcgccgtggccgccgccgccgccgccgccgccgccagcagcgccagcagcagctggaacacccaccagagcgtgaacgccgcctggagcgcccccagcaacccctggggcggcctgcaggccggcagagaccccagaagagccgtgggcgtgggcgtgggcgtgggcgtgggcgtgcccagccccctgaaccccatcagccccctgaagaagcccttcagcagcaacgtgatcgccccccccaagttccccagagccgcccccctgaccagcaagagctggatggaggacaacgccttcagaaccgacaacggcaacaacctgctgcccttccaggacagaagcagaccctacgacaccttcaacctgcacagcctggagaacagcctgatggacatgatcagaaccgaccacgagcccctgaagggcagaatgggcatcaacttccaccaccccggcaccgacaacatcatggccctgaacagcagaagcagcctgttccccttcgaggacgccttcctggacgacagccacggcgaccaggccctgagcagcggcctgagcagccccaccagatgccagaacggcgagagagtggagagatacagcagaaaggtgttcgtgggcggcctgccccccgacatcgacgaggacgagatcaccgccagcttcagaagattcggccccctggtggtggactggccccacaaggccgagagcaagagctacttcccccccaagggctacgccttcctgctgttccaggaggagagcagcgtgcaggccctgatcgacgcctgcctggaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacaacgacatcgacaagagagtggaggtgaagccctacgtgctggacgaccagatgtgcgacgagtgccagggcaccagatgcggcggcaagttcgcccccttcttctgcgccaacgtgacctgcctgcagtactactgcgagtactgctgggccagcatccacagcagagccggcagagagttccacaagcccctggtgaaggagggcggcgacagacccagacacgtgcccttcagatggagctag

SEQ ID NO: 78409 - DNA, 2055 bp, Artificial Sequence; identical to SEQ ID NO: 78408
  Description of Artificial Sequence: Synthetic coding sequence

SEQ ID NO: 78410 - DNA, 2190 bp, Artificial Sequence
  Description of Artificial Sequence: Synthetic coding sequence
atgggcgactacggcttcggcgtgctggtgcagagcaacaccggcaacaagagcgccttccccgtgagattccacccccacctgcagcccccccaccaccaccagaacgccacccccagccccgccgccttcatcaacaacaacaccgccgccaacggcagcagcgccggcagcgcctggctgttccccgcccccgccacccacaacatccaggacgagatcctgggcagcgagaaggccaagagccagcagcaggagcagcaggaccccctggagaagcagcagctgagccccagccccggccaggaggccggcatcctgcccgagaccgagaaggccaagagcgaggagaaccagggcgacaacagcagcgagaacggcaacggcaaggagaagatcagaatcgagagccccgtgctgaccggcttcgactaccaggaggccaccggcctgggcaccagcacccagcccctgaccagcagcgccagcagcctgaccggcttcagcaactggagcgccgccatcgcccccagcagcagcaccatcatcaacgaggacgccagcttcttccaccagggcggcgtgcccgccgccagcgccaacaacggcgccctgctgttccagaacttcccccaccacgtgagccccggcttcggcggcagcttcagcccccagatcggccccctgagccagcaccacccccaccacccccacttccagcaccaccacagccagcaccagcagcagagaagaagccccgccagcccccaccccccccccttcacccacagaaacgccgccttcaaccagctgccccacctggccaacaacctgaacaagccccccagcccctggagcagctaccagagccccagccccacccccagcagcagctggagccccggcggcggcggctacggcggctggggcggcagccagggcagagaccacagaagaggcctgaacggcggcatcacccccctgaacagcatcagccccctgaagaagaacttcgccagcaaccacatccagctgcagaagtacgccagacccagcagcgccttcgcccccaagagctggatggaggacagcctgaacagagccgacaacatcttccccttccccgacagacccagaaccttcgacatgcacagcctggagagcagcctgatcgacatcatgagagccgagaacgacaccatcaagggcagactgaactacagctaccccggcagcgacagcagcctgctgatcaacgccagaacctacggcagaagaagaggccagagcagcctgttccccatggaggacggcttcctggacgacggcagaggcgaccagcccctgcacagcggcctgggcagcccccactgcttcagccaccagaacggcgagagagtggagagatacagcagaaaggtgttcgtgggcggcctgccccccgacatcgacgaggacgagatcaccgccagcttcagaagattcggccccctgatcgtggactggccccacaaggccgagagcaagagctacttcccccccaagggctacgccttcctgctgttccaggacgagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgagatcgacaagagagtggaggtgaagccctacgtgctggacgaccagctgtgcgacgagtgccagggcgccagatgcggcggcaagttcgcccccttcttctgcgccaacgtgacctgcctgcagtactactgcgagtactgctgggccgccatccacagcagagccggcagagagttccacaagcccctggtgaaggagggcggcgacagacccagacacatcagcttcagatggaactag

SEQ ID NO: 78411 - DNA, 2139 bp, Artificial Sequence
  Description of Artificial Sequence: Synthetic coding sequence
atgggcgactacggcttcggcgtgctggtgcagagcaacaccggcaacaagagcgccttccccgtgagattccacccccacctgcagcccccccaccaccaccagaacgccacccccagccccgccgccttcatcaacaacaacaccgccgccaacggcagcagcgccggcagcgcctggctgttccccgcccccgccacccacaacatccaggacgagatcctgggcagcgagaaggccaagagccagcagcaggagcagcaggaccccctggagaagcagcagctgagccccagccccggccaggaggccggcatcctgcccgagaccgagaaggccaagagcgaggagaaccagggcgacaacagcagcgagaacggcaacggcaaggagaagatcagaatcgagagccccgtgctgaccggcttcgactaccaggaggccaccggcctgggcaccagcacccagcccctgaccagcagcgccagcagcctgaccggcttcagcaactggagcgccgccatcgcccccagcagcagcaccatcatcaacgaggacgccagcttcttccaccagggcggcgtgcccgccgccagcgccaacaacggcgccctgctgttccagaacttcccccaccacgtgagccccggcttcggcggcagcttcagcccccagatcggccccctgagccagcaccacccccaccacccccacttccagcaccaccacagccagcaccagcagcagagaagaagccccgccagcccccaccccccccccttcacccacagaaacgccgccttcaaccagctgccccacctggccaacaacctgaacaagccccccagcccctggagcagctaccagagccccagccccacccccagcagcagctggagccccggcggcggcggctacggcggctggggcggcagccagggcagagaccacagaagaggcctgaacggcggcatcacccccctgaacagcatcagccccctgaagaagaacttcgccagcaaccacatccagctgcagaagtacgccagacccagcagcgccttcgcccccaagagctggatggaggacagcctgaacagagccgacaacatcttccccttccccgacagacccagaaccttcgacatgcacagcctggagagcagcctgatcgacatcatgagagccgagaacgacaccatcaaggccagaacctacggcagaagaagaggccagagcagcctgttccccatggaggacggcttcctggacgacggcagaggcgaccagcccctgcacagcggcctgggcagcccccactgcttcagccaccagaacggcgagagagtggagagatacagcagaaaggtgttcgtgggcggcctgccccccgacatcgacgaggacgagatcaccgccagcttcagaagattcggccccctgatcgtggactggccccacaaggccgagagcaagagctacttcccccccaagggctacgccttcctgctgttccaggacgagagcagcgtgcaggccctgatcgacgcctgcatcgaggaggacggcaagctgtacctgtgcgtgagcagccccaccatcaaggacaagcccgtgcagatcagaccctggaacctgagcgacagcgacttcgtgatggacggcagccagcccctggaccccagaaagaccatcttcgtgggcggcgtgcccagacccctgagagccgtggagctggccatgatcatggacagactgtacggcggcgtgtgctacgccggcatcgacaccgaccccgagctgaagtaccccaagggcgccggcagagtggccttcagcaaccagcagagctacatcgccgccatcagcgccagattcgtgcagctgcagcacggcgagatcgacaagagagtggaggtgaagccctacgtgctggacgaccagctgtgcgacgagtgccagggcgccagatgcggcggcaagttcgcccccttcttctgcgccaacgtgacctgcctgcagtactactgcgagtactgctgggccgccatccacagcagagccggcagagagttccacaagcccctggtgaaggagggcggcgacagacccagacacatcagcttcagatggaactag

SEQ ID NO: 78412 - DNA, 2049 bp, Artificial Sequence
  Description of Artificial Sequence: Synthetic coding sequence
atgagcacccccgccgtgccccaggacctgcagctgccccccagccagagagcccagagcgccttcaaggagcagagaagacagaagctgaaggagcacctgctgagaagaaagaccctgttcgcctacaagcaggagaacgagatgctgagcagcagagaccagagagtggtgaccagcgaggaccaggtgcaggagggcaccaaggtgctgaagctgaagaccaagatggccgacaaggagaacatgaagagacccgccgagagcaagaacaacaccgtggtgggcaagcactgcatccccctgaagcccagcaacgagctgaccaacagcaccgtggtgatcgacacccacaagcccaaggacagcaaccagaccccccacctgctgctgaccgaggacgacccccagagccagcacatgaccctgagccaggccttccacctgaagaacaacagcaagaagaagcagatgaccaccgagaagcagaagcaggacgccaacatgcccaagaagcccgtgctgggcagctacagaggccagatcgtgcagagcaagatcaacagcttcagaaagcccctgcaggtgaaggacgagagcagcgccgccaccaagaagctgagcgccaccatccccaaggccaccaagccccagcccgtgaacaccagcagcgtgaccgtgaagagcaacagaagcagcaacatgaccgccaccaccaagttcgtgagcaccaccagccagaacacccagctggtgagaccccccatcagaagccaccacagcaacaccagagacaccgtgaagcagggcatcagcagaaccagcgccaacgtgaccatcagaaagggcccccacgagaaggagctgctgcagagcaagaccgccctgagcagcgtgaagaccagcagcagccagggcatcatcagaaacaagaccctgagcagaagcatcgccagcgaggtgatcgccagacccgccagcctgagcaacgacaagctgatggagaagagcgagcccgtggaccagagaagacacaccgccggcaaggccatcgtggacagcagaagcgcccagcccaaggagaccagcgaggagagaaaggccagactgagcgagtggaaggccggcaagggcagagtgctgaagagaccccccaacagcgtggtgacccagcacgagcccgccggccagaacgagaagcccgtgggcagcttctggaccaccatggccgaggaggacgagcagagactgttcaccgagaaggtgaacaacaccttcagcgagtgcctgaacctgatcaacgagggctgccccaaggaggacatcctggtgaccctgaacgacctgatcaagaacatccccgacgccaagaagctggtgaagtactggatctgcctggccctgatcgagcccatcaccagccccatcgagaacatcatcgccatctacgagaaggccatcctggccggcgcccagcccatcgaggagatgagacacaccatcgtggacatcctgaccatgaagagccaggagaaggccaacctgggcgagaacatggagaagagctgcgccagcaaggaggaggtgaaggaggtgagcatcgaggacaccggcgtggacgtggaccccgagaagctggagatggagagcaagctgcacagaaacctgctgttccaggactgcgagaaggagcaggacaacaagaccaaggaccccacccacgacgtgaagacccccaacaccgagaccagaaccagctgcctgatcaagtacaacgtgagcaccaccccctacctgcagagcgtgaagaagaaggtgcagttcgacggcaccaacagcgccttcaaggagctgaagttcctgacccccgtgagaagaagcagaagactgcaggagaagaccagcaagctgcccgacatgctgaaggaccactacccctgcgtgagcagcctggagcagctgaccgagctgggcagagagaccgacgccttcgtgtgcagacccaacgccgccctgtgcagagtgtactacgaggccgacaccacctag

SEQ ID NO: 78413 - DNA, 1485 bp, Artificial Sequence
  Description of Artificial Sequence: Synthetic coding sequence
atgagcacccccgccgtgccccaggacctgcagctgccccccagccagagagcccagagcgccttcaaggagcagagaagacagaagctgaaggagcacctgctgagaagaaagaccctgttcgcctacaagcaggagaacgagatgctgagcagcagagaccagagagtggtgaccagcgaggaccaggtgcaggagggcaccaaggtgctgaagctgaagaccaagatggccgacaaggagaacatgaagagacccgccgagagcaagaacaacaccgtggtgggcaagcactgcatccccctgaagcccagcaacgagctgaccaacagcaccgtggtgatcgacacccacaagcccaaggacagcaaccagaccccccacctgctgctgaccgaggacgacccccagagccagcacatgaccctgagccaggccttccacctgaagaacaacagcaagaagaagcagatgaccaccgagaagcagaagcaggacgccaacatgcccaagaagcccgtgctgggcagctacagaggccagatcgtgcagagcaagatcaacagcttcagaaagcccctgcaggtgaaggacgagagcagcgccgccaccaagaagctgagcgccaccatccccaaggccaccaagccccagcccgtgaacaccagcagcgtgaccgtgaagagcaacagaagcagcaacatgaccgccaccaccaagttcgtgagcaccaccagccagaacacccagctggtgagaccccccatcagaagccaccacagcaacaccagagacaccgtgaagcagggcatcagcagaaccagcgccaacgtgaccatcagaaagggcccccacgagaaggagctgctgcagagcaagaccgccctgagcagcgtgaagaccagcagcagccagggcatcatcagaaacaagaccctgagcagaagcatcgccagcgaggtgatcgccagacccgccagcctgagcaacgacaagctgatggagaagagcgagcccgtggaccagagaagacacaccgccggcaaggccatcgtggacagcagaagcgcccagcccaaggagaccagcgaggagagaaaggccagactgagcgagtggaaggccggcaagggcagagtgctgaagagaccccccaacagcgtggtgacccagcacgagcccgccggccagaacgagaagcccgtgggcagcttctggaccaccatggccgaggaggacgagcagagactgttcaccgagaaggtgaacaacaccttcagcgagtgcctgaacctgatcaacgagggctgccccaaggaggacatcctggtgaccctgaacgacctgatcaagaacatccccgacgccaagaagctggtgaagtactggatctgcctggccctgatcgagcccatcaccagccccatcgagaacatcatcgccatctacgagaaggccatcctggccggcgcccaggtgagatag

SEQ ID NO: 78414 - DNA, 2052 bp, Artificial Sequence
  Description of Artificial Sequence: Synthetic coding sequence
atgagcacccccgccgtgccccaggacctgcagctgccccccagccagagagcccagagcgccttcaaggagcagagaagacagaagctgaaggagcacctgctgagaagaaagaccctgttcgcctacaagcaggagaacgagatgctgagcagcagcagagaccagagagtggtgaccagcgaggaccaggtgcaggagggcaccaaggtgctgaagctgaagaccaagatggccgacaaggagaacatgaagagacccgccgagagcaagaacaacaccgtggtgggcaagcactgcatccccctgaagcccagcaacgagctgaccaacagcaccgtggtgatcgacacccacaagcccaaggacagcaaccagaccccccacctgctgctgaccgaggacgacccccagagccagcacatgaccctgagccaggccttccacctgaagaacaacagcaagaagaagcagatgaccaccgagaagcagaagcaggacgccaacatgcccaagaagcccgtgctgggcagctacagaggccagatcgtgcagagcaagatcaacagcttcagaaagcccctgcaggtgaaggacgagagcagcgccgccaccaagaagctgagcgccaccatccccaaggccaccaagccccagcccgtgaacaccagcagcgtgaccgtgaagagcaacagaagcagcaacatgaccgccaccaccaagttcgtgagcaccaccagccagaacacccagctggtgagaccccccatcagaagccaccacagcaacaccagagacaccgtgaagcagggcatcagcagaaccagcgccaacgtgaccatcagaaagggcccccacgagaaggagctgctgcagagcaagaccgccctgagcagcgtgaagaccagcagcagccagggcatcatcagaaacaagaccctgagcagaagcatcgccagcgaggtgatcgccagacccgccagcctgagcaacgacaagctgatggagaagagcgagcccgtggaccagagaagacacaccgccggcaaggccatcgtggacagcagaagcgcccagcccaaggagaccagcgaggagagaaaggccagactgagcgagtggaaggccggcaagggcagagtgctgaagagaccccccaacagcgtggtgacccagcacgagcccgccggccagaacgagaagcccgtgggcagcttctggaccaccatggccgaggaggacgagcagagactgttcaccgagaaggtgaacaacaccttcagcgagtgcctgaacctgatcaacgagggctgccccaaggaggacatcctggtgaccctgaacgacctgatcaagaacatccccgacgccaagaagctggtgaagtactggatctgcctggccctgatcgagcccatcaccagccccatcgagaacatcatcgccatctacgagaaggccatcctggccggcgcccagcccatcgaggagatgagacacaccatcgtggacatcctgaccatgaagagccaggagaaggccaacctgggcgagaacatggagaagagctgcgccagcaaggaggaggtgaaggaggtgagcatcgaggacaccggcgtggacgtggaccccgagaagctggagatggagagcaagctgcacagaaacctgctgttccaggactgcgagaaggagcaggacaacaagaccaaggaccccacccacgacgtgaagacccccaacaccgagaccagaaccagctgcctgatcaagtacaacgtgagcaccaccccctacctgcagagcgtgaagaagaaggtgcagttcgacggcaccaacagcgccttcaaggagctgaagttcctgacccccgtgagaagaagcagaagactgcaggagaagaccagcaagctgcccgacatgctgaaggaccactacccctgcgtgagcagcctggagcagctgaccgagctgggcagagagaccgacgccttcgtgtgcagacccaacgccgccctgtgcagagtgtactacgaggccgacaccacctag

SEQ ID NO: 78415 - DNA, 1488 bp, Artificial Sequence
  Description of Artificial Sequence: Synthetic coding sequence
atgagcacccccgccgtgccccaggacctgcagctgccccccagccagagagcccagagcgccttcaaggagcagagaagacagaagctgaaggagcacctgctgagaagaaagaccctgttcgcctacaagcaggagaacgagatgctgagcagcagcagagaccagagagtggtgaccagcgaggaccaggtgcaggagggcaccaaggtgctgaagctgaagaccaagatggccgacaaggagaacatgaagagacccgccgagagcaagaacaacaccgtggtgggcaagcactgcatccccctgaagcccagcaacgagctgaccaacagcaccgtggtgatcgacacccacaagcccaaggacagcaaccagaccccccacctgctgctgaccgaggacgacccccagagccagcacatgaccctgagccaggccttccacctgaagaacaacagcaagaagaagcagatgaccaccgagaagcagaagcaggacgccaacatgcccaagaagcccgtgctgggcagctacagaggccagatcgtgcagagcaagatcaacagcttcagaaagcccctgcaggtgaaggacgagagcagcgccgccaccaagaagctgagcgccaccatccccaaggccaccaagccccagcccgtgaacaccagcagcgtgaccgtgaagagcaacagaagcagcaacatgaccgccaccaccaagttcgtgagcaccaccagccagaacacccagctggtgagaccccccatcagaagccaccacagcaacaccagagacaccgtgaagcagggcatcagcagaaccagcgccaacgtgaccatcagaaagggcccccacgagaaggagctgctgcagagcaagaccgccctgagcagcgtgaagaccagcagcagccagggcatcatcagaaacaagaccctgagcagaagcatcgccagcgaggtgatcgccagacccgccagcctgagcaacgacaagctgatggagaagagcgagcccgtggaccagagaagacacaccgccggcaaggccatcgtggacagcagaagcgcccagcccaaggagaccagcgaggagagaaaggccagactgagcgagtggaaggccggcaagggcagagtgctgaagagaccccccaacagcgtggtgacccagcacgagcccgccggccagaacgagaagcccgtgggcagcttctggaccaccatggccgaggaggacgagcagagactgttcaccgagaaggtgaacaacaccttcagcgagtgcctgaacctgatcaacgagggctgccccaaggaggacatcctggtgaccctgaacgacctgatcaagaacatccccgacgccaagaagctggtgaagtactggatctgcctggccctgatcgagcccatcaccagccccatcgagaacatcatcgccatctacgagaaggccatcctggccggcgcccagcacatctag

SEQ ID NO: 78416 - DNA, 5919 bp, Artificial Sequence
  Description of Artificial Sequence: Synthetic coding sequence
atgggcgacgacagcgagtggctgaagctgcccgtggaccagaagtgcgagcacaagctgtggaaggccagactgagcggctacgaggaggccctgaagatcttccagaagatcaaggacgagaagagccccgagtggagcaagttcctgggcctgatcaagaagttcgtgaccgacagcaacgccgtggtgcagctgaagggcctggaggccgccctggtgtacgtggagaacgcccacgtggccggcaagaccaccggcgaggtggtgagcggcgtggtgagcaaggtgttcaaccagcccaaggccaaggccaaggagctgggcatcgagatctgcctgatgtacatcgagatcgagaagggcgaggccgtgcaggaggagctgctgaagggcctggacaacaagaaccccaagatcatcgtggcctgcatcgagaccctgagaaaggccctgagcgagttcggcagcaagatcatcctgctgaagcccatcatcaaggtgctgcccaagctgttcgagagcagagagaaggccgtgagagacgaggccaagctgatcgccgtggagatctacagatggatcagagacgccctgagaccccccctgcagaacatcaacagcgtgcagctgaaggagctggaggaggagtgggtgaagctgcccaccagcgcccccagacccaccagattcctgagaagccagcaggagctggaggccaagctggagcagcagcagagcgccggcggcgacgccgagggcggcggcgacgacggcgacgaggtgccccagatcgacgcctacgagctgctggaggccgtggagatcctgagcaagctgcccaaggacttctacgacaagatcgaggccaagaagtggcaggagagaaaggaggccctggagagcgtggaggtgctgatcaagaaccccaagctggaggccggcgactacgccgacctggtgaaggccctgaagaaggtggtgggcaaggacaccaacgtgatgctggtggccctggccgccaagtgcctgaccggcctggccgtgggcctgagaaagaagttcggccagtacgccggccacgtggtgcccaccatcctggagaagttcaaggagaagaagccccaggtggtgcaggccctgcaggaggccatcgacgccatcttcctgaccaccaccctgcagaacatcagcgaggacgtgctggccgtgatggacaacaagaaccccaccatcaagcagcagaccagcctgttcatcgccagaagcttcagacactgcaccgccagcaccctgcccaagagcctgctgaagcccttctgcgccgccctgctgaagcacatcaacgacagcgcccccgaggtgagagacgccgccttcgaggccctgggcaccgccctgaaggtggtgggcgagaaggccgtgaaccccttcctggccgacgtggacaagctgaagctggacaagatcaaggagtgcagcgagaaggtggagctgatccacggcaagaaggccggcctggccgccgacaagaaggagttcaagcccctgcccggcagaaccgccgccagcggcgccgccggcgacaaggacaccaaggacatcagcgcccccaagcccggccccctgaagaaggcccccgccgccaaggccggcggcccccccaagaagggcaagcccgccgcccccggcggcgccggcaacaccggcaccaagaacaagaagggcctggagaccaaggagatcgtggagcccgagctgagcatcgaggtgtgcgaggagaaggccagcgccgtgctgccccccacctgcatccagctgctggacagcagcaactggaaggagagactggcctgcatggaggagttccagaaggccgtggagctgatggacagaaccgagatgccctgccaggccctggtgagaatgctggccaagaagcccggctggaaggagaccaacttccaggtgatgcagatgaagctgcacatcgtggccctgatcgcccagaagggcaacttcagcaagaccagcgcccaggtggtgctggacggcctggtggacaagatcggcgacgtgaagtgcggcaacaacgccaaggaggccatgaccgccatcgccgaggcctgcatgctgccctggaccgccgagcaggtggtgagcatggccttcagccagaagaaccccaagaaccagagcgagaccctgaactggctgagcaacgccatcaaggagttcggcttcagcggcctgaacgtgaaggccttcatcagcaacgtgaagaccgccctggccgccaccaaccccgccgtgagaaccgccgccatcaccctgctgggcgtgatgtacctgtacgtgggccccagcctgagaatgttcttcgaggacgagaagcccgccctgctgagccagatcgacgccgagttcgagaagatgcagggccagagcccccccgcccccaccagaggcatcagcaagcacagcaccagcggcaccgacgagggcgaggacggcgacgagcccgacgacggcagcaacgacgtggtggacctgctgcccagaaccgagatcagcgacaagatcaccagcgagctggtgagcaagatcggcgacaagaactggaagatcagaaaggagggcctggacgaggtggccggcatcatcaacgacgccaagttcatccagcccaacatcggcgagctgcccaccgccctgaagggcagactgaacgacagcaacaagatcctggtgcagcagaccctgaacatcctgcagcagctggccgtggccatgggccccaacatcaagcagcacgtgaagaacctgggcatccccatcatcaccgtgctgggcgacagcaagaacaacgtgagagccgccgccctggccaccgtgaacgcctgggccgagcagaccggcatgaaggagtggctggagggcgaggacctgagcgaggagctgaagaaggagaaccccttcctgagacaggagctgctgggctggctggccgagaagctgcccaccctgagaagcacccccaccgacctgatcctgtgcgtgccccacctgtacagctgcctggaggacagaaacggcgacgtgagaaagaaggcccaggacgccctgcccttcttcatgatgcacctgggctacgagaagatggccaaggccaccggcaagctgaagcccaccagcaaggaccaggtgctggccatgctggagaaggccaaggtgaacatgcccgccaagcccgccccccccaccaaggccaccagcaagcccatgggcggcagcgcccccgccaagttccagcccgccagcgcccccgccgaggactgcatcagcagcagcaccgagcccaagcccgaccccaagaaggccaaggcccccggcctgagcagcaaggccaagagcgcccagggcaagaagatgcccagcaagaccagcctgaaggaggacgaggacaagagcggccccatcttcatcgtggtgcccaacggcaaggagcagagaatgaaggacgagaagggcctgaaggtgctgaagtggaacttcaccacccccagagacgagtacatcgagcagctgaagacccagatgagcagctgcgtggccaagtggctgcaggacgagatgttccacagcgacttccagcaccacaacaaggccctggccgtgatggtggaccacctggagagcgagaaggagggcgtgatcggctgcctggacctgatcctgaagtggctgaccctgagattcttcgacaccaacaccagcgtgctgatgaaggccctggagtacctgaagctgctgttcaccctgctgagcgaggaggagtaccacctgaccgagaacgaggccagcagcttcatcccctacctggtggtgaaggtgggcgagcccaaggacgtgatcagaaaggacgtgagagccatcctgaacagaatgtgcctggtgtaccccgccagcaagatgttccccttcatcatggagggcaccaagagcaagaacagcaagcagagagccgagtgcctggaggagctgggctgcctggtggagagctacggcatgaacgtgtgccagcccacccccggcaaggccctgaaggagatcgccgtgcacatcggcgacagagacaacgccgtgagaaacgccgccctgaacaccatcgtgaccgtgtacaacgtgcacggcgaccaggtgttcaagctgatcggcaacctgagcgagaaggacatgagcatgctggaggagagaatcaagagaagcgccaagagacccagcgccgcccccatcaagcaggtggaggagaagccccagagagcccagaacatcagcagcaacgccaacatgctgagaaagggccccgccgaggacatgagcagcaagctgaaccaggccagaagcatgagcggccaccccgaggccgcccagatggtgagaagagagttccagctggacctggacgagatcgagaacgacaacggcaccgtgagatgcgagatgcccgagctggtgcagcacaagctggacgacatcttcgagcccgtgctgatccccgagcccaagatcagagccgtgagcccccacttcgacgacatgcacagcaacaccgccagcaccatcaacttcatcatcagccaggtggccagcggcgacatcaacaccagcatccaggccctgacccagctgttccagatcgagagcctggccagagaggccagcaccggcgtgctgaaggacctgatgcacggcctgatcaccctgatgctggacagcagaatcgaggacctggaggagggccagcaggtgatcagaagcgtgaacctgctggtggtgaaggtgctggagaagagcgaccagaccaacatcctgagcgccctgctggtgctgctgcaggacagcctgctggccaccgccagcagccccaagttcagcgagctggtgatgaagtgcctgtggagaatggtgagactgctgcccgacaccatcaacagcatcaacctggacagaatcctgctggacatccacatcttcatgaaggtgttccccaaggagaagctgaagcagtgcaagagcgagttccccatcagaaccctgaagaccctgctgcacaccctgtgcaagctgaagggccccaagatcctggaccacctgaccatgatcgacaacaagaacgagagcgagctggaggcccacctgtgcagaatgatgaagcacagcatggaccagaccggcagcaagagcgacaaggagaccgagaagggcgccagcagaatcgacgagaagagcagcaaggccaaggtgaacgacttcctggccgagatcttcaagaagatcggcagcaaggagaacaccaaggagggcctggccgagctgtacgagtacaagaagaagtacagcgacgccgacatcgagcccttcctgaagaacagcagccagttcttccagagctacgtggagagaggcctgagagtgatcgagatggagagagagggcaagggcagaatcagcaccagcaccggcatcagcccccagatggaggtgacctgcgtgcccacccccaccagcaccgtgagcagcatcggcaacaccaacggcgaggaggtgggccccagcgtgtacctggagagactgaagatcctgagacagagatgcggcctggacaacaccaagcaggacgacagaccccccctgaccagcctgctgagcaagcccgccgtgcccaccgtggccagcagcaccgacatgctgcacagcaagctgagccagctgagagagagcagagagcagcaccagcacagcgacctggacagcaaccagacccacagcagcggcaccgtgaccagcagcagcagcaccgccaacatcgacgacctgaagaagagactggagagaatcaagagcagcagaaagtag

SEQ ID NO: 78417 - DNA, 5919 bp, Artificial Sequence; identical to SEQ ID NO: 78416
  Description of Artificial Sequence: Synthetic coding sequence

SEQ ID NO: 78418 - DNA, 906 bp, Artificial Sequence
  Description of Artificial Sequence: Synthetic coding sequence
atgggcgacgacagcgagtggctgaagctgcccgtggaccagaagtgcgagcacaagctgtggaaggccagactgagcggctacgaggaggccctgaagatcttccagaagatcaaggacgagaagagccccgagtggagcaagttcctgggcctgatcaagaagttcgtgaccgacagcaacgccgtggtgcagctgaagggcctggaggccgccctggtgtacgtggagaacgcccacgtggccggcaagaccaccggcgaggtggtgagcggcgtggtgagcaaggtgttcaaccagcccaaggccaaggccaaggagctgggcatcgagatctgcctgatgtacatcgagatcgagaagggcgaggccgtgcaggaggagctgctgaagggcctggacaacaagaaccccaagatcatcgtggcctgcatcgagaccctgagaaaggccctgagcgagttcggcagcaagatcatcctgctgaagcccatcatcaaggtgctgcccaagctgttcgagagcagagagaaggccgtgagagacgaggccaagctgatcgccgtggagatctacagatggatcagagacgccctgagaccccccctgcagaacatcaacagcgtgcagctgaaggagctggaggaggagtgggtgaagctgcccaccagcgcccccagacccaccagattcctgagaagccagcaggagctggaggccaagctggagcagcagcagagcgccggcggcgacgccgagggcggcggcgacgacggcgacgaggtgccccagatcgacgcctacgagctgctggaggccgtggagatcctgagcaagcccaagaccttcatgaccaagctgagacagaagaacggcaagagagagaagagaccctggagcctgtag

SEQ ID NO: 78419 - DNA, 6120 bp, Artificial Sequence
  Description of Artificial Sequence: Synthetic coding sequence
atgggcgacgacagcgagtggctgaagctgcccgtggaccagaagtgcgagcacaagctgtggaaggccagactgagcggctacgaggaggccctgaagatcttccagaagatcaaggacgagaagagccccgagtggagcaagttcctgggcctgatcaagaagttcgtgaccgacagcaacgccgtggtgcagctgaagggcctggaggccgccctggtgtacgtggagaacgcccacgtggccggcaagaccaccggcgaggtggtgagcggcgtggtgagcaaggtgttcaaccagcccaaggccaaggccaaggagctgggcatcgagatctgcctgatgtacatcgagatcgagaagggcgaggccgtgcaggaggagctgctgaagggcctggacaacaagaaccccaagatcatcgtggcctgcatcgagaccctgagaaaggccctgagcgagttcggcagcaagatcatcctgctgaagcccatcatcaaggtgctgcccaagctgttcgagagcagagagaaggccgtgagagacgaggccaagctgatcgccgtggagatctacagatggatcagagacgccctgagaccccccctgcagaacatcaacagcgtgcagctgaaggagctggaggaggagtgggtgaagctgcccaccagcgcccccagacccaccagattcctgagaagccagcaggagctggaggccaagctggagcagcagcagagcgccggcggcgacgccgagggcggcggcgacgacggcgacgaggtgccccagatcgacgcctacgagctgctggaggccgtggagatcctgagcaagctgcccaaggacttctacgacaagatcgaggccaagaagtggcaggagagaaaggaggccctggagagcgtggaggtgctgatcaagaaccccaagctggaggccggcgactacgccgacctggtgaaggccctgaagaaggtggtgggcaaggacaccaacgtgatgctggtggccctggccgccaagtgcctgaccggcctggccgtgggcctgagaaagaagttcggccagtacgccggccacgtggtgcccaccatcctggagaagttcaaggagaagaagccccaggtggtgcaggccctgcaggaggccatcgacgccatcttcctgaccaccaccctgcagaacatcagcgaggacgtgctggccgtgatggacaacaagaaccccaccatcaagcagcagaccagcctgttcatcgccagaagcttcagacactgcaccgccagcaccctgcccaagagcctgctgaagcccttctgcgccgccctgctgaagcacatcaacgacagcgcccccgaggtgagagacgccgccttcgaggccctgggcaccgccctgaaggtggtgggcgagaaggccgtgaaccccttcctggccgacgtggacaagctgaagctggacaagatcaaggagtgcagcgagaaggtggagctgatccacggcaagaaggccggcctggccgccgacaagaaggagttcaagcccctgcccggcagaaccgccgccagcggcgccgccggcgacaaggacaccaaggacatcagcgcccccaagcccggccccctgaagaaggcccccgccgccaaggccggcggcccccccaagaagggcaagcccgccgcccccggcggcgccggcaacaccggcaccaagaacaagaagggcctggagaccaaggagatcgtggagcccgagctgagcatcgaggtgtgcgaggagaaggccagcgccgtgctgccccccacctgcatccagctgctggacagcagcaactggaaggagagactggcctgcatggaggagttccagaaggccgtggagctgatggacagaaccgagatgccctgccaggccctggtgagaatgctggccaagaagcccggctggaaggagaccaacttccaggtgatgcagatgaagctgcacatcgtggccctgatcgcccagaagggcaacttcagcaagaccagcgcccaggtggtgctggacggcctggtggacaagatcggcgacgtgaagtgcggcaacaacgccaaggaggccatgaccgccatcgccgaggcctgcatgctgccctggaccgccgagcaggtggtgagcatggccttcagccagaagaaccccaagaaccagagcgagaccctgaactggctgagcaacgccatcaaggagttcggcttcagcggcctgaacgtgaaggccttcatcagcaacgtgaagaccgccctggccgccaccaaccccgccgtgagaaccgccgccatcaccctgctgggcgtgatgtacctgtacgtgggccccagcctgagaatgttcttcgaggacgagaagcccgccctgctgagccagatcgacgccgagttcgagaagatgcagggccagagcccccccgcccccaccagaggcatcagcaagcacagcaccagcggcaccgacgagggcgaggacggcgacgagcccgacgacggcagcaacgacgtggtggacctgctgcccagaaccgagatcagcgacaagatcaccagcgagctggtgagcaagatcggcgacaagaactggaagatcagaaaggagggcctggacgaggtggccggcatcatcaacgacgccaagttcatccagcccaacatcggcgagctgcccaccgccctgaagggcagactgaacgacagcaacaagatcctggtgcagcagaccctgaacatcctgcagcagctggccgtggccatgggccccaacatcaagcagcacgtgaagaacctgggcatccccatcatcaccgtgctgggcgacagcaagaacaacgtgagagccgccgccctggccaccgtgaacgcctgggccgagcagaccggcatgaaggagtggctggagggcgaggacctgagcgaggagctgaagaaggagaaccccttcctgagacaggagctgctgggctggctggccgagaagctgcccaccctgagaagcacccccaccgacctgatcctgtgcgtgccccacctgtacagctgcctggaggacagaaacggcgacgtgagaaagaaggcccaggacgccctgcccttcttcatgatgcacctgggctacgagaagatggccaaggccaccggcaagctgaagcccaccagcaaggaccaggtgctggccatgctggagaaggccaaggtgaacatgcccgccaagcccgccccccccaccaaggccaccagcaagcccatgggcggcagcgcccccgccaagttccagcccgccagcgcccccgccgaggactgcatcagcagcagcaccgagcccaagcccgaccccaagaaggccaaggcccccggcctgagcagcaaggccaagagcgcccagggcaagaagatgcccagcaagaccagcctgaaggaggacgaggacaagagcggccccatcttcatcgtggtgcccaacggcaaggagcagagaatgaaggacgagaagggcctgaaggtgctgaagtggaacttcaccacccccagagacgagtacatcgagcagctgaagacccagatgagcagctgcgtggccaagtggctgcaggacgagatgttccacagcgacttccagcaccacaacaaggccctggccgtgatggtggaccacctggagagcgagaaggagggcgtgatcggctgcctggacctgatcctgaagtggctgaccctgagattcttcgacaccaacaccagcgtgctgatgaaggccctggagtacctgaagctgctgttcaccctgctgagcgaggaggagtaccacctgaccgagaacgaggccagcagcttcatcccctacctggtggtgaaggtgggcgagcccaaggacgtgatcagaaaggacgtgagagccatcctgaacagaatgtgcctggtgtaccccgccagcaagatgttccccttcatcatggagggcaccaagagcaagaacagcaagcagagagccgagtgcctggaggagctgggctgcctggtggagagctacggcatgaacgtgtgccagcccacccccggcaaggccctgaaggagatcgccgtgcacatcggcgacagagacaacgccgtgagaaacgccgccctgaacaccatcgtgaccgtgtacaacgtgcacggcgaccaggtgttcaagctgatcggcaacctgagcgagaaggacatgagcatgctggaggagagaatcaagagaagcgccaagagacccagcgccgcccccatcaagcaggtggaggagaagccccagagagcccagaacatcagcagcaacgccaacatgctgagaaagggccccgccgaggacatgagcagcaagctgaaccaggccagaagcatgagcggccaccccgaggccgcccagatggtgagaagagagttccagctggacctggacgagatcgagaacgacaacggcaccgtgagatgcgagatgcccgagctggtgcagcacaagctggacgacatcttcgagcccgtgctgatccccgagcccaagatcagagccgtgagcccccacttcgacgacatgcacagcaacaccgccagcaccatcaacttcatcatcagccaggtggccagcggcgacatcaacaccagcatccaggccctgacccagatcgacgaggtgctgagacaggaggacaaggccgaggccatgagcggccacatcgaccagttcctgatcgccaccttcatgcagctgagactgatctacaacacccacatggccgacgagaagctggagaaggacgagatcatcaagctgtacagctgcatcatcggcaacatgatcagcctgttccagatcgagagcctggccagagaggccagcaccggcgtgctgaaggacctgatgcacggcctgatcaccctgatgctggacagcagaatcgaggacctggaggagggccagcaggtgatcagaagcgtgaacctgctggtggtgaaggtgctggagaagagcgaccagaccaacatcctgagcgccctgctggtgctgctgcaggacagcctgctggccaccgccagcagccccaagttcagcgagctggtgatgaagtgcctgtggagaatggtgagactgctgcccgacaccatcaacagcatcaacctggacagaatcctgctggacatccacatcttcatgaaggtgttccccaaggagaagctgaagcagtgcaagagcgagttccccatcagaaccctgaagaccctgctgcacaccctgtgcaagctgaagggccccaagagctgcatgtgcctgccccagatcctggaccacctgaccatgatcgacaacaagaacgagagcgagctggaggcccacctgtgcagaatgatgaagcacagcatggaccagaccggcagcaagagcgacaaggagaccgagaagggcgccagcagaatcgacgagaagagcagcaaggccaaggtgaacgacttcctggccgagatcttcaagaagatcggcagcaaggagaacaccaaggagggcctggccgagctgtacgagtacaagaagaagtacagcgacgccgacatcgagcccttcctgaagaacagcagccagttcttccagagctacgtggagagaggcctgagagtgatcgagatggagagagagggcaagggcagaatcagcaccagcaccggcatcagcccccagatggaggtgacctgcgtgcccacccccaccagcaccgtgagcagcatcggcaacaccaacggcgaggaggtgggccccagcgtgtacctggagagactgaagatcctgagacagagatgcggcctggacaacaccaagcaggacgacagaccccccctgaccagcctgctgagcaagcccgccgtgcccaccgtggccagcagcaccgacatgctgcacagcaagctgagccagctgagagagagcagagagcagcaccagcacagcgacctggacagcaaccagacccacagcagcggcaccgtgaccagcagcagcagcaccgccaacatcgacgacctgaagaagagactggagagaatcaagagcagcagaaagtag

SEQ ID NO: 78420 - DNA, 456 bp, Artificial Sequence
  Description of Artificial Sequence: Synthetic coding sequence
atgggcgacgacagcgagtggctgaagctgcccgtggaccagaagtgcgagcacaagctgtggaaggccagactgagcggctacgaggaggccctgaagatcttccagaagatcaaggacgagaagagccccgagtggagcaagttcctgggcctgatcaagaagttcgtgaccgacagcaacgccgtggtgcagctgaagggcctggaggccgccctggtgtacgtggagaacgcccacgtggccggcaagaccaccggcgaggtggtgagcggcgtggtgagcaaggtgttcaaccagcccaaggccaaggccaaggagctgggcatcgagatctgcctgatgtacatcgagatcgagaagggcgaggccgtgcaggaggagctgctgaagggcctggacaacaagaaccccaagatcatcgtggcctgcatcgagaccctgagaaaggcctag

SEQ ID NO: 78421 - DNA, 6099 bp, Artificial Sequence
  Description of Artificial Sequence: Synthetic coding sequence
atgggcgacgacagcgagtggctgaagctgcccgtggaccagaagtgcgagcacaagctgtggaaggccagactgagcggctacgaggaggccctgaagatcttccagaagatcaaggacgagaagagccccgagtggagcaagttcctgggcctgatcaagaagttcgtgaccgacagcaacgccgtggtgcagctgaagggcctggaggccgccctggtgtacgtggagaacgcccacgtggccggcaagaccaccggcgaggtggtgagcggcgtggtgagcaaggtgttcaaccagcccaaggccaaggccaaggagctgggcatcgagatctgcctgatgtacatcgagatcgagaagggcgaggccgtgcaggaggagctgctgaagggcctggacaacaagaaccccaagatcatcgtggcctgcatcgagaccctgagaaaggccctgagcgagttcggcagcaagatcatcctgctgaagcccatcatcaaggtgctgcccaagctgttcgagagcagagagaaggccgtgagagacgaggccaagctgatcgccgtggagatctacagatggatcagagacgccctgagaccccccctgcagaacatcaacagcgtgcagctgaaggagctggaggaggagtgggtgaagctgcccaccagcgcccccagacccaccagattcctgagaagccagcaggagctggaggccaagctggagcagcagcagagcgccggcggcgacgccgagggcggcggcgacgacggcgacgaggtgccccagatcgacgcctacgagctgctggaggccgtggagatcctgagcaagctgcccaaggacttctacgacaagatcgaggccaagaagtggcaggagagaaaggaggccctggagagcgtggaggtgctgatcaagaaccccaagctggaggccggcgactacgccgacctggtgaaggccctgaagaaggtggtgggcaaggacaccaacgtgatgctggtggccctggccgccaagtgcctgaccggcctggccgtgggcctgagaaagaagttcggccagtacgccggccacgtggtgcccaccatcctggagaagttcaaggagaagaagccccaggtggtgcaggccctgcaggaggccatcgacgccatcttcctgaccaccaccctgcagaacatcagcgaggacgtgctggccgtgatggacaacaagaaccccaccatcaagcagcagaccagcctgttcatcgccagaagcttcagacactgcaccgccagcaccctgcccaagagcctgctgaagcccttctgcgccgccctgctgaagcacatcaacgacagcgcccccgaggtgagagacgccgccttcgaggccctgggcaccgccctgaaggtggtgggcgagaaggccgtgaaccccttcctggccgacgtggacaagctgaagctggacaagatcaaggagtgcagcgagaaggtggagctgatccacggcaagaaggccggcctggccgccgacaagaaggagttcaagcccctgcccggcagaaccgccgccagcggcgccgccggcgacaaggacaccaaggacatcagcgcccccaagcccggccccctgaagaaggcccccgccgccaaggccggcggcccccccaagaagggcaagcccgccgcccccggcggcgccggcaacaccggcaccaagaacaagaagggcctggagaccaaggagatcgtggagcccgagctgagcatcgaggtgtgcgaggagaaggccagcgccgtgctgccccccacctgcatccagctgctggacagcagcaactggaaggagagactggcctgcatggaggagttccagaaggccgtggagctgatggacagaaccgagatgccctgccaggccctggtgagaatgctggccaagaagcccggctggaaggagaccaacttccaggtgatgcagatgaagctgcacatcgtggccctgatcgcccagaagggcaacttcagcaagaccagcgcccaggtggtgctggacggcctggtggacaagatcggcgacgtgaagtgcggcaacaacgccaaggaggccatgaccgccatcgccgaggcctgcatgctgccctggaccgccgagcaggtggtgagcatggccttcagccagaagaaccccaagaaccagagcgagaccctgaactggctgagcaacgccatcaaggagttcggcttcagcggcctgaacgtgaaggccttcatcagcaacgtgaagaccgccctggccgccaccaaccccgccgtgagaaccgccgccatcaccctgctgggcgtgatgtacctgtacgtgggccccagcctgagaatgttcttcgaggacgagaagcccgccctgctgagccagatcgacgccgagttcgagaagatgcagggccagagcccccccgcccccaccagaggcatcagcaagcacagcaccagcggcaccgacgagggcgaggacggcgacgagcccgacgacggcagcaacgacgtggtggacctgctgcccagaaccgagatcagcgacaagatcaccagcgagctggtgagcaagatcggcgacaagaactggaagatcagaaaggagggcctggacgaggtggccggcatcatcaacgacgccaagttcatccagcccaacatcggcgagctgcccaccgccctgaagggcagactgaacgacagcaacaagatcctggtgcagcagaccctgaacatcctgcagcagctggccgtggccatgggccccaacatcaagcagcacgtgaagaacctgggcatccccatcatcaccgtgctgggcgacagcaagaacaacgtgagagccgccgccctggccaccgtgaacgcctgggccgagcagaccggcatgaaggagtggctggagggcgaggacctgagcgaggagctgaagaaggagaaccccttcctgagacaggagctgctgggctggctggccgagaagctgcccaccctgagaagcacccccaccgacctgatcctgtgcgtgccccacctgtacagctgcctggaggacagaaacggcgacgtgagaaagaaggcccaggacgccctgcccttcttcatgatgcacctgggctacgagaagatggccaaggccaccggcaagctgaagcccaccagcaaggaccaggtgctggccatgctggagaaggccaaggtgaacatgcccgccaagcccgccccccccaccaaggccaccagcaagcccatgggcggcagcgcccccgccaagttccagcccgccagcgcccccgccgaggactgcatcagcagcagcaccgagcccaagcccgaccccaagaaggccaaggcccccggcctgagcagcaaggccaagagcgcccagggcaagaagatgcccagcaagaccagcctgaaggaggacgaggacaagagcggccccatcttcatcgtggtgcccaacggcaaggagcagagaatgaaggacgagaagggcctgaaggtgctgaagtggaacttcaccacccccagagacgagtacatcgagcagctgaagacccagatgagcagctgcgtggccaagtggctgcaggacgagatgttccacagcgacttccagcaccacaacaaggccctggccgtgatggtggaccacctggagagcgagaaggagggcgtgatcggctgcctggacctgatcctgaagtggctgaccctgagattcttcgacaccaacaccagcgtgctgatgaaggccctggagtacctgaagctgctgttcaccctgctgagcgaggaggagtaccacctgaccgagaacgaggccagcagcttcatcccctacctggtggtgaaggtgggcgagcccaaggacgtgatcagaaaggacgtgagagccatcctgaacagaatgtgcctggtgtaccccgccagcaagatgttccccttcatcatggagggcaccaagagcaagaacagcaagcagagagccgagtgcctggaggagctgggctgcctggtggagagctacggcatgaacgtgtgccagcccacccccggcaaggccctgaaggagatcgccgtgcacatcggcgacagagacaacgccgtgagaaacgccgccctgaacaccatcgtgaccgtgtacaacgtgcacggcgaccaggtgttcaagctgatcggcaacctgagcgagaaggacatgagcatgctggaggagagaatcaagagaagcgccaagagacccagcgccgcccccatcaagcaggtggaggagaagccccagagagcccagaacatcagcagcaacgccaacatgctgagaaagggccccgccgaggacatgagcagcaagctgaaccaggccagaagcatgagcggccaccccgaggccgcccagatggtgagaagagagttccagctggacctggacgagatcgagaacgacaacggcaccgtgagatgcgagatgcccgagctggtgcagcacaagctggacgacatcttcgagcccgtgctgatccccgagcccaagatcagagccgtgagcccccacttcgacgacatgcacagcaacaccgccagcaccatcaacttcatcatcagccaggtggccagcggcgacatcaacaccagcatccaggccctgacccagatcgacgaggtgctgagacaggaggacaaggccgaggccatgagcggccacatcgaccagttcctgatcgccaccttcatgcagctgagactgatctacaacacccacatggccgacgagaagctggagaaggacgagatcatcaagctgtacagctgcatcatcggcaacatgatcagcctgttccagatcgagagcctggccagagaggccagcaccggcgtgctgaaggacctgatgcacggcctgatcaccctgatgctggacagcagaatcgaggacctggaggagggccagcaggtgatcagaagcgtgaacctgctggtggtgaaggtgctggagaagagcgaccagaccaacatcctgagcgccctgctggtgctgctgcaggacagcctgctggccaccgccagcagccccaagttcagcgagctggtgatgaagtgcctgtggagaatggtgagactgctgcccgacaccatcaacagcatcaacctggacagaatcctgctggacatccacatcttcatgaaggtgttccccaaggagaagctgaagcagtgcaagagcgagttccccatcagaaccctgaagaccctgctgcacaccctgtgcaagctgaagggccccaagatcctggaccacctgaccatgatcgacaacaagaacgagagcgagctggaggcccacctgtgcagaatgatgaagcacagcatggaccagaccggcagcaagagcgacaaggagaccgagaagggcgccagcagaatcgacgagaagagcagcaaggccaaggtgaacgacttcctggccgagatcttcaagaagatcggcagcaaggagaacaccaaggagggcctggccgagctgtacgagtacaagaagaagtacagcgacgccgacatcgagcccttcctgaagaacagcagccagttcttccagagctacgtggagagaggcctgagagtgatcgagatggagagagagggcaagggcagaatcagcaccagcaccggcatcagcccccagatggaggtgacctgcgtgcccacccccaccagcaccgtgagcagcatcggcaacaccaacggcgaggaggtgggccccagcgtgtacctggagagactgaagatcctgagacagagatgcggcctggacaacaccaagcaggacgacagaccccccctgaccagcctgctgagcaagcccgccgtgcccaccgtggccagcagcaccgacatgctgcacagcaagctgagccagctgagagagagcagagagcagcaccagcacagcgacctggacagcaaccagacccacagcagcggcaccgtgaccagcagcagcagcaccgccaacatcgacgacctgaagaagagactggagagaatcaagagcagcagaaagtag

SEQ ID NO: 78422 - DNA, 1020 bp, Artificial Sequence
  Description of Artificial Sequence: Synthetic coding sequence
atgaaggacagcctggtgctgctgggcagagtgcccgcccaccccgacagcagatgctggttcctggcctggaaccccgccggcaccctgctggccagctgcggcggcgacagaagaatcagaatctggggcaccgagggcgacagctggatctgcaagagcgtgctgagcgagggccaccagagaaccgtgagaaaggtggcctggagcccctgcggcaactacctggccagcgccagcttcgacgccaccacctgcatctggaagaagaaccaggacgacttcgagtgcgtgaccaccctggagggccacgagaacgaggtgaagagcgtggcctgggcccccagcggcaacctgctggccacctgcagcagagacaagagcgtgtgggtgtgggaggtggacgaggaggacgagtacgagtgcgtgagcgtgctgaacagccacacccaggacgtgaagcacgtggtgtggcaccccagccaggagctgctggccagcgccagctacgacgacaccgtgaagctgtacagagaggaggaggacgactgggtgtgctgcgccaccctggagggccacgagagcaccgtgtggagcctggccttcgaccccagcggccagagactggccagctgcagcgacgacagaaccgtgagaatctggagacagtacctgcccggcaacgagcagggcgtggcctgcagcggcagcgaccccagctggaagtgcatctgcaccctgagcggcttccacagcagaaccatctacgacatcgcctggtgccagctgaccggcgccctggccaccgcctgcggcgacgacgccatcagagtgttccaggaggaccccaacagcgacccccagcagcccaccttcagcctgaccgcccacctgcaccaggcccacagccaggacgtgaactgcgtggcctggaaccccaaggagcccggcctgctggccagctgcagcgacgacggcgaggtggccttctggaagtaccagagacccgagggcctgtag

SEQ ID NO: 78423 - DNA, 1380 bp, Artificial Sequence
  Description of Artificial Sequence: Synthetic coding sequence
atggccgccagcggcgccgtggagcccggcccccccggcgccgccgtggcccccagccccgcccccgcccccccccccgcccccgaccacctgttcagacccatcagcgccgaggacgaggagcagcagcccaccgagatcgagagcctgtgcatgaactgctactgcaacggcatgaccagactgctgctgaccaagatccccttcttcagagagatcatcgtgagcagcttcagctgcgagcactgcggctggaacaacaccgagatccagagcgccggcagaatccaggaccagggcgtgagatacaccctgagcgtgagagccctggaggacatgaacagagaggtggtgaagaccgacagcgccgccaccagaatccccgagctggacttcgagatccccgccttcagccagaagggcgccctgaccaccgtggagggcctgatcaccagagccatcagcggcctggagcaggaccagcccgccagaagagccaacaaggacgccaccgccgagagaatcgacgagttcatcgtgaagctgaaggagctgaagcaggtggccagccccttcaccctgatcatcgacgaccccagcggcaacagcttcgtggagaacccccacgccccccagaaggacgacgccctggtgatcacccactacaacagaaccagacagcaggaggagatgctgggcctgcaggaggaggcccccgccgagaagcccgaggaggaggacctgagaaacgaggtgctgcagttcagcaccaactgccccgagtgcaacgcccccgcccagaccaacatgaagctggtgcagatcccccacttcaaggaggtgatcatcatggccaccaactgcgagaactgcggccacagaaccaacgaggtgaagagcggcggcgccgtggagcccctgggcaccagaatcaccctgcacatcaccgacgccagcgacatgaccagagacctgctgaagagcgagacctgcagcgtggagatccccgagctggagttcgagctgggcatggccgtgctgggcggcaagttcaccaccctggagggcctgctgaaggacatcagagagctggtgaccaagaaccccttcaccctgggcgacagcagcaaccccggccagaccgagagactgcaggagttcagccagaagatggaccagatcatcgagggcaacatgaaggcccacttcatcatggacgaccccgccggcaacagctacctgcagaacgtgtacgcccccgaggacgaccccgagatgaaggtggagagatacaagagaaccttcgaccagaacgaggagctgggcctgaacgacatgaagaccgagggctacgaggccggcctggccccccagagatag

SEQ ID NO: 78424 - DNA, 585 bp, Artificial Sequence
  Description of Artificial Sequence: Synthetic coding sequence
atgtgggtgaagctgctgagcatcgtggccgagttctgcttcagccccttcctggtgaccgacgaggagaccgccagcgacgccctggagagaaacagcctgagcagccaggacccccagcagcccaccagcaccgtgagcgtgaccgaggacagcagcaccagcgagatcgacaaggaggagaaggagcagaccacccaggaccccgacctgaccaccgaggccaacccccagtacctgggcctggccagaaagaagagcggcatcctgctgctgaccctggtgagcttcctgatcttcatcctgttcatcatcgtgcagctgttcatcatgaagctgagaaaggcccacgtgatctggaagaaggagaacgaggtgagcgagcacaccctggagagctacagaagcagaagcaacaacgaggagaccagcagcgaggagaagaacggccagagcagccaccccatgagatgcatgaactacatcaccaagctgtacagcgaggccaagaccaagagaaaggagaacgtgcagcacagcaagctggaggagaagcacatccaggtgcccgagagcatcgtgtag

SEQ ID NO: 78425 - DNA, 525 bp, Artificial Sequence
  Description of Artificial Sequence: Synthetic coding sequence
atggcctgcctgggcttccagagacacaaggcccagctgaacctggccaccagaacctggccctgcaccctgctgttcttcctgctgttcatccccgtgttctgcaaggccatgcacgtggcccagcccgccgtggtgctggccagcagcagaggcatcgccagcttcgtgtgcgagtacgccagccccggcaaggccaccgaggtgagagtgaccgtgctgagacaggccgacagccaggtgaccgaggtgtgcgccgccacctacatgatgggcaacgagctgaccttcctggacgacagcatctgcaccggcaccagcagcggcaaccaggtgaacctgaccatccagggcctgagagccatggacaccggcctgtacatctgcaaggtggagctgatgtacccccccccctactacctgggcatcggcaacggcacccagatctacgtgatcgccaaggagaagaagcccagctacaacagaggcctgtgcgagaacgcccccaacagagccagaatgtag

SEQ ID NO: 78426 - DNA, 672 bp, Artificial Sequence
  Description of Artificial Sequence: Synthetic coding sequence
atggcctgcctgggcttccagagacacaaggcccagctgaacctggccaccagaacctggccctgcaccctgctgttcttcctgctgttcatccccgtgttctgcaaggccatgcacgtggcccagcccgccgtggtgctggccagcagcagaggcatcgccagcttcgtgtgcgagtacgccagccccggcaaggccaccgaggtgagagtgaccgtgctgagacaggccgacagccaggtgaccgaggtgtgcgccgccacctacatgatgggcaacgagctgaccttcctggacgacagcatctgcaccggcaccagcagcggcaaccaggtgaacctgaccatccagggcctgagagccatggacaccggcctgtacatctgcaaggtggagctgatgtacccccccccctactacctgggcatcggcaacggcacccagatctacgtgatcgaccccgagccctgccccgacagcgacttcctgctgtggatcctggccgccgtgagcagcggcctgttcttctacagcttcctgctgaccgccgtgagcctgagcaagatgctgaagaagagaagccccctgaccaccggcgtgtacgtgaagatgccccccaccgagcccgagtgcgagaagcagttccagccctacttcatccccatcaactag

SEQ ID NO: 78427 - DNA, 414 bp, Artificial Sequence
  Description of Artificial Sequence: Synthetic coding sequence
atgcacgtggcccagcccgccgtggtgctggccagcagcagaggcatcgccagcttcgtgtgcgagtacgccagccccggcaaggccaccgaggtgagagtgaccgtgctgagacaggccgacagccaggtgaccgaggtgtgcgccgccacctacatgatgggcaacgagctgaccttcctggacgacagcatctgcaccggcaccagcagcggcaaccaggtgaacctgaccatccagggcctgagagccatggacaccggcctgtacatctgcaaggtggagctgatgtacccccccccctactacctgggcatcggcaacggcacccagatctacgtgatcgccaaggagaagaagcccagctacaacagaggcctgtgcgagaacgcccccaacagagccagaatgtag

SEQ ID NO: 78428 - DNA, 171 bp, Artificial Sequence
  Description of Artificial Sequence: Synthetic coding sequence
atggcctgcctgggcttccagagacacaaggcccagctgaacctggccaccagaacctggccctgcaccctgctgttcttcctgctgttcatccccgtgttctgcaaggtgccccccaccgagcccgagtgcgagaagcagttccagccctacttcatccccatcaactag

SEQ ID NO: 78429 - DNA, 660 bp, Artificial Sequence
  Description of Artificial Sequence: Synthetic coding sequence
atggccagcgccggcgacacccaggccggccccagagacgccgccgaccagaacttcgactacatgttcaagctgctgctgatcggcaacagcagcgtgggcaagaccagcttcctgttcagatacgccgacgacagcttcacccccgccttcgtgagcaccgtgggcatcgacttcaaggtgaagaccgtgtacagacacgacaagagaatcaagctgcagatctgggacaccgccggccaggagagatacagaaccatcaccaccgcctactacagaggcgccatgggcttcctgctgatgtacgacatcgccaaccaggagagcttcgccgccgtgcaggactgggccacccagatcaagacctacagctgggacaacgcccaggtgatcctggtgggcaacaagtgcgacctggaggacgagagagtggtgcccgccgaggacggcagaagactggccgacgacctgggcttcgagttcttcgaggccagcgccaaggagaacatcaacgtgaagcaggtgttcgagagactggtggacgtgatctgcgagaagatgaacgagagcctggagcccagcagcagcagcggcagcaacggcaagggccccgccgtgggcgacgcccccgccccccagcccagcagctgcagctgctag

SEQ ID NO: 78430 - DNA, 1566 bp, Artificial Sequence
  Description of Artificial Sequence: Synthetic coding sequence
atgctgcccagaagacccctggcctggcccgcctggctgctgagaggcgcccccggcgccgccggcagctggggcagacccgtgggccccctggccagaagaggctgctgcagcgcccccggcacccccgaggtgcccctgaccagagagagataccccgtgagaagactgcccttcagcaccgtgagcaagcaggacctggccgccttcgagagaatcgtgcccggcggcgtggtgaccgaccccgaggccctgcaggcccccaacgtggactggctgagaaccctgagaggctgcagcaaggtgctgctgagacccagaaccagcgaggaggtgagccacatcctgagacactgccacgagagaaacctggccgtgaacccccagggcggcaacaccggcatggtgggcggcagcgtgcccgtgttcgacgagatcatcctgagcaccgccagaatgaacagagtgctgagcttccacagcgtgagcggcatcctggtgtgccaggccggctgcgtgctggaggagctgagcagatacgtggaggagagagacttcatcatgcccctggacctgggcgccaagggcagctgccacatcggcggcaacgtggccaccaacgccggcggcctgagattcctgagatacggcagcctgcacggcaccgtgctgggcctggaggtggtgctggccgacggcaccgtgctggactgcctgaccagcctgagaaaggacaacaccggctacgacctgaagcagctgttcatcggcagcgagggcaccctgggcatcatcaccaccgtgagcatcctgtgcccccccaagcccagagccgtgaacgtggccttcctgggctgccccggcttcgccgaggtgctgcagaccttcagcacctgcaagggcatgctgggcgagatcctgagcgccttcgagttcatggacgccgtgtgcatgcagctggtgggcagacacctgcacctggccagccccgtgcaggagagccccttctacgtgctgatcgagaccagcggcagcaacgccggccacgacgccgagaagctgggccacttcctggagcacgccctgggcagcggcctggtgaccgacggcaccatggccaccgaccagagaaaggtgaagatgctgtgggccctgagagagagaatcaccgaggccctgagcagagacggctacgtgtacaagtacgacctgagcctgcccgtggagagactgtacgacatcgtgaccgacctgagagccagactgggcccccacgccaagcacgtggtgggctacggccacctgggcgacggcaacctgcacctgaacgtgaccgccgaggccttcagccccagcctgctggccgccctggagccccacgtgtacgagtggaccgccggccagcagggcagcgtgagcgccgagcacggcgtgggcttcagaaagagagacgtgctgggctacagcaagccccccggcgccctgcagctgatgcagcagctgaaggccctgctggaccccaagggcatcctgaacccctacaagaccctgcccagccaggcctag

SEQ ID NO: 78431 - DNA, 960 bp, Artificial Sequence
  Description of Artificial Sequence: Synthetic coding sequence
atgctgcccagaagacccctggcctggcccgcctggctgctgagaggcgcccccggcgccgccggcagctggggcagacccgtgggccccctggccagaagaggctgctgcagcgcccccggcacccccgaggtgcccctgaccagagagagataccccgtgagaagactgcccttcagcaccgtgagcaagcaggacctggccgccttcgagagaatcgtgcccggcggcgtggtgaccgaccccgaggccctgcaggcccccaacgtggactggctgagaaccctgagaggctgcagcaaggtgctgctgagacccagaaccagcgaggaggtgagccacatcctgagacactgccacgagagaaacctggccgtgaacccccagggcggcaacaccggcatggtgggcggcagcgtgcccgtgttcgacgagatcatcctgagcaccgccagaatgaacagagtgctgagcttccacagcgtgagcggcatcctggtgtgccaggccggctgcgtgctggaggagctgagcagatacgtggaggagagagacttcatcatgcccctggacctgggcgccaagggcagctgccacatcggcggcaacgtggccaccaacgccggcggcctgagattcctgagatacggcagcctgcacggcaccgtgctgggcctggaggtggtgctggccgacggcaccgtgctggactgcctgaccagcctgagaaaggacaacaccggctacgacctgaagcagctgttcatcggcagcgagggcaccctgggcatcatcaccaccgtgagcatcctgtgcccccccaagcccagagccgtgaacgtggccttcctggtgacctgcgtgccccccgcctgcggccccggcagccccagacccgccagactgccccaccccgccctgagaacccccggcgtgtgcccccagcccctgagactgtag

SEQ ID NO: 78432 - DNA, 1164 bp, Artificial Sequence
  Description of Artificial Sequence: Synthetic coding sequence
atggtgggcggcagcgtgcccgtgttcgacgagatcatcctgagcaccgccagaatgaacagagtgctgagcttccacagcgtgagcggcatcctggtgtgccaggccggctgcgtgctggaggagctgagcagatacgtggaggagagagacttcatcatgcccctggacctgggcgccaagggcagctgccacatcggcggcaacgtggccaccaacgccggcggcctgagattcctgagatacggcagcctgcacggcaccgtgctgggcctggaggtggtgctggccgacggcaccgtgctggactgcctgaccagcctgagaaaggacaacaccggctacgacctgaagcagctgttcatcggcagcgagggcaccctgggcatcatcaccaccgtgagcatcctgtgcccccccaagcccagagccgtgaacgtggccttcctgggctgccccggcttcgccgaggtgctgcagaccttcagcacctgcaagggcatgctgggcgagatcctgagcgccttcgagttcatggacgccgtgtgcatgcagctggtgggcagacacctgcacctggccagccccgtgcaggagagccccttctacgtgctgatcgagaccagcggcagcaacgccggccacgacgccgagaagctgggccacttcctggagcacgccctgggcagcggcctggtgaccgacggcaccatggccaccgaccagagaaaggtgaagatgctgtgggccctgagagagagaatcaccgaggccctgagcagagacggctacgtgtacaagtacgacctgagcctgcccgtggagagactgtacgacatcgtgaccgacctgagagccagactgggcccccacgccaagcacgtggtgggctacggccacctgggcgacggcaacctgcacctgaacgtgaccgccgaggccttcagccccagcctgctggccgccctggagccccacgtgtacgagtggaccgccggccagcagggcagcgtgagcgccgagcacggcgtgggcttcagaaagagagacgtgctgggctacagcaagccccccggcgccctgcagctgatgcagcagctgaaggccctgctggaccccaagggcatcctgaacccctacaagaccctgcccagccaggcctag

SEQ ID NO: 78433 - DNA, 978 bp, Artificial Sequence
  Description of Artificial Sequence: Synthetic coding sequence
atgctgcccagaagacccctggcctggcccgcctggctgctgagaggcgcccccggcgccgccggcagctggggcagacccgtgggccccctggccagaagaggctgctgcagcgcccccggcacccccgaggtgcccctgaccagagagagataccccgtgagaagactgcccttcagcaccgtgagcaagcaggacctggccgccttcgagagaatcgtgcccggcggcgtggtgaccgaccccgaggccctgcaggcccccaacgtggactggctgagaaccctgagaggctgcagcaaggtgctgctgagacccagaaccagcgaggaggtgagccacatcctgagacactgccacgagagaaacctggccgtgaacccccagggcggcaacaccggcatggtgggcggcagcgtgcccgtgttcgacgagatcatcctgagcaccgccagaatgaacagagtgctgagcttccacagcgtgagcggcatcctggtgtgccaggccggctgcgtgctggaggagctgagcagatacgtggaggagagagacttcatcatgcccctggacctgggcgccaagggcagctgccacatcggcggcaacgtggccaccaacgccggcggcctgagattcctgagatacggcagcctgcacggcaccgtgctgggcctggaggtggtgctggccgacggcaccgtgctggactgcctgaccagcctgagaaaggacaacaccggctacgacctgaagcagctgttcatcggcagcgagggcaccctgggcatcatcaccaccgtgagcatcctgtgcccccccaagcccagagccgtgaacgtggccttcctggtgacctgcgtgccccccgcctgcggccccggcagccccagacccgccagactgccccaccccgccctgagaacccccggcctgagacaggagagcctggccagcagctgccacgcccacgtgtag

SEQ ID NO: 78434 - DNA, 426 bp, Artificial Sequence
  Description of Artificial Sequence: Synthetic coding sequence
atgctgtgggccctgagagagagaatcaccgaggccctgagcagagacggctacgtgtacaagtacgacctgagcctgcccgtggagagactgtacgacatcgtgaccgacctgagagccagactgggcccccacgccaagcacgtggtgggctacggccacctgggcgacggcaacctgcacctgaacgtgaccgccgaggccttcagccccagcctgctggccgccctggagccccacgtgtacgagtggaccgccggccagcagggcagcgtgagcgccgagcacggcgtgggcttcagaaagagagacgtgctgggctacagcaagccccccggcgccctgcagctgatgcagcagctgaaggccctgctggaccccaagggcatcctgaacccctacaagaccctgcccagccaggcctag

SEQ ID NO: 78435 - DNA, 609 bp, Artificial Sequence
  Description of Artificial Sequence: Synthetic coding sequence
atgagcttcccccccctgtggcccaccagacacgtgcccgccagccaccccacctgccccctgctgcccggcccctgctgctgcccccactgcctgtgcgacagcgccccccccagcctgccctgccccaccctggtgcagggcgccagcagacccatcctgatcctgagagccttccccggcccctgccacagcgtgccctgccacgacctgaagctgcaggtgggcgccagccccttcagacacggctgcccccccagcgtgagatgccccagcagactgatcgccggcgtgcccggctgcagcgtgctgagctggagcctgggccacagcctgagcggcatcgacagcagagtgggcgccacccccggcctgggccacagcctgagctgggtgagagccccccccggcctgggccacagcctgagcggcgtgggcgccacccccggcctgggccacctgctgagcggcgtgggcgccagccccggcgaggacaccgagcacgccgccgccctgaccccctgcggcgtgccccccgtgcccggctgcagaagccacagccagcccctgagccacctggtgagcagcagcagatgctgcggcccctag

SEQ ID NO: 78436 - DNA, 849 bp, Artificial Sequence
  Description of Artificial Sequence: Synthetic coding sequence
atggccctgagctgcagcagctggtgcagaagcccccagtggaagttcgaggccagcaagagccacgccaaccacagacccatctgcctgagccccagaatctggcccggcagcgccagcgccaccagcaccgtgtgcagcagcagcgagagcttcctgcccagaggcccccccgccgtgagcctgctgctgcacggcccccccaccgtgagcttcccccccccctggcccacccaccacgtgctgcccagccccgtggcccaccccccctgcccctgcctgccccccgacatgcccctggagctgcccggcccctgctgctgcccccactgcctgtgcgacagcgccccccccagcctgccctgccccaccctggtgcagggcgccagcagacccatcctgatcctgagagccttccccggcccctgccacagcgtgccctgccacgacctgaagctgcaggtgggcgccagccccttcagacacggctgcccccccagcgtgagatgccccagcagactgatcgccggcgtgcccggctgcagcgtgctgagctggagcctgggccacagcctgagcggcatcgacagcagagtgggcgccacccccggcctgggccacagcctgagctgggtgagagccccccccggcctgggccacagcctgagcggcgtgggcgccacccccggcctgggccacctgctgagcggcgtgggcgccagccccggcgaggacaccgagcacgccgccgccctgaccccctgcggcgtgccccccgtgcccggctgcagaagccacagccagcccctgagccacctggtgagcagcagcagatgctgcggcccctag

SEQ ID NO: 78437 - DNA, 1245 bp, Artificial Sequence
  Description of Artificial Sequence: Synthetic coding sequence
atgggcggcctgagcgccagacccaccgccggcagaaccgaccccgccggcacctgctggggccaggaccccggcagcaagatggccaccgtgatccccggccccctgagcctgggcgaggacttctacagagaggccatcgagcactgcagaagctacaacgccagactgtgcgccgagagaagcctgagactgcccttcctggacagccagaccggcgtggcccagaacaactgctacatctggatggagaagacccacagaggccccggcctggcccccggccagatctacacctaccccgccagatgctggagaaagaagagaagactgaacatcctggaggaccccagactgagaccctgcgagtacaagatcgactgcgaggcccccctgaagaaggagggcggcctgcccgagggccccgtgctggaggccctgctgtgcgccgagaccggcgagaagaagatcgagctgaaggaggaggagaccatcatggactgccagaagcagcagctgctggagttcccccacgacctggaggtggaggacctggaggacgacatccccagaagaaagaacagagccaagggcaaggcctacggcatcggcggcctgagaaagagacaggacaccgccagcctggaggacagagacaagccctacgtgtgcgacatctgcggcaagagatacaagaacagacccggcctgagctaccactacacccacacccacctggccgaggaggagggcgaggagaacgccgagagacacgccctgcccttccacagaaagaacaaccacaagcagttctacaaggagctggcctgggtgcccgaggcccagagaaagcacaccgccaagaaggcccccgacggcaccgtgatccccaacggctactgcgacttctgcctgggcggcagcaagaagaccggctgccccgaggacctgatcagctgcgccgactgcggcagaagcggccaccccagctgcctgcagttcaccgtgaacatgaccgccgccgtgagaacctacagatggcagtgcatcgagtgcaagagctgcagcctgtgcggcaccagcgagaacgacgaccagctgctgttctgcgacgactgcgacagaggctaccacatgtactgcctgagcccccccatggccgagccccccgagggcagctggagctgccacctgtgcctgagacacctgaaggagaaggccagcgcctacatcaccctgacctag

SEQ ID NO: 78438 - DNA, 1074 bp, Artificial Sequence
  Description of Artificial Sequence: Synthetic coding sequence
atggccaccgtgatccacaaccccctgaaggccctgggcgaccagttctacaaggaggccatcgagcactgcagaagctacaacagcagactgtgcgccgagagaagcgtgagactgcccttcctggacagccagaccggcgtggcccagaacaactgctacatctggatggagaagagacacagaggccccggcctggcccccggccagctgtacacctaccccgccagatgctggagaaagaagagaagactgcacccccccgaggaccccaagctgagactgctggagatcaagcccgaggtggagctgcccctgaagaaggacggcttcaccagcgagagcaccaccctggaggccctgctgagaggcgagggcgtggagaagaaggtggacgccagagaggaggagagcatccaggagatccagagagtgctggagaacgacgagaacgtggaggagggcaacgaggaggaggacctggaggaggacatccccaagagaaagaacagaaccagaggcagagccagaggcagcgccggcggcagaagaagacacgacgccgccagccaggaggaccacgacaagccctacgtgtgcgacatctgcggcaagagatacaagaacagacccggcctgagctaccactacgcccacacccacctggccagcgaggagggcgacgaggcccaggaccaggagaccagaagcccccccaaccacagaaacgagaaccacagaccccagaagggccccgacggcaccgtgatccccaacaactactgcgacttctgcctgggcggcagcaacatgaacaagaagagcggcagacccgaggagctggtgagctgcgccgactgcggcagaagcgcccacctgggcggcgagggcagaaaggagaaggaggccgccgccgccgccagaaccaccgaggacctgttcggcagcaccagcgagagcgacaccagcaccttccacggcttcgacgaggacgacctggaggagcccagaagctgcagaggcagaagaagcggcagaggcagccccaccgccgacaagaagggcagctgctag

SEQ ID NO: 78439 - DNA, 999 bp, Artificial Sequence
  Description of Artificial Sequence: Synthetic coding sequence
atggagaagacccacagaggccccggcctggcccccggccagatctacacctaccccgccagatgctggagaaagaagagaagactgaacatcctggaggaccccagactgagaccctgcgagtacaagatcgactgcgaggcccccctgaagaaggagggcggcctgcccgagggccccgtgctggaggccctgctgtgcgccgagaccggcgagaagaagatcgagctgaaggaggaggagaccatcatggactgccagaagcagcagctgctggagttcccccacgacctggaggtggaggacctggaggacgacatccccagaagaaagaacagagccaagggcaaggcctacggcatcggcggcctgagaaagagacaggacaccgccagcctggaggacagagacaagccctacgtgtgcgacatctgcggcaagagatacaagaacagacccggcctgagctaccactacacccacacccacctggccgaggaggagggcgaggagaacgccgagagacacgccctgcccttccacagaaagaacaaccacaagcagttctacaaggagctggcctgggtgcccgaggcccagagaaagcacaccgccaagaaggcccccgacggcaccgtgatccccaacggctactgcgacttctgcctgggcggcagcaagaagaccggctgccccgaggacctgatcagctgcgccgactgcggcagaagcggccaccccagctgcctgcagttcaccgtgaacatgaccgccgccgtgagaacctacagatggcagtgcatcgagtgcaagagctgcagcctgtgcggcaccagcgagaacgacgaccagctgctgttctgcgacgactgcgacagaggctaccacatgtactgcctgagcccccccatggccgagccccccgagggcagctggagctgccacctgtgcctgagacacctgaaggagaaggccagcgcctacatcaccctgacctag

SEQ ID NO: 78440 - DNA, 1143 bp, Artificial Sequence
  Description of Artificial Sequence: Synthetic coding sequence
atgggcggcctgagcgccagacccaccgccggcagaaccgaccccgccggcacctgctggggccaggaccccggcagcaagatggccaccgtgatccccggccccctgagcctgggcgaggacttctacagagaggccatcgagcactgcagaagctacaacgccagactgtgcgccgagagaagcctgagactgcccttcctggacagccagaccggcgtggcccagaacaactgctacatctggatggagaagacccacagaggccccggcctggcccccggccagatctacacctaccccgccagatgctggagaaagaagagaagactgaacatcctggaggaccccagactgagaccctgcgagtacaagatcgactgcgaggcccccctgaagaaggagggcggcctgcccgagggccccgtgctggaggccctgctgtgcgccgagaccggcgagaagaagatcgagctgaaggaggaggagaccatcatggactgccagaagcagcagctgctggagttcccccacgacctggaggtggaggacctggaggacgacatccccagaagaaagaacagagccaagggcaaggcctacggcatcggcggcctgagaaagagacaggacaccgccagcctggaggacagagacaagccctacgtgtgcgacaagttctacaaggagctggcctgggtgcccgaggcccagagaaagcacaccgccaagaaggcccccgacggcaccgtgatccccaacggctactgcgacttctgcctgggcggcagcaagaagaccggctgccccgaggacctgatcagctgcgccgactgcggcagaagcggccaccccagctgcctgcagttcaccgtgaacatgaccgccgccgtgagaacctacagatggcagtgcatcgagtgcaagagctgcagcctgtgcggcaccagcgagaacgacggcgccagctgggccggcctgaccccccaggaccagctgctgttctgcgacgactgcgacagaggctaccacatgtactgcctgagcccccccatggccgagccccccgagggcagctggagctgccacctgtgcctgagacacctgaaggagaaggccagcgcctacatcaccctgacctag

SEQ ID NO: 78441 - DNA, 612 bp, Artificial Sequence
  Description of Artificial Sequence: Synthetic coding sequence
atggccaccgccatccagaaccccctgaagagcctgggcgaggacttctacagagaggccatcgagcactgcagaagctacaacgccagactgtgcgccgagagaagcctgagactgcccttcctggacagccagaccggcgtggcccagaacaactgctacatctggatggagaagacccacagaggccccggcctggcccccggccagatctacacctaccccgccagatgctggagaaagaagagaagactgaacatcctggaggaccccagactgagaccctgcgagtacaagatcgactgcgaggcccccctgaagaaggagggcggcctgcccgagggccccgtgctggaggccctgctgtgcgccgagaccggcgagaagaagatcgagctgaaggaggaggagaccatcatggactgccagaagcagcagctgctggagttcccccacgacctggaggtggaggacctggaggacgacatccccagaagaaagaacagagccaagggcaaggcctacggcatcggcggcctgagaaagagacaggacaccgccagcctggaggacagagacaagccctacgtgtgcgacagcgagagcttctag

SEQ ID NO: 78442 - DNA, 1245 bp, Artificial Sequence; identical to SEQ ID NO: 78437
  Description of Artificial Sequence: Synthetic coding sequence

SEQ ID NO: 78443 - DNA, 1167 bp, Artificial Sequence
  Description of Artificial Sequence: Synthetic coding sequence
atggccaccgccatccagaaccccctgaagagcctgggcgaggacttctacagagaggccatcgagcactgcagaagctacaacgccagactgtgcgccgagagaagcctgagactgcccttcctggacagccagaccggcgtggcccagaacaactgctacatctggatggagaagacccacagaggccccggcctggcccccggccagatctacacctaccccgccagatgctggagaaagaagagaagactgaacatcctggaggaccccagactgagaccctgcgagtacaagatcgactgcgaggcccccctgaagaaggagggcggcctgcccgagggccccgtgctggaggccctgctgtgcgccgagaccggcgagaagaagatcgagctgaaggaggaggagaccatcatggactgccagaagcagcagctgctggagttcccccacgacctggaggtggaggacctggaggacgacatccccagaagaaagaacagagccaagggcaaggcctacggcatcggcggcctgagaaagagacaggacaccgccagcctggaggacagagacaagccctacgtgtgcgacatctgcggcaagagatacaagaacagacccggcctgagctaccactacacccacacccacctggccgaggaggagggcgaggagaacgccgagagacacgccctgcccttccacagaaagaacaaccacaagcagttctacaaggagctggcctgggtgcccgaggcccagagaaagcacaccgccaagaaggcccccgacggcaccgtgatccccaacggctactgcgacttctgcctgggcggcagcaagaagaccggctgccccgaggacctgatcagctgcgccgactgcggcagaagcggccaccccagctgcctgcagttcaccgtgaacatgaccgccgccgtgagaacctacagatggcagtgcatcgagtgcaagagctgcagcctgtgcggcaccagcgagaacgacgaccagctgctgttctgcgacgactgcgacagaggctaccacatgtactgcctgagcccccccatggccgagccccccgagggcagctggagctgccacctgtgcctgagacacctgaaggagaaggccagcgcctacatcaccctgacctag

SEQ ID NO: 78444 - DNA, 1176 bp, Artificial Sequence
  Description of Artificial Sequence: Synthetic coding sequence
atggccgccgtggtggagaacgtggtgaagctgctgggcgagcagtactacaaggacgccatggagcagtgccacaactacaacgccagactgtgcgccgagagaagcgtgagactgcccttcctggacagccagaccggcgtggcccagagcaactgctacatctggatggagaagagacacagaggccccggcctggccagcggccagctgtacagctaccccgccagaagatggagaaagaagagaagagcccacccccccgaggaccccagactgagcttccccagcatcaagcccgacaccgaccagaccctgaagaaggagggcctgatcagccaggacggcagcagcctggaggccctgctgagaaccgaccccctggagaagagaggcgcccccgaccccagagtggacgacgacagcctgggcgagttccccgtgaccaacagcagagccagaaagagaatcctggagcccgacgacttcctggacgacctggacgacgaggactacgaggaggacacccccaagagaagaggcaagggcaagagcaagggcaagggcgtgggcagcgccagaaagaagctggacgccagcatcctggaggacagagacaagccctacgcctgcgacatctgcggcaagagatacaagaacagacccggcctgagctaccactacgcccacagccacctggccgaggaggagggcgaggacaaggaggacagccagccccccacccccgtgagccagagaagcgaggagcagaagagcaagaagggccccgacggcctggccctgcccaacaactactgcgacttctgcctgggcgacagcaagatcaacaagaagaccggccagcccgaggagctggtgagctgcagcgactgcggcagaagcggccaccccagctgcctgcagttcacccccgtgatgatggccgccgtgaagacctacagatggcagtgcatcgagtgcaagtgctgcaacatctgcggcaccagcgagaacgacgaccagctgctgttctgcgacgactgcgacagaggctaccacatgtactgcctgacccccagcatgagcgagccccccgagggcagctggagctgccacctgtgcctggacctgctgaaggagaaggccagcatctaccagaaccagaacagcagctag

SEQ ID NO: 78445 - DNA, 1134 bp, Artificial Sequence
  Description of Artificial Sequence: Synthetic coding sequence
agcagcatcatccagaacagactgaagaagctgggcgaccagttctacaaggaggccatcgagcactgcagaagctacaacagcagactgtgcgccgagagaagcgtgagactgcccttcctggacagccagaccggcgtggcccagaacaactgctacatctggatggagaagagacacagaggccccggcctggcccccggccagctgtacacctaccccgccagatgctggagaaagaagagaagactgcacccccccgaggaccccaagctgagactgctggagatcaagcccgaggtggagctgcccctgaagaaggacggcttcaccagcgagagcaccaccctggaggccctgctgagaggcgagggcgtggagaagaaggtggacgccagagaggaggagagcatccaggagatccagagagtgctggagaacgacgagaacgtggaggagggcaacgaggaggaggacctggaggaggacatccccaagagaaagaacagaaccagaggcagagccagaggcagcgccggcggcagaagaagacacgacgccgccagccaggaggaccacgacaagccctacgtgtgcgacatctgcggcaagagatacaagaacagacccggcctgagctaccactacgcccacacccacctggccagcgaggagggcgacgaggcccaggaccaggagaccagaagcccccccaaccacagaaacgagaaccacagaccccagaagggccccgacggcaccgtgatccccaacaactactgcgacttctgcctgggcggcagcaacatgaacaagaagagcggcagacccgaggagctggtgagctgcgccgactgcggcagaagcggccaccccacctgcctgcagttcaccctgaacatgaccgaggccgtgaagacctacaagtggcagtgcatcgagtgcaagagctgcatcctgtgcggcaccagcgagaacgacgaccagctgctgttctgcgacgactgcgacagaggctaccacatgtactgcctgaacccccccgtggccgagccccccgagggcagctggagctgccacctgtgctgggagctgctgaaggagaaggccagcgccttcggctgccaggcctag

SEQ ID NO: 78446 - DNA, 1074 bp, Artificial Sequence; identical to SEQ ID NO: 78438
  Description of Artificial Sequence: Synthetic coding sequence

SEQ ID NO: 78447 - DNA, 1137 bp, Artificial Sequence
  Description of Artificial Sequence: Synthetic coding sequence
atggccaccgtgatccacaaccccctgaaggccctgggcgaccagttctacaaggaggccatcgagcactgcagaagctacaacagcagactgtgcgccgagagaagcgtgagactgcccttcctggacagccagaccggcgtggcccagaacaactgctacatctggatggagaagagacacagaggccccggcctggcccccggccagctgtacacctaccccgccagatgctggagaaagaagagaagactgcacccccccgaggaccccaagctgagactgctggagatcaagcccgaggtggagctgcccctgaagaaggacggcttcaccagcgagagcaccaccctggaggccctgctgagaggcgagggcgtggagaagaaggtggacgccagagaggaggagagcatccaggagatccagagagtgctggagaacgacgagaacgtggaggagggcaacgaggaggaggacctggaggaggacatccccaagagaaagaacagaaccagaggcagagccagaggcagcgccggcggcagaagaagacacgacgccgccagccaggaggaccacgacaagccctacgtgtgcgacatctgcggcaagagatacaagaacagacccggcctgagctaccactacgcccacacccacctggccagcgaggagggcgacgaggcccaggaccaggagaccagaagcccccccaaccacagaaacgagaaccacagaccccagaagggccccgacggcaccgtgatccccaacaactactgcgacttctgcctgggcggcagcaacatgaacaagaagagcggcagacccgaggagctggtgagctgcgccgactgcggcagaagcggccaccccacctgcctgcagttcaccctgaacatgaccgaggccgtgaagacctacaagtggcagtgcatcgagtgcaagagctgcatcctgtgcggcaccagcgagaacgacgaccagctgctgttctgcgacgactgcgacagaggctaccacatgtactgcctgaacccccccgtggccgagccccccgagggcagctggagctgccacctgtgctgggagctgctgaaggagaaggccagcgccttcggctgccaggcctag

SEQ ID NO: 78448 - DNA, 4110 bp, Artificial Sequence
  Description of Artificial Sequence: Synthetic coding sequence
atgagcccctgcggcagaaagatgggcgagggcagacagcagagaagagcccccgtgggcaagctgctgctgctgcccggcagaagagacaccccccacggcagaagcggcagcagcggcgccagaacccagagaagcctgctgtggctgctggtgcacgtgtggctgtgggccgccagcggcagcagcgcccagctgttcaacctgaccctgagcgtggacgagggcctgccccccgacaccctggtgggcgacatcagagccggcctgcccgccgcccagcagcaggagggcagcggcttcttcctgagcgaggacagcgacgacagccccctgctggacgacttccacgtgcaccccgacaccggcatcatcagaaccgccagaagactggacagagagagaagagaccactacagcttcgtggccgccaccctgctgggcgccgtggtgcaggtggagatcagagtgaacgacgtgaacgaccacagccccagattccccctggacagcctgcagctggacgtgagcgagctgagcccccccggcaccgccttcagactgcccgtggcccacgaccccgacgccggcctgttcagcacccagggctacaccctggtgcagcccagcgacctgcccaaggaccccgccggccccttcttccagctgagatacagaacccccggccccctgcccagccccctgctgcccggcagcagcagccccctggagcccctggacctggtgctgctgagaagactggacagagaggaggccgccgcccacagactgcagatcgaggcctgggacggcggcagacccagaagaaccggcctgctgagcgtggagctgagagtgctggacgagaacgacaacccccccgtgttcgagcaggacgagtacagagccgccgtgagagaggacgcccagcccggcgccgaggtgtgcagagtgagagccaccgacagagacctgggccccaacggcttcgtgagatacagcgtgagagccagacaggtgcccggcgccggcagcggcggcggcgccctgggcgacgccgcctacttcgccgtggaggagctgagcggcgtggtgagagtgtggagacccctggacagagaggcccaggcctggcaccagctggtggtggaggccagagacggcggcgccgagcccgaggtggccaccgtgagagtgagcatcgccgtgctggacgtgaacgacaacagacccgccatccacgtgctgttcctgaccgagggcggcgtggccagagtgagcgagggcgccagacccggcgactacgtggccagagtgagcgtgagcgacgccgacggcgactgggagaaggaggacgaggccaccggcgagctgggcgtgggcctgggcgacggcagcatcagcctgagcctggagggcggcgagggcgacttcgccctgctgcccggcggcccccccggcgtgttcttcctgtgcgtggagggccccctggacagagagagcagagacctgtacgagctgctgctggtggccaccgacgccggcagcccccccctgagcaccgaggagaccctgctgctgagagtggccgacctgaacgaccagccccccctgttcagccagcagcactacaaggccagcgtgagcgaggccgccgcccccggcaccgtggtgatgtgggtgagcgccagcgacgccgacgaggccggcagcgaccacgcctggctgagatacaccgtggtgcagctgagcgccccctgcaacctgggcagcctgcagagcaagatggtgcacaccgccgagtgcggccccagcttcgccatcgacagcgagagcggcgccatcagcaccatcagaaccctggacagagaggtgcaggaggccgtggagctgaaggtggtggcccaggacctgggcgagccccccctgagcgccacctgcctggtgagcatcaccgtggacgacgtgaacgacaacgagcccatcttctggagacaggtgtacaacgccaccatcgccgagcacgcccccgtgggccactgcttcctgcaggtgaccgccagcgacgccgacagcggcctgtacggcttcatcgagtacagcctgtacgacggcttcctgagctacgaggccccccaggccttcagaatcgacccccacgacggccagatctgcgtgagccaggacatcgacagagagagagaccccgccacctacgacctgctggtggaggccaaggacggcggcggcctgagcgcccaggccttcgtgagagtggacctggaggacgtgaacgacaaccaccccgtgttcaaccccagcacctacgtgaccagcatcagcgacgagacccagcccggcaccgagatcatcaacgtgctggccaccgaccaggacagcggcatctacggcaccgtggcctacgagctgatccccggcaacgtgagcagcctgttcaccatcgacagcaccaccggcatcatctacctgaccctgcccctgagccacctggagagcaccaccctgagcctgatggtgagcgcccaggacggcggcggcctgaccgccgtgatcaacgccgacgtgaccatccacatcttccagaccaccctggcccccgccgagttcgagagacccaagtacaccttcctggtgtacgaggacgtgcccgaggacagccccatcggcaccgtgaaggccagagagcccctgaacagcagcgagcccatcttctacagaatcagcagcggcgacctgggcggcaagttcagcatccaccccagactgggcaccatcagaaccagaaagcccctggaccacgagacccagcccgtggtggtgctgaccgtgcaggcccagctgggcagcgcccccgcctgcagcagcaccgaggtgaacatcaccgtgatggacgtgaacgacaaccaccccgccttcctgagaaccagcgacgagatcagaatcagccagaccaccccccccggcaccgccctgtacctggccagagccgaggacagagacagcggcagaaacggcctgatcagatacagcatcgccagcccccagcccggcgtgttcgccatcgacagagccctgggcgtgctgttcctgaacggcagcctgggcgccggcgagcagagagagctgaccctgaccctgagagccgaggaccagggcgtgcacccccaggccgccctgctggtgctgaccgtggtgatcgagaagagagagcacagccccagctggaccttcgagcacctggtgtaccaggtggaggtgagcgagagcctgagccccatgacccagatgctgcagacccaggcccaccccctgggcccccagagagccgccagccccctgagatacagcctggagcccagcgtggacagcgccatgttcggcatcagaccctacaccggctggatctacctgagaagacagttcgactacgagagcacccagacctacaacttcagagtgttcgcctggatccccgaggacggcttcctgcagaacgtgagcaccaccgtgatcgtgagagtgtgggacgagaacgacaacagccccaccttcctgcacgacgtgctgttcctgaaggtggaggagagccccgtgccccagggcgtgatcggcaagatcaccgccatcgacatggacagcggcaagaacggccagctgctgtacttcctgctgagcgacggcaagttcttcaagatgaaccccaacaccggcgagctgatcaactgggtggccctggacagagagcacagaggccaccacgagatgaccgtgctggtgaccgacagaggcagcccccccagaaacgccaccatggccgtgtacgtgagcgtgaccgacatcaacgacaacagacccttcttcccccagtgcctgcccggcaaggagctgcacgtgaaggtgctggagggccagcccgtgaacatgctggtgaccaccgtgttcgccaaggaccccgacgagggcaacaacgccgaggtgacctacagcgtgagcagcgccagacccatgcccctgaagggcaagaccgccttcggcaagcagagctgcaagaagcagaccaacaagcagaccaacaagatcctgacctag

SEQ ID NO: 78449 - DNA, 8751 bp, Artificial Sequence
  Description of Artificial Sequence: Synthetic coding sequence
atgagactggacgagatcaccaagagcgagaacgaggacggcgagaagaagatgttcacccagcagttcgagagcaccgacgcctgcgtgtacgaggtgtacgtgaagatcaacagcatcgtgaagagccagagccagtgcggcctgaagagaggcagccccgagaccgagctgtggggcgccatcgtgttcagaagccaggaggagaacgccaagcccgtgaaggagaccgaggtgaccgccagcgacgccgacagcggcctgtacggcttcatcgagtacagcctgtacgacggcttcctgagctacgaggccccccaggccttcagaatcgacccccacgacggccagatctgcgtgagccaggacatcgacagagagagagaccccgccacctacgacctgctggtggaggccaaggacggcgacgagcagagaatgacccacctggccctggtgaagggcggcctgagcgcccaggccttcgtgagagtggacctggaggacgtgaacgacaaccaccccgtgttcaaccccagcacctacgtgaccagcatcagcgacgagacccagcccggcaccgagatcatcaacgtgctggccaccgaccaggacagcggcatctacggcaccgtggcctacgagctgatccccggcaacgtgagcagcctgttcaccatcgacagcaccaccggcctgtacagccccgaggtggagatcctgagcgccgtgaacttcagcgccgacaaggaggtgatgaacagcctggagatgttcctgcccctgctgagacacttcaagaaggtggagagagacgaggaggccgccgagaagaagttcgaggccagcagaggctggttcatgagattcaagggcagaagacacctgcactacctgaaggtgcaggacgaggccgccagcgccgacggcgaggccgccgccagatacgtggccaacctggccaagatcctgggcgagggcatcatctacctgaccctgcccctgagccacctggagagcaccaccctgagcctgatggtgagcgcccaggacggcggcggcctgaccgccgtgatcaacgccgacgtgaccatccacatcttccagaccaccctggcccccgccgagttcgagagacccaagtacaccttcctggtgtacgaggacgtgcccgaggacagccccatcggcaccgtgaaggccagagagcccctgaacagcagcgagcccatcttctacagaatcagcagcggcgacctgggcggcaagttcagcatccaccccagactgggcaccatcagaaccagaaagcccctggaccacgagacccagcccgtggtggtgctgaccgtgcaggcccagctgggcagcgcccccgcctgcagcagcaccgaggtgaacatcaccgtgatggacgtgaacgacaaccaccccgccttcctgagaaccagcgacgagatcagaatcagccagaccaccccccccggcaccgccctgtacctggccagagccgaggacagagacagcggcagaaacggcctgatcagatacagcatcgccagcccccagcccggcgtgttcgccatcgacagagccctgggcgtgctgttcctgaacggcagcctgggcgccggcgagcagagagagctgaccctgaccctgagagccgaggaccagggcgtgcacccccaggccgccctgctggtgctgaccgtggtgatcgagaagagagagcacagccccagctggaccttcgagcacctggtgtaccaggtggaggtgagcgagagcctgagccccatgacccagatgctgcagacccaggcccaccccctgggcccccagagagccgccagccccctgagatacagcctggagcccagcgtggacagcgccatgttcggcatcagaccctacaccggctggatctacctgagaagacagttcgactacgagagcacccagacctacaacttcagagtgttcgcctggatccccgaggacggcttcctgcagaacgtgagcaccaccgtgatcgtgagagtgtgggacgagaacgacaacagccccaccttcctgcacgacgtgctgttcctgaaggtggaggagagccccgtgccccagggcgtgatcggcaagatcaccgccatcgacatggacagcggcaagaacggccagctgctgtacttcctgctgagcgacggcaagttcttcaagatgaaccccaacaccggccccgccggcaccatctacgtgatcacctgggccgacggcgccgccgccttcagcggcaccgacttcgccttcagcagcgacgagctgcaggccttcgtgctgaagagcctgttctgcgagctgggcgagggcgagctgatcaactgggtggccctggacagagagcacagaggccaccacgagatgaccgtgctggtgaccgacagaggcagcccccccagaaacgccaccatggccgtgtacgtgagcgtgaccgacatcaacgacaacagacccttcttcccccagtgcctgcccggcaaggagctgcacgtgaaggtgctggagggccagcccgtgaacatgctggtgaccaccgtgttcgccaaggaccccgacgagggcaacaacgccgaggtgacctacagcgtgagcagcgaggacagcagcgaccacttcaagatcgacgccaacaacggcgagatcagaaccaccaccatcctgagctacgactacagacccagctacagaatgagcgtgatcgccaccgaccagggcgtgccccccctgcagggccaggccgtggtgaacatccaggtgatccccctgagcaagggcagagccatcatgagccagaacatcagacacctgatcatccccgagaacctgaagcccaccaagatcatgagcctgatcaagagcagcgaccacctgcagcagcactacaacggcaagctgcacttcagcatcgtggccgacgacaaggacggccacttcgagatcgacagcagcaccggcgacctgttcctgagcaaggagctggactacgagaccaccagccactacctgttcagagtgatcaccaccgaccacagcaagaacctgagcctgagcagcaccgtgttcctgagcatcgacgtggaggaccagaacgaccacagccccagcttccaggacgagctgatcgtgatcagcgtggaggagaacgtgcccatcggcaccctggtgtacgtgttcaacgccaaggacgacgacggcagcttcctgaacagcagaatccagtactacatcgagagccacaaccccggcaccaaccccttcctgatccaccccagcttcggcaccctggtgaccgtgagcagactggacagagagagcatccccaccgtgatcctgaccgtgaccgccagcgaccaggccgtgaacgtgaccgacagaagactgagaagcctgaccgcccagatcgtgatcctggacgtgaacgaccacaaccccaccttcatcagcttccccaacgcccacgtgaaggaggacgtgaccgtgggcagcctggtgcaccacatcaccgcccacgaccccgacgagggcagaaacggcaaggtgacctacagcatcctgagcggcaacgagaacatgaccttcatgctggacgagagcagcggcctgctgaccaccacctgccccctggactacgagatgaagacccagcacatcctgaccgtgctggccctggacgacggcacccccgccctgagcagcagccagaccctgaccgtgaccgtgctggacgtgaacgacgaggcccccgtgttcaagcagcacctgtacgaggccagcgtgaaggagaaccagaaccccggcgagttcgtgaccagagtggaggccctggacagagacagcggcgtgaacagcaagctgcagttcgagatcatgcccggcgccagcttcgagctgttcgagatcaacagcgacaccggcgaggtggtgaccaccaccatcctggacagagagatccaggaggtgttcaccctgagagtgctggtgagagacggcggcttccccagcctgagcagcaccaccaccatcctgtgcaccgtggaggacgagaacgaccacgcccccgagttcatcgtgagcagctacgacatcgaggtgctggagaaccaggagcccgaggtggtgtacaccgtgctggccagcgacatggacgccggcaacaacagagccgtggagtaccacatcatcgacggcaacaccgacgagtgcttcaccatcaacgagatgagcggcgagctgagcaccaccagagccctggacagagagcagatcagcaacttcaccctggtgatcctgtgcagcgacctgggcgacccccccagaagcagcgtgatccacctgcaggtgagagtgctggacgccaacgaccacagccccagcttccccaccctgtactaccagagcagcgtgagagaggacgccgaggtgggcaccgtggtgctggtgctgagcgccgtggacaaggacgagggcctgaacggccagaccgagtacttcctgaccgacgaggccagcggcgccttcaccatcgaccccatgagcggcaccctgaagaccagcaacaccctggacagagaggccagaagccagcacaccttcagcgccgtggccagagactgcagcatccagggcagcagaagcaccaccgtgatcatcaaggtgtacgtgaccgacgtgaacgacaacgaccccgtgctggagcagaaccccttcgacgtgttcctgagccccgagagccccaccaaccagaccaccgtgatcgtgagagccgacgacctggacctgggccccaacggcaccgtggtgttcagcttcgccgagacccagagcatgttcagcatcgacaagtacaccggcgagatccagttccagcagaaccccagcagcgagtacttccccatctggctgcagctgaaggtgaccgaccagggcatccccgccagaaccaccaccggcctgctggtgatccacatggagggcgaggacgtgaagatcagcttcagccaccacctgtacaagggcctggtgaccgagaactgcgaggccggcaccagcatcgtgaccgtgaaggccttcgcccccgacagcatccaggacagcatgaagtacagcatcttcagcggcaacgaggacggcgtgctgagcctgtgcagcaagagcggccagctgaccgtgaaggagcccaagttcctggacttcgaggtgagaaacgaggtgcagctgatcgtgctggccgagagcagcggccacagagcctactgcaaggtggccgtgctgatccaggacgagaacgacaacagcccctgcttcgagcagagcatctaccaggccagcgtgagcgagagccagctgtacaacgcccacgtgatccaggtgttcgccaccgacctggacagcggcctgaacggcctgatcgagtacagcatcctgagcggcaaccaggaggaggccttccagatcgacgccctgagcggcgtgatcaccaccaaggccatcctggactacgagctgaccagcagctacagcctgatcgtgcaggccaccgacaagggcatgcccagactgagcaacaccaccgtgatcaaggtgcaggtgaccgacatcaacgacaacgcccccgccttcctgcccagcgaggccgtggagatcaccgaggacagcctgcccggcgtgatcgtgacccacgtgagcgtgcacgacgtggacctgaacagcgccttcatcttcagcttcgccaaggagagcaaccccggcaccaagttcgccatcgaccagaacaccggcgtggtggtgctggtgaagaccctggacttcgaggagatgaccgagtacgagctgctgatccagatcagcgacagcgtgcactacaccgagggcgccctggtggtgagagtgctggacgtgaacgacaacccccccgtgttcagccaggacttctaccaggtgaccgtgcccgagagcatccccgtgggctacagcgtgctgaccctgagcgccaccgacctggagagcaacgagaacatcagctacagaatcctgagcagcagcaaggagttcagcatcgaccccaagaacggcaccatcttcaccatcagccccgtgctgctgctggacaccatcagcaccacccagttcctggtggaggccagcgacggcggcaaccccgacctgagagccctgaccctggtggagatcggcatcgaggacatgaacaactacgcccccgagttcaccgtgaagagctacaacctgagcctgagcgaggacgccctggtgggcagcaccctggtgaccttcagcaacatcgaccacgactggaccagagagaacacctacgtggagtacagcatcatcagcggcaacagccagaacaacttccacgtggagaccaagttcttccacagcgagtacccctacaagcaggtgggctacctggtgctgctgcacagcctggacagagaggccagcgccagccacgagctggtgatcctggccagcgacagcggctgcccccccctgagcagcaccgccgtgatcagcatccaggtgctggacgtgaacgacaacccccccaacttcagcagcctgagctaccacacccacgtgaaggagagcacccccctgggcagccacatcaccgtggtgagcgccaacgacagagacaccggcagccacgccgagatcatctacaacatcatcagcggcaacgagaagggccacttctacctggaggagaacaccggcgtgctgtacctgatcaagcccctggactacgagaagatgaccaagttcaccctgaccgtgcaggccagcgacgccgagaagaagcacttcagcttcgccgtggtgttcgtgagcgtgctggacgacaacgaccacgccccccagttcatgttcagcagcttcagctgcatcgtgcccgagaacctgcccatcagcagcaccatctgcagcatcaacgccctggacttcgacgccggcccctacggcgagctgacctacagcatcgtgagcccctgcttcctgacccacggcatgagctacgaccacgacctgttcctgatcgaccccctgaccggcgacatccacgccaagcagatcctggactacgagaacggcaacaagtactgcctgaccgtgcaggccaaggacaagggcgacgccaccgccagcctggtggtgtgggtggacatcgagggcatcgacgagttcgagcccatcttcacccaggaccagtacttcttcaccctgcccgagaagaacaaggacagacagctgatcggcagagtggaggccagcgacgccgacgccggcatcgacggcgtgatcctgtacagcctgggcaccagcagccccttcttcagcgtgaacaagaccaacggcaacatctacctgatcagagccctgcccctgatcaagagccagctgaacaaggaggacaccctggagatgaagatcatcgcccacagccccaagagcgacagcaagttcgccagctgcaccgtgttcgtgaacgtgagcttcagcagcgagggcacccccctggccgtgttcgccagcagcttcagcatcagcctggtggtgagcttcctggtgttcctgatcctgatctgcatcctgatcgtgatgatcctgagacacaagcagaaggacaccatcaacaactacgaggagaagaagaccagcagcctggacgccgacctgagagtgaccagagacgccagcgtgctgaaggccttccagaagaccgacgactgcagcaacgaggtggtgcccgtggacgccacccccgagtggctgagcctgatcagcatcatggagaaggacatcgtgaacctgtacagacacagcaacagcagcggccactgcagcgtggagggcgagaccgccgaggacaaggagatccagagaatcaacgagcacccctacagaaagtgcagcgacagcgccctgagcgaccacgagagcagagtgcccgacagcggcatccccagagacagcgaccagctgagctgcctgagcggcgagaccgacgtgatggtgaccgccgagaccgccgaggccagccagaccttcggcgagggcgaccagggcgagggctgcagcaccacctgcgcccagaacaacgtgctgccccagaccgtgcagaagagagaggccaaggagagcatcctggccgacgtgagaaaggagagcgtgttcatcagcggcgaccaggaggtgagatgcgccgccctgagcacccagaccaccagcgaccacgacggcaaggacaactaccactggaactacctgctgagctgggagcccaagttccagcccctggccagcgtgttcaacgacatcgccaagctgaaggacgagcacctgcacatgcccggcatccccaaggagaagaagagcttcgtgttccccccccccctgatcaccgccgtggcccagcccggcatcaaggccgtgccccccagaatgcccgccgtgaacctgggccaggtgccccccaagcaccccagaagccccatcccctaccacctgggcagcctgcccgagggcatgacccccaacttcagccccagcctgagcctgctgaccatgcagccccccgccctgagccccctgctgagagagggcgagctgctgggcacccacatcagcggcacctgccacgagctgaaggccgaggacgaggtgcagatctag

SEQ ID NO: 78450 - DNA, 2130 bp, Artificial Sequence
  Description of Artificial Sequence: Synthetic coding sequence
atgagcccctgcggcagaaagatgggcgagggcagacagcagagaagagcccccgtgggcaagctgctgctgctgcccggcagaagagacaccccccacggcagaagcggcagcagcggcgccagaacccagagaagcctgctgtggctgctggtgcacgtgtggctgtgggccgccagcggcagcagcgcccagctgttcaacctgaccctgagcgtggacgagggcctgccccccgacaccctggtgggcgacatcagagccggcctgcccgccgcccagcagcaggagggcagcggcttcttcctgagcgaggacagcgacgacagccccctgctggacgacttccacgtgcaccccgacaccggcatcatcagaaccgccagaagactggacagagagagaagagaccactacagcttcgtggccgccaccctgctgggcgccgtggtgcaggtggagatcagagtgaacgacgtgaacgaccacagccccagattccccctggacagcctgcagctggacgtgagcgagctgagcccccccggcaccgccttcagactgcccgtggcccacgaccccgacgccggcctgttcagcacccagggctacaccctggtgcagcccagcgacctgcccaaggaccccgccggccccttcttccagctgagatacagaacccccggccccctgcccagccccctgctgcccggcagcagcagccccctggagcccctggacctggtgctgctgagaagactggacagagaggaggccgccgcccacagactgcagatcgaggcctgggacggcggcagacccagaagaaccggcctgctgagcgtggagctgagagtgctggacgagaacgacaacccccccgtgttcgagcaggacgagtacagagccgccgtgagagaggacgcccagcccggcgccgaggtgtgcagagtgagagccaccgacagagacctgggccccaacggcttcgtgagatacagcgtgagagccagacaggtgcccggcgccggcagcggcggcggcgccctgggcgacgccgcctacttcgccgtggaggagctgagcggcgtggtgagagtgtggagacccctggacagagaggcccaggcctggcaccagctggtggtggaggccagagacggcggcgccgagcccgaggtggccaccgtgagagtgagcatcgccgtgctggacgtgaacgacaacagacccgccatccacgtgctgttcctgaccgagggcggcgtggccagagtgagcgagggcgccagacccggcgactacgtggccagagtgagcgtgagcgacgccgacggcgactgggagaaggaggacgaggccaccggcgagctgggcgtgggcctgggcgacggcagcatcagcctgagcctggagggcggcgagggcgacttcgccctgctgcccggcggcccccccggcgtgttcttcctgtgcgtggagggccccctggacagagagagcagagacctgtacgagctgctgctggtggccaccgacgccggcagcccccccctgagcaccgaggagaccctgctgctgagagtggccgacctgaacgaccagccccccctgttcagccagcagcactacaaggccagcgtgagcgaggccgccgcccccggcaccgtggtgatgtgggtgagcgccagcgacgccgacgaggccggcagcgaccacgcctggctgagatacaccgtggtgcagctgagcgccccctgcaacctgggcagcctgcagagcaagatggtgcacaccgccgagtgcggccccagcttcgccatcgacagcgagagcggcgccatcagcaccatcagaaccctggacagagaggtgcaggaggccgtggagctgaaggtggtggcccaggacctgggcgagccccccctgagcgccacctgcctggtgagcatcaccgtggacgacgtgaacgacaacgagcccatcttctggagacaggtgtacaacgccaccatcgccgagcacgcccccgtgggccactgcttcctgcagctgatcagcgcccaggtggccttcgtgaagatcaagcagaagcagaaggagatccaggagaagcagaacctggcctag

SEQ ID NO: 78451 - DNA, 2109 bp, Artificial Sequence
  Description of Artificial Sequence: Synthetic coding sequence
atgggcgagggcagacagcagagaagagcccccgtgggcaagctgctgctgctgcccggcagaagagacaccccccacggcagaagcggcagcagcggcgccagaacccagagaagcctgctgtggctgctggtgcacgtgtggctgtgggccgccagcggcagcagcgcccagctgttcaacctgaccctgagcgtggacgagggcctgccccccgacaccctggtgggcgacatcagagccggcctgcccgccgcccagcagcaggagggcagcggcttcttcctgagcgaggacagcgacgacagccccctgctggacgacttccacgtgcaccccgacaccggcatcatcagaaccgccagaagactggacagagagagaagagaccactacagcttcgtggccgccaccctgctgggcgccgtggtgcaggtggagatcagagtgaacgacgtgaacgaccacagccccagattccccctggacagcctgcagctggacgtgagcgagctgagcccccccggcaccgccttcagactgcccgtggcccacgaccccgacgccggcctgttcagcacccagggctacaccctggtgcagcccagcgacctgcccaaggaccccgccggccccttcttccagctgagatacagaacccccggccccctgcccagccccctgctgcccggcagcagcagccccctggagcccctggacctggtgctgctgagaagactggacagagaggaggccgccgcccacagactgcagatcgaggcctgggacggcggcagacccagaagaaccggcctgctgagcgtggagctgagagtgctggacgagaacgacaacccccccgtgttcgagcaggacgagtacagagccgccgtgagagaggacgcccagcccggcgccgaggtgtgcagagtgagagccaccgacagagacctgggccccaacggcttcgtgagatacagcgtgagagccagacaggtgcccggcgccggcagcggcggcggcgccctgggcgacgccgcctacttcgccgtggaggagctgagcggcgtggtgagagtgtggagacccctggacagagaggcccaggcctggcaccagctggtggtggaggccagagacggcggcgccgagcccgaggtggccaccgtgagagtgagcatcgccgtgctggacgtgaacgacaacagacccgccatccacgtgctgttcctgaccgagggcggcgtggccagagtgagcgagggcgccagacccggcgactacgtggccagagtgagcgtgagcgacgccgacggcgactgggagaaggaggacgaggccaccggcgagctgggcgtgggcctgggcgacggcagcatcagcctgagcctggagggcggcgagggcgacttcgccctgctgcccggcggcccccccggcgtgttcttcctgtgcgtggagggccccctggacagagagagcagagacctgtacgagctgctgctggtggccaccgacgccggcagcccccccctgagcaccgaggagaccctgctgctgagagtggccgacctgaacgaccagccccccctgttcagccagcagcactacaaggccagcgtgagcgaggccgccgcccccggcaccgtggtgatgtgggtgagcgccagcgacgccgacgaggccggcagcgaccacgcctggctgagatacaccgtggtgcagctgagcgccccctgcaacctgggcagcctgcagagcaagatggtgcacaccgccgagtgcggccccagcttcgccatcgacagcgagagcggcgccatcagcaccatcagaaccctggacagagaggtgcaggaggccgtggagctgaaggtggtggcccaggacctgggcgagccccccctgagcgccacctgcctggtgagcatcaccgtggacgacgtgaacgacaacgagcccatcttctggagacaggtgtacaacgccaccatcgccgagcacgcccccgtgggccactgcttcctgcagctgatcagcgcccaggtggccttcgtgaagatcaagcagaagcagaaggagatccaggagaagcagaacctggcctag

SEQ ID NO: 78452 - DNA, 4101 bp, Artificial Sequence
  Description of Artificial Sequence: Synthetic coding sequence
atgagcccctgcggcagaaagatgggcgagggcagacagcagagaagagcccccgtgggcaagctgctgctgctgcccggcagaagagacaccccccacggcagaagcggcagcagcggcgccagaacccagagaagcctgctgtggctgctggtgcacgtgtggctgtgggccgccagcggcagcagcgcccagctgttcaacctgaccctgagcgtggacgagggcctgccccccgacaccctggtgggcgacatcagagccggcctgcccgccgcccagcagcaggagggcagcggcttcttcctgagcgaggacagcgacgacagccccctgctggacgacttccacgtgcaccccgacaccggcatcatcagaaccgccagaagactggacagagagagaagagaccactacagcttcgtggccgccaccctgctgggcgccgtggtgcaggtggagatcagagtgaacgacgtgaacgaccacagccccagattccccctggacagcctgcagctggacgtgagcgagctgagcccccccggcaccgccttcagactgcccgtggcccacgaccccgacgccggcctgttcagcacccagggctacaccctggtgcagcccagcgacctgcccaaggaccccgccggccccttcttccagctgagatacagaacccccggccccctgcccagccccctgctgcccggcagcagcagccccctggagcccctggacctggtgctgctgagaagactggacagagaggaggccgccgcccacagactgcagatcgaggcctgggacggcggcagacccagaagaaccggcctgctgagcgtggagctgagagtgctggacgagaacgacaacccccccgtgttcgagcaggacgagtacagagccgccgtgagagaggacgcccagcccggcgccgaggtgtgcagagtgagagccaccgacagagacctgggccccaacggcttcgtgagatacagcgtgagagccagacaggtgcccggcgccggcagcggcggcggcgccctgggcgacgccgcctacttcgccgtggaggagctgagcggcgtggtgagagtgtggagacccctggacagagaggcccaggcctggcaccagctggtggtggaggccagagacggcggcgccgagcccgaggtggccaccgtgagagtgagcatcgccgtgctggacgtgaacgacaacagacccgccatccacgtgctgttcctgaccgagggcggcgtggccagagtgagcgagggcgccagacccggcgactacgtggccagagtgagcgtgagcgacgccgacggcgactgggagaaggaggacgaggccaccggcgagctgggcgtgggcctgggcgacggcagcatcagcctgagcctggagggcggcgagggcgacttcgccctgctgcccggcggcccccccggcgtgttcttcctgtgcgtggagggccccctggacagagagagcagagacctgtacgagctgctgctggtggccaccgacgccggcagcccccccctgagcaccgaggagaccctgctgctgagagtggccgacctgaacgaccagccccccctgttcagccagcagcactacaaggccagcgtgagcgaggccgccgcccccggcaccgtggtgatgtgggtgagcgccagcgacgccgacgaggccggcagcgaccacgcctggctgagatacaccgtggtgcagctgagcgccccctgcaacctgggcagcctgcagagcaagatggtgcacaccgccgagtgcggccccagcttcgccatcgacagcgagagcggcgccatcagcaccatcagaaccctggacagagaggtgcaggaggccgtggagctgaaggtggtggcccaggacctgggcgagccccccctgagcgccacctgcctggtgagcatcaccgtggacgacgtgaacgacaacgagcccatcttctggagacaggtgtacaacgccaccatcgccgagcacgcccccgtgggccactgcttcctgcaggtgaccgccagcgacgccgacagcggcctgtacggcttcatcgagtacagcctgtacgacggcttcctgagctacgaggccccccaggccttcagaatcgacccccacgacggccagatctgcgtgagccaggacatcgacagagagagagaccccgccacctacgacctgctggtggaggccaaggacggcggcggcctgagcgcccaggccttcgtgagagtggacctggaggacgtgaacgacaaccaccccgtgttcaaccccagcacctacgtgaccagcatcagcgacgagacccagcccggcaccgagatcatcaacgtgctggccaccgaccaggacagcggcatctacggcaccgtggcctacgagctgatccccggcaacgtgagcagcctgttcaccatcgacagcaccaccggcatcatctacctgaccctgcccctgagccacctggagagcaccaccctgagcctgatggtgagcgcccaggacggcggcggcctgaccgccgtgatcaacgccgacgtgaccatccacatcttccagaccaccctggcccccgccgagttcgagagacccaagtacaccttcctggtgtacgaggacgtgcccgaggacagccccatcggcaccgtgaaggccagagagcccctgaacagcagcgagcccatcttctacagaatcagcagcggcgacctgggcggcaagttcagcatccaccccagactgggcaccatcagaaccagaaagcccctggaccacgagacccagcccgtggtggtgctgaccgtgcaggcccagctgggcagcgcccccgcctgcagcagcaccgaggtgaacatcaccgtgatggacgtgaacgacaaccaccccgccttcctgagaaccagcgacgagatcagaatcagccagaccaccccccccggcaccgccctgtacctggccagagccgaggacagagacagcggcagaaacggcctgatcagatacagcatcgccagcccccagcccggcgtgttcgccatcgacagagccctgggcgtgctgttcctgaacggcagcctgggcgccggcgagcagagagagctgaccctgaccctgagagccgaggaccagggcgtgcacccccaggccgccctgctggtgctgaccgtggtgatcgagaagagagagcacagccccagctggaccttcgagcacctggtgtaccaggtggaggtgagcgagagcctgagccccatgacccagatgctgcagacccaggcccaccccctgggcccccagagagccgccagccccctgagatacagcctggagcccagcgtggacagcgccatgttcggcatcagaccctacaccggctggatctacctgagaagacagttcgactacgagagcacccagacctacaacttcagagtgttcgcctggatccccgaggacggcttcctgcagaacgtgagcaccaccgtgatcgtgagagtgtgggacgagaacgacaacagccccaccttcctgcacgacgtgctgttcctgaaggtggaggagagccccgtgccccagggcgtgatcggcaagatcaccgccatcgacatggacagcggcaagaacggccagctgctgtacttcctgctgagcgacggcaagttcttcaagatgaaccccaacaccggcgagctgatcaactgggtggccctggacagagagcacagaggccaccacgagatgaccgtgctggtgaccgacagaggcagcccccccagaaacgccaccatggccgtgtacgtgagcgtgaccgacatcaacgacaacagacccttcttcccccagtgcctgcccggcaaggagctgcacgtgaaggtgctggagggccagcccgtgaacatgctggtgaccaccgtgttcgccaaggaccccgacgagggcaacaacgccgaggtgacctacagcgtgagcagcgccagacccatgcccctgaagggcaagaccgccttcggcaagcagagctgcaagaagcagaccaacaagcagaccaagagctag

SEQ ID NO: 78453 - DNA, 462 bp, Artificial Sequence
  Description of Artificial Sequence: Synthetic coding sequence
atgctggagaagctgatgggcgccgacagcctgcagctgttcagaagcagatacaccctgggcaagatctacttcatcggcttccagagaagcatcctgctgagcaagagcgagaacagcctgaacagcatcgccaaggagaccgaggagggcagagagaccgtgaccagaaaggagggctggaagagaagacacgaggacggctacctggagatggcccagagacacctgcagagaagcctgtgcccctgggtgagctacctgccccagccctacgccgagctggaggaggtgagcagccacgtgggcaaggtgttcatggccagaaactacgagttcctggcctacgaggccagcaaggacagaagacagcccctggagagaatgtggacctgcaactacaaccagcagaaggaccagagctgcaaccacaaggagatcaccagcaccaaggccgagtag

SEQ ID NO: 78454 - DNA, 249 bp, Artificial Sequence
  Description of Artificial Sequence: Synthetic coding sequence
atggcccagagacacctgcagagaagcctgtgcccctgggtgagctacctgccccagccctacgccgagctggaggaggtgagcagccacgtgggcaaggtgttcatggccagaaactacgagttcctggcctacgaggccagcaaggacagaagacagcccctggagagaatgtggacctgcaactacaaccagcagaaggaccagagctgcaaccacaaggagatcaccagcaccaaggccgagtag

SEQ ID NO: 78455 - DNA, 378 bp, Artificial Sequence
  Description of Artificial Sequence: Synthetic coding sequence
atgagaaccgccatctggaagtggcacagaggcatctacagagaccactacgtgctgggcagcctgaccttcctgagccccatgcagagagccggcaccagcaaccagtggaacatgggcaaggtgatgaccctggacagcggcgacgaggtgaccttccacaagacctggcccaccgagaccggcagcccctacagactggaggaggtgagcagccacgtgggcaaggtgttcatggccagaaactacgagttcctggcctacgaggccagcaaggacagaagacagcccctggagagaatgtggacctgcaactacaaccagcagaaggaccagagctgcaaccacaaggagatcaccagcaccaaggccgagtag

SEQ ID NO: 78456 - DNA, 1725 bp, Artificial Sequence
  Description of Artificial Sequence: Synthetic coding sequence
atggagctgaaggccgaggaggaggaggtgggcggcgtgcagcccgtgagcatccaggccttcgccagcagcagcaccctgcacggcctggcccacatcttcagctacgagagactgagcctgaagagagccctgtgggccctgtgcttcctgggcagcctggccgtgctgctgtgcgtgtgcaccgagagagtgcagtactacttccactaccaccacgtgaccaagctggacgaggtggccgccagccagctgaccttccccgccgtgaccctgtgcaacctgaacgagttcagattcagccaggtgagcaagaacgacctgtaccacgccggcgagctgctggccctgctgaacaacagatacgagatccccgacacccagatggccgacgagaagcagctggagatcctgcaggacaaggccaacttcagaagcttcaagcccaagcccttcaacatgagagagttctacgacagagccggccacgacatcagagacatgctgctgagctgccacttcagaggcgaggtgtgcagcgccgaggacttcaaggtggtgttcaccagatacggcaagtgctacaccttcaacagcggcagagacggcagacccagactgaagaccatgaagggcggcaccggcaacggcctggagatcatgctggacatccagcaggacgagtacctgcccgtgtggggcgagaccgacgagaccagcttcgaggccggcatcaaggtgcagatccacagccaggacgagccccccttcatcgaccagctgggcttcggcgtggcccccggcttccagaccttcgtggcctgccaggagcagagactgatctacctgccccccccctggggcacctgcaaggccgtgaccatggacagcgacctggacttcttcgacagctacagcatcaccgcctgcagaatcgactgcgagaccagatacctggtggagaactgcaactgcagaatggtgcacatgcccggcgacgccccctactgcacccccgagcagtacaaggagtgcgccgaccccgccctggacttcctggtggagaaggaccaggagtactgcgtgtgcgagatgccctgcaacctgaccagatacggcaaggagctgagcatggtgaagatccccagcaaggccagcgccaagtacctggccaagaagttcaacaagagcgagcagtacatcggcgagaacatcctggtgctggacatcttcttcgaggtgctgaactacgagaccatcgagcagaagaaggcctacgagatcgccggcctgctgggcgagctgctgatgacccccgtgcccttcagctgccacggccacggcgtggccccctaccaccccaaggccggctgcagcctgctgagccacgagggcccccccccccagagacccttccccaagccctgctgcctgggcgacatcggcggccagatgggcctgttcatcggcgccagcatcctgaccgtgctggagctgttcgactacgcctacgaggtgatcaagcacaagctgtgcagaagaggcaagtgccagaaggaggccaagagaagcagcgccgacaagggcgtggccctgagcctggacgacgtgaagagacacaacccctgcgagagcctgagaggccaccccgccggcatgacctacgccgccaacatcctgccccaccaccccgccagaggcaccttcgaggacttcacctgctag

SEQ ID NO: 78457 - DNA, 594 bp, Artificial Sequence
  Description of Artificial Sequence: Synthetic coding sequence
atgagagtggtggtgatcggcgccggcgtgatcggcctgagcaccgccctgtgcatccacgagagataccacagcgtgctgcagcccctggacatcaaggtgtacgccgacagattcacccccctgaccaccaccgacgtggccgccggcctgtggcagccctacctgagcgaccccaacaacccccaggaggccgactggagccagcagaccttcgactacctgctgagccacgtgcacagccccaacgccgagaacctgggcctgttcctgatcagcggctacaacctgttccacgaggccatccccgaccccagctggaaggacaccgtgctgggcttcagaaagctgacccccagagagctggacatgttccccgactacggctacggctggttccacaccagcctgatcctggagggcaagaactacctgcagtggctgaccgagagactgaccgagagaggcgtgaagttcttccagagaaaggtggagagcttcgaggaggtggccagagagggcgccgacgtgatcgtgaactgcaccggcgtgtgggccggcgccctgcagagagaccccctgctgcagccctag

SEQ ID NO: 78458 - DNA, 2400 bp, Artificial Sequence
  Description of Artificial Sequence: Synthetic coding sequence
atgaagcccagccccgccggcaccgccaaggagctggagccccccgcccccgccagaggcgagcagagaaccgccgagcccgagggcagatggagagagaagggcgaggccgacaccgagagacagagaaccagagagagacaggaggccaccctggccggcctggccgagctggagtacctgagacagagacaggagctgctggtgagaggcgccctgagaggcgccggcggcgccggcgccgccgcccccagagccggcgagctgctgggcgaggccgcccagagaagcagactggaggagaagttcctggaggagaacatcctgctgctgagaaagcagctgaactgcctgagaagaagagacgccggcctgctgaaccagctgcaggagctggacaagcagatcagcgacctgagactggacgtggagaagaccagcgaggagcacctggagaccgacagcagacccagcagcggcttctacgagctgagcgacggcgccagcggcagcctgagcaacagcagcaacagcgtgttcagcgagtgcctgagcagctgccacagcagcacctgcttctgcagccccctggaggccaccctgagcctgagcgacggctgccccaagagcgccgacgtgaaccccaagtaccagtgcgacctggtgagcaagaacggcaacgacgtgtacagataccccagccccctgcacgccgtggccgtgcagagccccatgttcctgctgtgcctgaccggcaaccccctgagagaggaggacagactgggcaaccacgccagcgacatctgcggcggcagcgagctggacgccgtgaagaccgacagcagcctgcccagccccagcagcctgtggagcgccagccaccccagcagcagcaagaagatggacggctacatcctgagcctggtgcagaagaagacccaccccgtgagaaccaacaagcccagaaccagcgtgaacgccgaccccaccaagggcctgctgagaaacggcagcgtgtgcgtgagagcccccggcggcgtgagccagggcaacagcgtgaacctgaagaacagcaagcaggcctgcctgcccagcggcggcatccccagcctgaacaacggcaccttcagcccccccaagcagtggagcaaggagagcaaggccgagcaggccgagagcaagagagtgcccctgcccgagggctgccccagcggcgccgccagcgacctgcagagcaagcacctgcccaagaccgccaagcccgccagccaggagcacgccagatgcagcgccatcggcaccggcgagagccccaaggagagcgcccagctgagcggcgccagccccaaggagagccccagcagaggccccgcccccccccaggagaacaaggtggtgcagcccctgaagaagatgagccagaagaacagcctgcagggcgtgccccccgccaccccccccctgctgagcaccgccttccccgtggaggagagacccgccctggacttcaagagcgagggcagcagccagagcctggaggaggcccacctggtgaaggcccagttcatccccggccagcagcccagcgtgagactgcacagaggccacagaaacatgggcgtggtgaagaacagcagcctgaagcacagaggccccgccctgcagggcctggagaacggcctgcccaccgtgagagagaagaccagagccggcagcaagaagtgcagattccccgacgacctggacaccaacaagaagctgaagaaggccagcagcaagggcagaaagagcggcggcggccccgaggccggcgtgcccggcagacccgccggcggcggccacagagccggcagcagagcccacggccacggcagagaggccgtggtggccaagcccaagcacaagagaaccgactacagaagatggaagagcagcgccgagatcagctacgaggaggccctgagaagagccagaagaggcagaagagagaacgtgggcctgtaccccgcccccgtgcccctgccctacgccagcccctacgcctacgtggccagcgacagcgagtacagcgccgagtgcgagagcctgttccacagcaccgtggtggacaccagcgaggacgagcagagcaactacaccaccaactgcttcggcgacagcgagagcagcgtgagcgagggcgagttcgtgggcgagagcaccaccaccagcgacagcgaggagagcggcggcctgatctggagccagttcgtgcagaccctgcccatccagaccgtgaccgcccccgacctgcacaaccaccccgccaagaccttcgtgaagatcaaggccagccacaacctgaagaagaagatcctgagattcagaagcggcagcctgaagctgatgaccaccgtgtag

SEQ ID NO: 78459 - DNA, 2511 bp, Artificial Sequence
  Description of Artificial Sequence: Synthetic coding sequence
atgaagcccagccccgccggcaccgccaaggagctggagccccccgcccccgccagaggcgagcagagaaccgccgagcccgagggcagatggagagagaagggcgaggccgacaccgagagacagagaaccagagagagacaggaggccaccctggccggcctggccgagctggagtacctgagacagagacaggagctgctggtgagaggcgccctgagaggcgccggcggcgccggcgccgccgcccccagagccggcgagctgctgggcgaggccgcccagagaagcagactggaggagaagttcctggaggagaacatcctgctgctgagaaagcagctgaactgcctgagaagaagagacgccggcctgctgaaccagctgcaggagctggacaagcagatcagcgacctgagactggacgtggagaagaccagcgaggagcacctggagaccgacagcagacccagcagcggcttctacgagctgagcgacggcgccagcggcagcctgagcaacagcagcaacagcgtgttcagcgagtgcctgagcagctgccacagcagcacctgcttctgcagccccctggaggccaccctgagcctgagcgacggctgccccaagagcgccgacctgatcggcctgctggagtacaaggagggccactgcgaggaccaggccagcggcgccgtgtgcagaagcctgagcaccccccagttcaacagcctggacgtgatcgccgacgtgaaccccaagtaccagtgcgacctggtgagcaagaacggcaacgacgtgtacagataccccagccccctgcacgccgtggccgtgcagagccccatgttcctgctgtgcctgaccggcaaccccctgagagaggaggacagactgggcaaccacgccagcgacatctgcggcggcagcgagctggacgccgtgaagaccgacagcagcctgcccagccccagcagcctgtggagcgccagccaccccagcagcagcaagaagatggacggctacatcctgagcctggtgcagaagaagacccaccccgtgagaaccaacaagcccagaaccagcgtgaacgccgaccccaccaagggcctgctgagaaacggcagcgtgtgcgtgagagcccccggcggcgtgagccagggcaacagcgtgaacctgaagaacagcaagcaggcctgcctgcccagcggcggcatccccagcctgaacaacggcaccttcagcccccccaagcagtggagcaaggagagcaaggccgagcaggccgagagcaagagagtgcccctgcccgagggctgccccagcggcgccgccagcgacctgcagagcaagcacctgcccaagaccgccaagcccgccagccaggagcacgccagatgcagcgccatcggcaccggcgagagccccaaggagagcgcccagctgagcggcgccagccccaaggagagccccagcagaggccccgcccccccccaggagaacaaggtggtgcagcccctgaagaagatgagccagaagaacagcctgcagggcgtgccccccgccaccccccccctgctgagcaccgccttccccgtggaggagagacccgccctggacttcaagagcgagggcagcagccagagcctggaggaggcccacctggtgaaggcccagttcatccccggccagcagcccagcgtgagactgcacagaggccacagaaacatgggcgtggtgaagaacagcagcctgaagcacagaggccccgccctgcagggcctggagaacggcctgcccaccgtgagagagaagaccagagccggcagcaagaagtgcagattccccgacgacctggacaccaacaagaagctgaagaaggccagcagcaagggcagaaagagcggcggcggccccgaggccggcgtgcccggcagacccgccggcggcggccacagagccggcagcagagcccacggccacggcagagaggccgtggtggccaagcccaagcacaagagaaccgactacagaagatggaagagcagcgccgagatcagctacgaggaggccctgagaagagccagaagaggcagaagagagaacgtgggcctgtaccccgcccccgtgcccctgccctacgccagcccctacgcctacgtggccagcgacagcgagtacagcgccgagtgcgagagcctgttccacagcaccgtggtggacaccagcgaggacgagcagagcaactacaccaccaactgcttcggcgacagcgagagcagcgtgagcgagggcgagttcgtgggcgagagcaccaccaccagcgacagcgaggagagcggcggcctgatctggagccagttcgtgcagaccctgcccatccagaccgtgaccgcccccgacctgcacaaccaccccgccaagaccttcgtgaagatcaaggccagccacaacctgaagaagaagatcctgagattcagaagcggcagcctgaagctgatgaccaccgtgtag

SEQ ID NO: 78460 - DNA, 2325 bp, Artificial Sequence
  Description of Artificial Sequence: Synthetic coding sequence
atgtggacccccggcggcccccccggcagcgccggctgggacagaagaagactgggcgccagactgagagccgccttcgccggcctgcaggagctgcagggcctgagagccacccagcaggagagagtgagaggcgccctggccctgcagcccccccccgcccccgccgccccctgcggcccccacggcctgcacggccccgagcagcagctggaggccgccctggccgccctgcaggagcagctgagcagactgagacagcaggacatcggcctgaagacccacctggaccagctggacctgcagatcagcaagctgcagctggacgtgggcaccgccagcggcgaggccctggacagcgacagcagacccagcagcggcttctacgagatgagcgacggcggcagctgcagcctgagcaccagctgcgccagcgtgtgcagcgaccacatcagccccagcctgggcagcctgctgcccgtggcccaggcccacaaggccagacccagcatgggcgactggagacccagaagcgtggacgagaccaccgtgcccgcctggagaccccaggccaccgaggagggcgccagaccccccggcagcgtggaggacgccggccagccctggggcaccttctggcccagacccgtgagcaccggcgacctggacagagccctgcccgccgacaccggcctgcagaaggccagcgccgacgccgagctgctgggcctgctgtgccagggcgtggacatccccctgcacgtgcccgaccccaagtacagacaggacctggtgagccagggcggcagagaggtgtacccctaccccagccccctgcacgccgtggccctgcagagccccctgttcgtgctgaccaaggagaccccccagagaggcggccccagcttccccagagagagccccagaggccccgccggcctgaacaccatccagaccggccccgtgctggaggccggccccgccagagccagagcctacatcgacagactgctgcacctgtggggcagagagacccccgccaagggcagcgagggcgagcagggccccctgagacacgccgccagccccagcccccagagacagggcggctggagcaccgacggcggcggcagactgctggtgttcgcccccggcagagaggacgagggcggccccgcccagagcagaggcgccggcagaggcggcccccagcagcagggctacatgcccctggagggcccccagcagagcggcagcctgcccgaggagggcagcaagcccagcaacagctgcgtgctgagagagaccatggtgcaggccagccccagcagcaaggcccagcagacccccagcgcccaggactacggcagaggcaacatcatcagccccagcagaatgctggacaagagccccagccccgccagcggccacttcgcccaccccagcttcgccgccagcctgaagatgggcccccccaagagcaaggccgagaagatcaagagaagccccatggacaaggtgctgagattcgccagacagcccctgctgctgctggacagacccgagggcgcccacgccgccccccagcccagcctggagtgggaccccgcccactggcccaccggcagaggcggcctgcagagaagacccgccctggcctgggaggcccccggcagaagctgcagcgagagcaccctgtaccccatgcccgtgctggtgcccctggccgtggccccccaggagagccacagaaccagcgcccaggccctgttccccttcgaggccagcctgctgaccagcgtggccagaagaaagcacagaagatggcagagcaccgtggagatcagcgccagagccagactggccagctgccccgagagcaacctgggcccccccagacccgtggccagaagagccggcggccccctggccagaggcagacccagcctggtgagacaggacgcctacaccagaagcgacagcgagcccagcaagcacagcgccgagtgcgaccccagattccccagcgtgatccccgagaccagcgagggcgagagcagcgaccacaccaccaacagattcggcgacagagagagcagcagcagcgacgaggagggcggcgcccagagcagagactgcgacctggccctgggctacgtggccgccggccacgccgagctggcctggacccaggaggcccccgtgagcagcggccccctgctgagccccgtgcccaagctgtgcagaatcaaggccagcaaggccctgaagaagaagatcagaagattccagcccaccgccctgaaggtgatgaccatggtgtag

SEQ ID NO: 78461 - DNA, 843 bp, Artificial Sequence
  Description of Artificial Sequence: Synthetic coding sequence
atgtggacccccggcggcccccccggcagcgccggctgggacagaagaagactgggcgccagactgagagccgccttcgccggcctgcaggagctgcagggcctgagagccacccagcaggagagagtgagaggcgccctggccctgcagcccccccccgcccccgccgccccctgcggcccccacggcctgcacggccccgagcagcagctggaggccgccctggccgccctgcaggagcagctgagcagactgagacagcaggacatcggcctgaagacccacctggaccagctggacctgcagatcagcaagctgcagctggacgtgggcaccgccagcggcgaggccctggacagcgacagcagacccagcagcggcttctacgagatgagcgacggcggcagctgcagcctgagcaccagctgcgccagcgtgtgcagcgaccacatcagccccagcctgggcagcctgctgcccgtggcccaggcccacaaggccagacccagcatgggcgactggagacccagaagcgtggacgagaccaccgtgcccgcctggagaccccaggccaccgaggagggcgccagaccccccggcagcgtggaggacgccggccagccctggggcaccttctggcccagacccgtgagcaccgagctgtgcaacgcccccggcgagctggacatgcacgccccccccgccggctgcaccagcagcagcctgaccggcgtgggcagcggcctgagaggcaagtgcggcctgtgcggctgccagctgcccttctgcagcgtgaacaccagcagcaagaccaagagcagcggcatcagcagacagcagtag

SEQ ID NO: 78462 - DNA, 1890 bp, Artificial Sequence
  Description of Artificial Sequence: Synthetic coding sequence
atgatcagagccttcagcttccccgtgagccccgagagaggcagactgagaggctggctggagggcagcctggccggcctgtgcgagctgcactggctgagagagagacaggagtacagagtgcagcaggccctgagactggcccagcccggcatgggcggcgccgaggccgaggacgaggaggacgccgacgaggacgaggacgccgccgccgccagaagagccgccgccgccctggaggagcagctggaggccctgcccggcctggtgtgggacctgggccagcagctgggcgacctgagcctggagagcggcggcctggagcaggagagcggcagaagcagcggcttctacgaggaccccagcagcaccggcggccccgacagcccccccagcaccttctgcggcgacagcggcttcagcggcagcagcagctacggcagactgggccccagcgagcccagaggcatctacgccagcgagagacccaagagcctgggcgacgccagccccagcgcccccgaggtggtgggcgccagagccgccgtgcccagaagcttcagcgccccctaccccaccgccggcggcagcgccggccccgaggcctgcagcagcgccgagagaagagccagagccggccccttcctgacccccagccccctgcacgccgtggccatgagaagccccagaccctgcggcagaccccccaccgacagccccgacgccggcggcgccggcagacccctggacggctacatcagcgccctgctgagaagaagaagaagaagaggcgccggccagcccagaaccagccccggcggcgccgacggcggccccagaagacagaacagcgtgagacagagaccccccgacgccagccccagccccggcagcgccagacccgccagagagcccagcctggagagagtgggcggccaccccaccagccccgccgccctgagcagagcctgggccagcagctgggagagcgaggccgcccccgagcccgccgccccccccgccgcccccagcccccccgacagccccgccgagggcagactggtgaaggcccagtacatccccggcgcccaggccgccaccagaggcctgcccggcagagccgccagaagaaagcccccccccctgaccagaggcagaagcgtggagcagagcccccccagagagagacccagagccgccggcagaagaggcagaatggccgaggccagcggcagaagaggcagccccagagccagaaaggccagcagaagccagagcgagaccagcctgctgggcagagccagcgccgtgcccagcggcccccccaagtaccccaccgccgagagagaggagcccagaccccccagacccagaagaggccccgcccccaccctggccgcccaggccgccggcagctgcagaagatggagaagcaccgccgagatcgacgccgccgacggcagaagagtgagacccagagcccccgccgccagagtgcccggccccggccccagccccagcgccccccagagaagactgctgtacggctgcgccggcagcgacagcgagtgcagcgccggcagactgggccccctgggcagaagaggccccgccggcggcgtgggcggcggctacggcgagagcgagagcagcgccagcgagggcgagagccccgccttcagcagcgccagcagcgacagcgacggcagcggcggcctggtgtggccccagcagctggtggccgccaccgccgccagcggcggcggcgccggcgccggcgcccccgccggccccgccaaggtgttcgtgaagatcaaggccagccacgccctgaagaagaagatcctgagattcagaagcggcagcctgaaggtgatgaccaccgtgtag

SEQ ID NO: 78463 - DNA, 2025 bp, Artificial Sequence
  Description of Artificial Sequence: Synthetic coding sequence
atgaacagcggcgccatgagaatccacagcaagggccacttccagggcggcatccaggtgaagaacgagaagaacagacccagcctgaagagcctgaagaccgacaacagacccgagaagagcaagtgcaagcccctgtggggcaaggtgttctacctggacctgcccagcgtgaccatcagcgagaagctgcagaaggacatcaaggacctgggcggcagagtggaggagttcctgagcaaggacatcagctacctgatcagcaacaagaaggaggccaagttcgcccagaccctgggcagaatcagccccgtgcccagccccgagagcgcctacaccgccgagaccaccagcccccaccccagccacgacggcagcagcttcaagagccccgacaccgtgtgcctgagcagaggcaagctgctggtggagaaggccatcaaggaccacgacttcatccccagcaacagcatcctgagcaacgccctgagctggggcgtgaagatcctgcacatcgacgacatcagatactacatcgagcagaagaagaaggagctgtacctgctgaagaagagcagcaccagcgtgagagacggcggcaagagagtgggcagcggcgcccagaagaccagaaccggcagactgaagaagcccttcgtgaaggtggaggacatgagccagctgtacagacccttctacctgcagctgaccaacatgcccttcatcaactacagcatccagaagccctgcagccccttcgacgtggacaagcccagcagcatgcagaagcagacccaggtgaagctgagaatccagaccgacggcgacaagtacggcggcaccagcatccagctgcagctgaaggagaagaagaagaagggctactgcgagtgctgcctgcagaagtacgaggacctggagacccacctgctgagcgagcagcacagaaacttcgcccagagcaaccagtaccaggtggtggacgacatcgtgagcaagctggtgttcgacttcgtggagtacgagaaggacacccccaagaagaagagaatcaagtacagcgtgggcagcctgagccccgtgagcgccagcgtgctgaagaagaccgagcagaaggagaaggtggagctgcagcacatcagccagaaggactgccaggaggacgacaccaccgtgaaggagcagaacttcctgtacaaggagacccaggagaccgagaagaagctgctgttcatcagcgagcccatcccccaccccagcaacgagctgagaggcctgaacgagaagatgagcaacaagtgcagcatgctgagcaccgccgaggacgacatcagacagaacttcacccagctgcccctgcacaagaacaagcaggagtgcatcctggacatcagcgagcacaccctgagcgagaacgacctggaggagctgagagtggaccactacaagtgcaacatccaggccagcgtgcacgtgagcgacttcagcaccgacaacagcggcagccagcccaagcagaagagcgacaccgtgctgttccccgccaaggacctgaaggagaaggacctgcacagcatcttcacccacgacagcggcctgatcaccatcaacagcagccaggagcacctgaccgtgcaggccaaggcccccttccacaccccccccgaggagcccaacgagtgcgacttcaagaacatggacagcctgcccagcggcaagatccacagaaaggtgaagatcatcctgggcagaaacagaaaggagaacctggagcccaacgccgagttcgacaagagaaccgagttcatcacccaggaggagaacagaatctgcagcagccccgtgcagagcctgctggacctgttccagaccagcgaggagaagagcgagttcctgggcttcaccagctacaccgagaagagcggcatctgcaacgtgctggacatctgggaggaggagaacagcgacaacctgctgaccgccttcttcagcagccccagcaccagcaccttcaccggcttctag

SEQ ID NO: 78464 - DNA, 654 bp, Artificial Sequence
  Description of Artificial Sequence: Synthetic coding sequence
atgaacagcggcgccatgagaatccacagcaagggccacttccagggcggcatccaggtgaagaacgagaagaacagacccagcctgaagagcctgaagaccgacaacagacccgagaagagcaagtgcaagcccctgtggggcaaggtgttctacctggacctgcccagcgtgaccatcagcgagaagctgcagaaggacatcaaggacctgggcggcagagtggaggagttcctgagcaaggacatcagctacctgatcagcaacaagaaggaggccaagttcgcccagaccctgggcagaatcagccccgtgcccagccccgagagcgcctacaccgccgagaccaccagcccccaccccagccacgacggcagcagcttcaagagccccgacaccgtgtgcctgagcagaggcaagctgctggtggagaaggccatcaaggaccacgacttcatccccagcaacagcatcctgagcaacgccctgagctggggcgtgaagatcctgcacatcgacgacatcagatactacatcgagcagaagaagaaggagctgtacctgctgaagaagagcagcaccagcgtgagagacggcggcaagagagtgggcagcggcgcccagaagaccagaaaggccctgcagagcatctag

SEQ ID NO: 78465 - DNA, 1848 bp, Artificial Sequence
  Description of Artificial Sequence: Synthetic coding sequence
atgagcgagcccggcaagggcgacgactgcctggagctggagagcagcatggccgagagcagactgagagcccccgacctgggcgtgagcagatgcctgggcaagtgccagaagaacagccccggcgccagaaagcaccccttcagcggcaagagcttctacctggacctgcccgccggcaagaacctgcagttcctgaccggcgccatccagcagctgggcggcgtgatcgagggcttcctgagcaaggaggtgagctacatcgtgagcagcagaagagaggtgaaggccgagagcagcggcaagagccacagaggctgccccagccccagccccagcgaggtgagagtggagaccagcgccatggtggaccccaagggcagccaccccagacccagcagaaagcccgtggacagcgtgcccctgagcagaggcaaggagctgctgcagaaggccatcagaaaccagggcagcatcagcggcggcggcagcggcggcagcagcagcctgctgaccaacgccagaagctggggcgtgagaatcctgcacgtggacgagatgatgatgcacgtgcagcagctgagcctggccagcctgtgcgtgaagaagcagcagcccaagaagcccgagggcacctgccccgccgccgagagcagaaccagaaaggtggccagactgaaggcccccttcctgaagatcgaggacgagagcagaaagttcagacccttccaccaccagttcaagagcttccccgagatcagcttcctgggccccaaggacgccagccccttcgaggcccccaccaccctgggcagcatgcaccacaccagagagagcaaggacggcgagcccagccccagaagcgccgcccacaccatgcccagaagaaagaagggctactgcgagtgctgccaggaggccttcgaggagctgcacgtgcacctgcagagcgcccagcacagaagcttcgccctggaggcccacctgtacgccgaggtggacagaatcatcgcccagctgagccacagcttcgccgacatccccttccaggccggcctgcccagatggagcggcagccccgccagcgactgcgaccccctgtgccccgagaccctgcacccccaccagcccagccaccccagagccgccagccccagaatcagaaaggaggacagctgccaggccagcgtgacccagggcagagccgccggccagcagagatggaccgagagcctggacggcgtgatgggcccccccgccagccacacctgcgtgagcgccaccaccctgctgcccgccctgcccaagggcagcagagagcagggctgcctgtgcccctgccccgccagcttcacccagagccacctggtgaccagcctggccctgctgcccggcgagtggagccccgccgaggacatgcccctgcaccccagccaggagaacagcttcgcccccgccgacatccccgtgaagggccccctgctgttccccgaggccagaccctggctgatgagcgccagatgctgggtgagacccttccccttcgtgacctggggctgcctgatcccccacgacaccacccccctgcacgaggaggtgagcccctgcccctgcctgagactgggctacctgtacctgctgctgacccagagcctgtggtgcagagtgagagtgcccagcctgagcaccgccggccccatccccagaaccagccacccctgcaccctggccttccccagctacctgaacgaccacgacctgggccacctgtgccaggccaagccccagggctggaacaccccccagcccttcctgcactgcggcttcctggccgtggacagcggctag

SEQ ID NO: 78466 - DNA, 1296 bp, Artificial Sequence
  Description of Artificial Sequence: Synthetic coding sequence
atgagcgagcccggcaagggcgacgactgcctggagctggagagcagcatggccgagagcagactgagagcccccgacctgggcgtgagcagatgcctgggcaagtgccagaagaacagccccggcgccagaaagcaccccttcagcggcaagagcttctacctggacctgcccgccggcaagaacctgcagttcctgaccggcgccatccagcagctgggcggcgtgatcgagggcttcctgagcaaggaggtgagctacatcgtgagcagcagaagagaggtgaaggccgagagcagcggcaagagccacagaggctgccccagccccagccccagcgaggtgagagtggagaccagcgccatggtggaccccaagggcagccaccccagacccagcagaaagcccgtggacagcgtgcccctgagcagaggcaaggagctgctgcagaaggccatcagaaaccagggcagcatcagcggcggcggcagcggcggcagcagcagcctgctgaccaacgccagaagctggggcgtgagaatcctgcacgtggacgagatgatgatgcacgtgcagcagctgagcctggccagcctgtgcgtgaagaagcagcagcccaagaagcccgagggcacctgccccgccgccgagagcagaaccagaaaggtggccagactgaaggcccccttcctgaagatcgaggacgagagcagaaagttcagacccttccaccaccagttcaagagcttccccgagatcagcttcctgggccccaaggacgccagccccttcgaggcccccaccaccctgggcagcatgcaccacaccagagagagcaaggacggcgagcccagccccagaagcgccgcccacaccatgcccagaagaaagaagggctactgcgagtgctgccaggaggccttcgaggagctgcacgtgcacctgcagagcgcccagcacagaagcttcgccctggaggcccacctgtacgccgaggtggacagaatcatcgcccagctgagccacagcttcgccgacatccccttccaggccggcctgcccagatggagcggcagccccgccagcgactgcgaccccctgtgccccgagaccctgcacccccaccagcccagccaccccagagccgccagccccagaatcagaaaggaggacagctgccaggccagcgtgacccagggcagagccgccggccagcagagatggaccgagagcctggacggcgtgatgggcccccccgccagccacacctgccacagaccctgcagactgccctag

SEQ ID NO: 78467 - DNA, 474 bp, Artificial Sequence
  Description of Artificial Sequence: Synthetic coding sequence
atgagcgagcccggcaagggcgacgactgcctggagctggagagcagcatggccgagagcagactgagagcccccgacctgggcgtgagcagatgcctgggcaagtgccagaagaacagccccggcgccagaaagcaccccttcagcggcaagagcttctacctggacctgcccgccggcaagaacctgcagttcctgaccggcgccatccagcagctgggcggcgtgatcgagggcttcctgagcaaggaggtgagctacatcgtgagcagcagaagagaggtgaaggccgagagcagcggcaagagccacagaggctgccccagccccagccccagcgaggtgagagtggagaccagcgccatggtggaccccaagggcagccaccccagacccagcagaaagcccgtggacagcgtgcccctgagcagaggcaaggagctgctgcagaaggccatcagaaaccagaagtag

SEQ ID NO: 78468 - DNA, 570 bp, Artificial Sequence
  Description of Artificial Sequence: Synthetic coding sequence
atggtgggcggcggccagccctgcggccccaacatgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctgcagcgacgacgtgctgccctggagaagaaccgccgagaacaagctggacaccaagtacccctacgtgtgccacgccgagctgaacgccatcatgaacaagaacagcaccgacgtgaagggctgcagcatgtacgtggccctgttcccctgcaacgagtgcgccaagctgatcatccaggccggcatcaaggaggtgatcttcatgagcgacaagtaccacgacagcgacgaggccaccgccgccagactgctgttcaacatggccggcgtgaccttcagaaagttcatccccaagtgcagcaagatcgtgatcgacttcgacagcatcaacagcagacccagccagaagctgcagtag

SEQ ID NO: 78469 - DNA, 537 bp, Artificial Sequence
  Description of Artificial Sequence: Synthetic coding sequence
atgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctgcagcgacgacgtgctgccctggagaagaaccgccgagaacaagctggacaccaagtacccctacgtgtgccacgccgagctgaacgccatcatgaacaagaacagcaccgacgtgaagggctgcagcatgtacgtggccctgttcccctgcaacgagtgcgccaagctgatcatccaggccggcatcaaggaggtgatcttcatgagcgacaagtaccacgacagcgacgaggccaccgccgccagactgctgttcaacatggccggcgtgaccttcagaaagttcatccccaagtgcagcaagatcgtgatcgacttcgacagcatcaacagcagacccagccagaagctgcagtag

SEQ ID NO: 78470 - DNA, 510 bp, Artificial Sequence
  Description of Artificial Sequence: Synthetic coding sequence
atgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctgcagcgacgacgtgctgccctggagaagaaccgccgagaacaagctggacaccaagtacccctacgtgtgccacgccgagctgaacgccatcatgaacaagaacagcaccgacgtgaagggctgcagcatgtacgtggccctgttcccctgcaacgagtgcgccaagctgatcatccaggccggcatcaaggaggtgatcttcatgagcgacaagtaccacgacagcgacgaggccaccgccgccagactgctgttcaacatggccggcgtgaccttcagaaagttcatccccaagtgcagcaagatcgtgatcgacttcgacagcatctag

SEQ ID NO: 78471 - DNA, 222 bp, Artificial Sequence
  Description of Artificial Sequence: Synthetic coding sequence
atgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctgcagcgacgacgtgctgccctggagaagaaccgccgagaactag

SEQ ID NO: 78472 - DNA, 180 bp, Artificial Sequence
  Description of Artificial Sequence: Synthetic coding sequence
atgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctag

SEQ ID NO: 78473 - DNA, 72 bp, Artificial Sequence
  Description of Artificial Sequence: Synthetic coding sequence
atgagcgaggtgagctgcaagaagagagacgactacctggagtggcccgagtacttcatggccgtggcctag

SEQ ID NO: 78474 - DNA, 363 bp, Artificial Sequence
  Description of Artificial Sequence: Synthetic coding sequence
atgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctgcagcgacgacgtgctgccctggagaagaaccgccgagaacaagctggacaccaagtacccctacgtgtgccacgccgagctgaacgccatcatgaacaagaacagcaccgacgtgaagggctgcagcatgtacgtggccctgttcccctgcaacgagtgcgccaagctgatcatccaggcctag

SEQ ID NO: 78475 - DNA, 537 bp, Artificial Sequence; identical to SEQ ID NO: 78469
  Description of Artificial Sequence: Synthetic coding sequence

SEQ ID NO: 78476 - DNA, 360 bp, Artificial Sequence
  Description of Artificial Sequence: Synthetic coding sequence
atgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctgcagcgacgacgtgctgccctggagaagaaccgccgagaacaagctggacaccaagtacccctacgtgtgccacgccgagctgaacgccatcatgaacaagaacagcaccgacgtgaagggctgcagcatgtacgtggccctgttcccctgcaacgagtgcgccaagctgatcatccagtag

SEQ ID NO: 78477 - DNA, 297 bp, Artificial Sequence
  Description of Artificial Sequence: Synthetic coding sequence
atgagcgaggtgagctgcaagaagagagacgactacctggagtggcccgagtacttcatggccgtggccttcctgagcgcccagagaagcaaggaccccaacagccaggtgggcgcctgcatcgtgaacagcgagaacaagatcgtgggcatcggctacaacggcatgcccaacggctgcagcgacgacgtgctgccctggagaagaaccgccgagaacaagctggacaccaagtacccctacgtgtgccacgccgagctgaacgccatcatgaacaagaacagcaccgacgtgtag

SEQ ID NO: 78478 - DNA, 780 bp, Artificial Sequence
  Description of Artificial Sequence: Synthetic coding sequence
atgaacaagctgaagagcagccagaaggacaaggtgagacagttcatgatcttcacccagagcagcgagaagaccgccgtgagctgcctgagccagaacgactggaagctggacgtggccaccgacaacttcttccagaaccccgagctgtacatcagagagagcgtgaagggcagcctggacagaaagaagctggagcagctgtacaacagatacaaggacccccaggacgagaacaagatcggcatcgacggcatccagcagttctgcgacgacctggccctggaccccgccagcatcagcgtgctgatcatcgcctggaagttcagagccgccacccagtgcgagttcagcaagcaggagttcatggacggcatgaccgagctgggctgcgacagcatcgagaagctgaaggcccagatccccaagatggagcaggagctgaaggagcccggcagattcaaggacttctaccagttcaccttcaacttcgccaagaaccccggccagaagggcctggacctggagatggccatcgcctactggaacctggtgctgaacggcagattcaagttcctggacctgtggaacaagttcctgctggagcaccacaagagaagcatccccaaggacacctggaacctgctgctggacttcagcaccatgatcgccgacgacatgagcaactacgacgaggagggcgcctggcccgtgctgatcgacgacttcgtggagttcgccagaccccagatcgccggcaccaagagcaccaccgtgtag

SEQ ID NO: 78479 - DNA, 660 bp, Artificial Sequence
  Description of Artificial Sequence: Synthetic coding sequence
atgaacaagctgaagagcagccagaaggacaaggtgagacagttcatgatcttcacccagagcagcgagaagaccgccgtgagctgcctgagccagaacgactggaagctggacgtggccaccgacaacttcttccagaaccccgagctgtacatcagagagagcgtgaagggcagcctggacagaaagaagctggagcagctgtacaacagatacaaggacccccaggacgagaacaagatcggcatcgacggcatgaccgagctgggctgcgacagcatcgagaagctgaaggcccagatccccaagatggagcaggagctgaaggagcccggcagattcaaggacttctaccagttcaccttcaacttcgccaagaaccccggccagaagggcctggacctggagatggccatcgcctactggaacctggtgctgaacggcagattcaagttcctggacctgtggaacaagttcctgctggagcaccacaagagaagcatccccaaggacacctggaacctgctgctggacttcagcaccatgatcgccgacgacatgagcaactacgacgaggagggcgcctggcccgtgctgatcgacgacttcgtggagttcgccagaccccagatcgccggcaccaagagcaccaccgtgtag

SEQ ID NO: 78480 - DNA, 387 bp, Artificial Sequence
  Description of Artificial Sequence: Synthetic coding sequence
atgatcttcacccagagcagcgagaagaccgccgtgagctgcctgagccagaacgactggaagctggacgtggccaccgacaacttcttccagaaccccgagctgtacatcagagagagcgtgaagggcagcctggacagaaagaagctggagcagctgtacaacagatacaaggacccccaggacgagaacaagatcggcatcgacggcatccagcagttctgcgacgacctggccctggaccccgccagcatcagcgtgctgatcatcgcctggaagttcagagccgccacccagtgcgagttcagcaagcaggagttcatggacggcatgaccgagctgggctgcgacagcatcgagaagctgaaggcccagatccccaagtag

SEQ ID NO: 78481 - DNA, 879 bp, Artificial Sequence
  Description of Artificial Sequence: Synthetic coding sequence
atgcacagcgacgccgccgccgtgaacttccagctgaacagccacctgagcaccctggccaacatccacaagatctaccacaccctgaacaagctgaacctgaccgaggacatcggccaggacgaccaccagaccggcagcctgagaagctgcagcagcagcgactgcttcaacaaggtgatgccccccagaaagaagagaagacccgccagcggcgacgacctgagcgccaagaagagcagacacgacagcatgtacagaaagtacgacagcaccagaatcaagaccgaggaggaggccttcagcagcaagagatgcctggagtggttctacgagtacgccggcaccgacgacgtggtgggccccgagggcatggagaagttctgcgaggacatcggcgtggagcccgagaacgtggtgatgctggtgctggcctggaagctggacgcccagaacatgggctacttcaccctgcaggagtggctgaagggcatgaccagcctgcagtgcgacaccaccgagaagctgagaaacaccctggactacctgagaagcttcctgaacgacagcaccaacttcaagctgatctacagatacgccttcgacttcgccagagagaaggaccagagaagcctggacatcaacaccgccaagtgcatgctgggcctgctgctgggcaagatctggcccctgttccccgtgttccaccagttcctggagcagagcaagtacaaggtgatcaacaaggaccagtggtgcaacgtgctggagttcagcagaaccatcaacctggacctgagcaactacgacgaggacggcgcctggcccgtgctgctggacgagttcgtggagtggtacaaggacaagcagatgagctag

SEQ ID NO: 78482 - DNA, 699 bp, Artificial Sequence
  Description of Artificial Sequence: Synthetic coding sequence
atgccccccagaaagaagagaagacccgccagcggcgacgacctgagcgccaagaagagcagacacgacagcatgtacagaaagtacgacagcaccagaatcaagaccgaggaggaggccttcagcagcaagagatgcctggagtggttctacgagtacgccggcaccgacgacgtggtgggccccgagggcatggagaagttctgcgaggacatcggcgtggagcccgagaacgtggtgatgctggtgctggcctggaagctggacgcccagaacatgggctacttcaccctgcaggagtggctgaagggcatgaccagcctgcagtgcgacaccaccgagaagctgagaaacaccctggactacctgagaagcttcctgaacgacagcaccaacttcaagctgatctacagatacgccttcgacttcgccagagagaaggaccagagaagcctggacatcaacaccgccaagtgcatgctgggcctgctgctgggcaagatctggcccctgttccccgtgttccaccagttcctggagcagagcaagtacaaggtgatcaacaaggaccagtggtgcaacgtgctggagttcagcagaaccatcaacctggacctgagcaactacgacgaggacggcgcctggcccgtgctgctggacgagttcgtggagtggtacaaggacaagcagatgagctag

SEQ ID NO: 78483 - DNA, 774 bp, Artificial Sequence
  Description of Artificial Sequence: Synthetic coding sequence
atgcacagcgacgccgccgccgtgaacttccagctgaacagccacctgagcaccctggccaacatccacaagatctaccacaccctgaacaagctgaacctgaccgaggacatcggccaggacgaccaccagaccggcagcctgagaagctgcagcagcagcgactgcttcaacaaggtgatgccccccagaaagaagagaagacccgccagcggcgacgacctgagcgccaagaagagcagacacgacagcatgtacagaaagtacgacagcaccagaatcaagaccgaggaggaggccttcagcagcaagagatgcctggagtggttctacgagtacgccggcaccgacgacgtggtgggccccgagggcatggagaagttctgcgaggacatcggcgtggagcccgagaacgtggtgatgctggtgctggcctggaagctggacgcccagaacatgggctacttcaccctgcaggagtggctgaagggcatgaccagcctgcagtgcgacaccaccgagaagctgagaaacaccctggactacctgagaagcttcctgaacgacagcaccaacttcaagctgatctacagatacgccttcgacttcgccagacagagcaagtacaaggtgatcaacaaggaccagtggtgcaacgtgctggagttcagcagaaccatcaacctggacctgagcaactacgacgaggacggcgcctggcccgtgctgctggacgagttcgtggagtggtacaaggacaagcagatgagctag

SEQ ID NO: 78484 - DNA, 1011 bp, Artificial Sequence
  Description of Artificial Sequence: Synthetic coding sequence
atggaggtggaggccgccctgggctgcagcggccagggcagaggctgcggcggcgtggcccccgccggcagaggcagagagagagccagcgagagaggcaccagagtgagaatcagcaagggcctgagcggcgccggcggcagcgtgagaaaggccgacttccagctgaacagccacctgagcaccctggccaacatccacaagatctaccacaccctgaacaagctgaacctgaccgaggacatcggccaggacgaccaccagaccggcagcctgagaagctgcagcagcagcgactgcttcaacaaggtgatgccccccagaaagaagagaagacccgccagcggcgacgacctgagcgccaagaagagcagacacgacagcatgtacagaaagtacgacagcaccagaatcaagaccgaggaggaggccttcagcagcaagagatgcctggagtggttctacgagtacgccggcaccgacgacgtggtgggccccgagggcatggagaagttctgcgaggacatcggcgtggagcccgagaacgtggtgatgctggtgctggcctggaagctggacgcccagaacatgggctacttcaccctgcaggagtggctgaagggcatgaccagcctgcagtgcgacaccaccgagaagctgagaaacaccctggactacctgagaagcttcctgaacgacagcaccaacttcaagctgatctacagatacgccttcgacttcgccagagagaaggaccagagaagcctggacatcaacaccgccaagtgcatgctgggcctgctgctgggcaagatctggcccctgttccccgtgttccaccagttcctggagcagagcaagtacaaggtgatcaacaaggaccagtggtgcaacgtgctggagttcagcagaaccatcaacctggacctgagcaactacgacgaggacggcgcctggcccgtgctgctggacgagttcgtggagtggtacaaggacaagcagatgagctag

SEQ ID NO: 78485 - DNA, 1854 bp, Artificial Sequence
  Description of Artificial Sequence: Synthetic coding sequence
atggccgccgtggccgccggcggcctggtgggcaagggcagagacatcagcctggccgccctgcagagacacgacccctacatcaacagaatcgtggacgtggccagccaggtggccctgtacaccttcggccacagagccaacgagtgggagaagaccgacgtggagggcaccctgttcgtgtacaccagaagcgccagccccaagcacggcttcaccatcatgaacagactgagcatggagaacagaaccgagcccatcaccaaggacctggacttccagctgcaggaccccttcctgctgtacagaaacgccagactgagcatctacggcatctggttctacgacaaggaggagtgccagagaatcgccgagctgatgaagaacctgacccagtacgagcagctgaaggcccaccagggcaccggcgccggcatcagccccgtgatcctgaacagcggcgagggcaaggaggtggacatcctgagaatgctgatcaaggccaaggacgagtacaccaagtgcaagacctgcagcgagcccaagaagatcaccagcagcagcgccatctacgacaaccccaacctgatcaagcccatccccgtgaagcccagcgagaaccagcagcagagaatcccccagcccaaccagaccctggaccccgagccccagcacctgagcctgaccgccctgttcggcaagcaggacaaggccacctgccaggagaccgtggagcccccccagaccctgcaccagcagcagcagcagcagcagcagcagcaggagaagctgcccatcagacagggcgtggtgagaagcctgagctacgaggagcccagaagacacagcccccccatcgagaagcagctgtgccccgccatccagaagctgatggtgagaagcgccgacctgcaccccctgagcgagctgcccgagaacagaccctgcgagaacggcagcacccacagcgccggcgagttcttcaccggccccgtgcagcccggcagcccccacaacatcggcaccagcagaggcgtgcagaacgccagcagaacccagaacctgttcgagaagctgcagagcacccccggcgccgccaacaagtgcgaccccagcacccccgcccccgccagcagcgccgccctgaacagaagcagagcccccaccagcgtgacccccgtggcccccggcaagggcctggcccagcccccccaggcctacttcaacggcagcctgcccccccagaccgtgggccaccaggcccacggcagagagcagagcaccctgcccagacagaccctgcccatcagcggcagccagaccggcagcagcggcgtgatcagcccccaggagctgctgaagaagctgcagatcgtgcagcaggagcagcagctgcacgccagcaacagacccgccctggccgccaagttccccgtgctggcccagagcagcggcaccggcaagcccctggagagctggatcaacaagacccccaacaccgagcagcagacccccctgttccaggtgatcagcccccagagaatccccgccaccgccgcccccagcctgctgatgagccccatggtgttcgcccagcccaccagcgtgccccccaaggagagagagagcggcctgctgcccgtgggcggccaggagccccccgccgccgccaccagcctgctgctgcccatccagagccccgagcccagcgtgatcaccagcagccccctgaccaagctgcagctgcaggaggccctgctgtacctgatccagaacgacgacaacttcctgaacatcatctacgaggcctacctgttcagcatgacccaggccgccatgaagaagaccatgtag

SEQ ID NO: 78486 - DNA, 1548 bp, Artificial Sequence
  Description of Artificial Sequence: Synthetic coding sequence
atgcagatcaaggtgagcatctacggcatctggttctacgacaaggaggagtgccagagaatcgccgagctgatgaagaacctgacccagtacgagcagctgaaggcccaccagggcaccggcgccggcatcagccccgtgatcctgaacagcggcgagggcaaggaggtggacatcctgagaatgctgatcaaggccaaggacgagtacaccaagtgcaagacctgcagcgagcccaagaagatcaccagcagcagcgccatctacgacaaccccaacctgatcaagcccatccccgtgaagcccagcgagaaccagcagcagagaatcccccagcccaaccagaccctggaccccgagccccagcacctgagcctgaccgccctgttcggcaagcaggacaaggccacctgccaggagaccgtggagcccccccagaccctgcaccagcagcagcagcagcagcagcagcagcaggagaagctgcccatcagacagggcgtggtgagaagcctgagctacgaggagcccagaagacacagcccccccatcgagaagcagctgtgccccgccatccagaagctgatggtgagaagcgccgacctgcaccccctgagcgagctgcccgagaacagaccctgcgagaacggcagcacccacagcgccggcgagttcttcaccggccccgtgcagcccggcagcccccacaacatcggcaccagcagaggcgtgcagaacgccagcagaacccagaacctgttcgagaagctgcagagcacccccggcgccgccaacaagtgcgaccccagcacccccgcccccgccagcagcgccgccctgaacagaagcagagcccccaccagcgtgacccccgtggcccccggcaagggcctggcccagcccccccaggcctacttcaacggcagcctgcccccccagaccgtgggccaccaggcccacggcagagagcagagcaccctgcccagacagaccctgcccatcagcggcagccagaccggcagcagcggcgtgatcagcccccaggagctgctgaagaagctgcagatcgtgcagcaggagcagcagctgcacgccagcaacagacccgccctggccgccaagttccccgtgctggcccagagcagcggcaccggcaagcccctggagagctggatcaacaagacccccaacaccgagcagcagacccccctgttccaggtgatcagcccccagagaatccccgccaccgccgcccccagcctgctgatgagccccatggtgttcgcccagcccaccagcgtgccccccaaggagagagagagcggcctgctgcccgtgggcggccaggagccccccgccgccgccaccagcctgctgctgcccatccagagccccgagcccagcgtgatcaccagcagccccctgaccaagctgcagctgcaggaggccctgctgtacctgatccagaacgacgacaacttcctgaacatcatctacgaggcctacctgttcagcatgacccaggccgccatgaagaagaccatgtag

SEQ ID NO: 78487 - DNA, 1263 bp, Artificial Sequence
  Description of Artificial Sequence: Synthetic coding sequence
atggagaccaagagagtggagatccccggcagcgtgctggacgacttctgcagcagattcatcctgcacatccccagcgaggagagagacaacgccatcagagtgtgcttccagatcgagctggcccactggttctacctggacttctacatgcagaacacccccggcctgccccagtgcggcatcagagacttcgccaaggccgtgttcagccactgccccttcctgctgccccagggcgaggacgtggagaaggtgctggacgagtggaaggagtacaagatgggcgtgcccacctacggcgccatcatcctggacgagaccctggagaacgtgctgctggtgcagggctacctggccaagagcggctggggcttccccaagggcaaggtgaacaaggaggaggccccccacgactgcgccgccagagaggtgttcgaggagaccggcttcgacatcaaggactacatctgcaaggacgactacatcgagctgagaatcaacgaccagctggccagactgtacatcatccccggcatccccaaggacaccaagttcaaccccaagaccagaagagagatcagaaacatcgagtggttcagcatcgagaagctgccctgccacagaaacgacatgacccccaagagcaagctgggcctggcccccaacaagttcttcatggccatccccttcatcagacccctgagagactggctgagcagaagattcggcgacagcagcgacagcgacaacggcttcagcagcaccggcagcacccccgccaagcccaccgtggagaagctgagcagaaccaagttcagacacagccagcagctgttccccgacggcagccccggcgaccagtgggtgaagcacagacagcccctgcagcagaagccctacaacaaccacagcgagatgagcgacctgctgaagggcaagaaccagagcatgagaggcaacggcagaaagcagtaccaggacagccccaaccagaagaagagaaccaacggcctgcagcccgccaagcagcagaacagcctgatgaagtgcgagaagaagctgcaccccagaaagctgcaggacaacttcgagaccgacgccgtgtacgacctgcccagcagcagcgaggaccagctgctggagcacgccgagggccagcccgtggcctgcaacggccactgcaagttccccttcagcagcagagccttcctgagcttcaagttcgaccacaacgccatcatgaagatcctggacctgtag

SEQ ID NO: 78488 - DNA, 1158 bp, Artificial Sequence
  Description of Artificial Sequence: Synthetic coding sequence
atggagaccaagagagtggagatccccggcagcgtgctggacgacttctgcagcagattcatcctgcacatccccagcgaggagagagacaacgccatcagagtgtgcttccagatcgagctggcccactggttctacctggacttctacatgcagaacacccccggcctgccccagtgcggcatcagagacttcgccaaggccgtgttcagccactgccccttcctgctgccccagggcgaggacgtggagaaggtgctggacgagtggaaggagtacaagatgggcgtgcccacctacggcgccatcatcctggacgagaccctggagaacgtgctgctggtgcagggctacctggccaagagcggctggggcttccccaagggcaaggtgaacaaggaggaggccccccacgactgcgccgccagagaggtgttcgaggagaccggcttcgacatcaaggactacatctgcaaggacgactacatcgagctgagaatcaacgaccagctggccagactgtacatcatccccggcatccccaaggacaccaagttcaaccccaagaccagaagagagatcagaaacatcgagtggttcagcatcgagaagctgccctgccacagaaacgacatgacccccaagagcaagctgggcctggcccccaacaagttcttcatggccatccccttcatcagacccctgagagactggctgagcagaagattcggcgacagcagcgacagcgacaacggcttcagcagcaccggcagcacccccgccaagcccaccgtggagaagctgagcagaaccaagttcagacacagccagcagctgttccccgacggcagccccggcgaccagtgggtgaagcacagacagcccctgcagcagaagccctacaacaaccacagcgagatgagcgacctgctgaagggcaagaagtgcgagaagaagctgcaccccagaaagctgcaggacaacttcgagaccgacgccgtgtacgacctgcccagcagcagcgaggaccagctgctggagcacgccgagggccagcccgtggcctgcaacggccactgcaagttccccttcagcagcagagccttcctgagcttcaagttcgaccacaacgccatcatgaagatcctggacctgtag

SEQ ID NO: 78489 - DNA, 630 bp, Artificial Sequence
  Description of Artificial Sequence: Synthetic coding sequence
atgacccccaagagcaagctgggcctggcccccaacaagttcttcatggccatccccttcatcagacccctgagagactggctgagcagaagattcggcgacagcagcgacagcgacaacggcttcagcagcaccggcagcacccccgccaagcccaccgtggagaagctgagcagaaccaagttcagacacagccagcagctgttccccgacggcagccccggcgaccagtgggtgaagcacagacagcccctgcagcagaagccctacaacaaccacagcgagatgagcgacctgctgaagggcaagaaccagagcatgagaggcaacggcagaaagcagtaccaggacagccccaaccagaagaagagaaccaacggcctgcagcccgccaagcagcagaacagcctgatgaagtgcgagaagaagctgcaccccagaaagctgcaggacaacttcgagaccgacgccgtgtacgacctgcccagcagcagcgaggaccagctgctggagcacgccgagggccagcccgtggcctgcaacggccactgcaagttccccttcagcagcagagccttcctgagcttcaagttcgaccacaacgccatcatgaagatcctggacctgtag

SEQ ID NO: 78490 - DNA, 1341 bp, Artificial Sequence
  Description of Artificial Sequence: Synthetic coding sequence
atgaccgagctgggcatggtggtgctgggcatcgacaccacccacctgtggatgctgcccctgacccccggcagctggaacagcatgagaagcagacacaagtggaactggccccagggcagctggggcctgggcggcccccccagaagcaccgccttcctggagtgctgcaccagcttcctgcccaacgacctgggcttcaccgacagctacagccagaaggccttctgcggcatctacagcaaggacggccagatcttcatgagcgcctgccaggaccagaccatcagactgtacgactgcagatacggcagattcagaaagttcaagagcatcaaggccagagacgtgggctggagcgtgctggacgtggccttcacccccgacggcaaccacttcctgtacagcagctggagcgactacatccacatctgcaacatctacggcgagggcgacacccacaccgccctggacctgagacccgacgagagaagattcgccgtgttcagcatcgccgtgagcagcgacggcagagaggtgctgggcggcgccaacgacggctgcctgtacgtgttcgacagagagcagaacagaagaaccctgcagatcgagagccacgaggacgacgtgaacgccgtggccttcgccgacatcagcagccagatcctgttcagcggcggcgacgacgccatctgcaaggtgtgggacagaagaaccatgagagaggacgaccccaagcccgtgggcgccctggccggccaccaggacggcatcaccttcatcgacagcaagggcgacgccagatacctgatcagcaacagcaaggaccagaccatcaagctgtgggacatcagaagattcagcagcagagagggcatggaggccagcagacaggccgccacccagcagaactgggactacagatggcagcaggtgcccaagaaggcctggagaaagctgaagctgcccggcgacagcagcctgatgacctacagaggccacggcgtgctgcacaccctgatcagatgcagattcagccccatccacagcaccggccagcagttcatctacagcggctgcagcaccggcaaggtggtggtgtacgacctgctgagcggccacatcgtgaagaagctgaccaaccacaaggcctgcgtgagagacgtgagctggcaccccttcgaggagaagatcgtgagcagcagctgggacggcaacctgagactgtggcagtacagacaggccgagtacttccaggacgacatgcccgagagcgaggagtgcgccagcgcccccgcccccgtgccccagagcagcacccccttcagcagcccccagtag

SEQ ID NO: 78491 - DNA, 1563 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggccctgctggacagcgaggaggagaacgacagagcctgggacggcagactgggcgacagatacaacccccccgtggacgccacccccgacaccagagagctggagttcaacgagatcaagacccaggtggagctggccaccggccagctgggcctgagaagagccgcccagaagcacagcttccccagaatgctgcaccagagagagagaggcctgtgccacagaggcagcttcagcctgggcgagcagagcagagtgatcagccacttcctgcccaacgacctgggcttcaccgacagctacagccagaaggccttctgcggcatctacagcaaggacggccagatcttcatgagcgcctgccaggaccagaccatcagactgtacgactgcagatacggcagattcagaaagttcaagagcatcaaggccagagacgtgggctggagcgtgctggacgtggccttcacccccgacggcaaccacttcctgtacagcagctggagcgactacatccacatctgcaacatctacggcgagggcgacacccacaccgccctggacctgagacccgacgagagaagattcgccgtgttcagcatcgccgtgagcagcgacggcagagaggtgctgggcggcgccaacgacggctgcctgtacgtgttcgacagagagcagaacagaagaaccctgcagatcgagagccacgaggacgacgtgaacgccgtggccttcgccgacatcagcagccagatcctgttcagcggcggcgacgacgccatctgcaaggtgtgggacagaagaaccatgagagaggacgaccccaagcccgtgggcgccctggccggccaccaggacggcatcaccttcatcgacagcaagggcgacgccagatacctgatcagcaacagcaaggaccagaccatcaagctgtgggacatcagaagattcagcagcagagagggcatggaggccagcagacaggccgccacccagcagaactgggactacagatggcagcaggtgcccaagaaggcctggagaaagctgaagctgcccggcgacagcagcctgatgacctacagaggccacggcgtgctgcacaccctgatcagatgcagattcagccccatccacagcaccggccagcagttcatctacagcggctgcagcaccggcaaggtggtggtgtacgacctgctgagcggccacatcgtgaagaagctgaccaaccacaaggcctgcgtgagagacgtgagctggcaccccttcgaggagaagatcgtgagcagcagctgggacggcaacctgagactgtggcagtacagacaggccgagtacttccaggacgacatgcccgagagcgaggagtgcgccagcgcccccgcccccgtgccccagagcagcacccccttcagcagcccccagtag

SEQ ID NO: 78492 - DNA, 1641 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagaggccaggtgagactggtgcagggcggcggcgccgccaacctgcagttcatccaggccctgctggacagcgaggaggagaacgacagagcctgggacggcagactgggcgacagatacaacccccccgtggacgccacccccgacaccagagagctggagttcaacgagatcaagacccaggtggagctggccaccggccagctgggcctgagaagagccgcccagaagcacagcttccccagaatgctgcaccagagagagagaggcctgtgccacagaggcagcttcagcctgggcgagcagagcagagtgatcagccacttcctgcccaacgacctgggcttcaccgacagctacagccagaaggccttctgcggcatctacagcaaggacggccagatcttcatgagcgcctgccaggaccagaccatcagactgtacgactgcagatacggcagattcagaaagttcaagagcatcaaggccagagacgtgggctggagcgtgctggacgtggccttcacccccgacggcaaccacttcctgtacagcagctggagcgactacatccacatctgcaacatctacggcgagggcgacacccacaccgccctggacctgagacccgacgagagaagattcgccgtgttcagcatcgccgtgagcagcgacggcagagaggtgctgggcggcgccaacgacggctgcctgtacgtgttcgacagagagcagaacagaagaaccctgcagatcgagagccacgaggacgacgtgaacgccgtggccttcgccgacatcagcagccagatcctgttcagcggcggcgacgacgccatctgcaaggtgtgggacagaagaaccatgagagaggacgaccccaagcccgtgggcgccctggccggccaccaggacggcatcaccttcatcgacagcaagggcgacgccagatacctgatcagcaacagcaaggaccagaccatcaagctgtgggacatcagaagattcagcagcagagagggcatggaggccagcagacaggccgccacccagcagaactgggactacagatggcagcaggtgcccaagaaggcctggagaaagctgaagctgcccggcgacagcagcctgatgacctacagaggccacggcgtgctgcacaccctgatcagatgcagattcagccccatccacagcaccggccagcagttcatctacagcggctgcagcaccggcaaggtggtggtgtacgacctgctgagcggccacatcgtgaagaagctgaccaaccacaaggcctgcgtgagagacgtgagctggcaccccttcgaggagaagatcgtgagcagcagctgggacggcaacctgagactgtggcagtacagacaggccgagtacttccaggacgacatgcccgagagcgaggagtgcgccagcgcccccgcccccgtgccccagagcagcacccccttcagcagcccccagtag

SEQ ID NO: 78493 - DNA, 369 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagaggccaggtgagactggtgcagggcggcggcgccgccaacctgcagttcatccaggccctgctggacagcgaggaggagaacgacagagcctgggacggcagactgggcgacagatacaacccccccgtggacgccacccccgacaccagagagctggagttcaacgagatcaagacccaggtggagctggccaccggccagctgggcctgtag

SEQ ID NO: 78494 - DNA, 222 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagaggccaggtgagactggtgcagggcggcggcgccgccaacctgcagttcatccaggccctgctgtag

SEQ ID NO: 78495 - DNA, 282 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagaggccaggtgagactggtgcagggcggcggcgccgccaacctgcagttcatccaggccctgctggacagcgaggaggagaacgacagagcctgggacggcagactgggcgacagatacaacccctag

SEQ ID NO: 78496 - DNA, 327 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagaggccaggtgagactggtgcagggcggcggcgccgccaacctgcagttcatccaggccctgctggacagcgaggaggagaacgacagagcctgggacggcagactgggcgacagatacaacccccccgtggacgccacccccgacaccagagagctggagttcaacgagtag

SEQ ID NO: 78497 - DNA, 1641 bp, Artificial Sequence; identical to SEQ ID NO: 78492
  Description of Artificial Sequence: Synthetic coding sequence

SEQ ID NO: 78498 - DNA, 273 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggccctgctggacagcgaggaggagaacgacagagcctgggacggcagactgggcgacagatacaacccccccgtggacgccacccccgacaccagagagctggagttcaacgagatcaagacccaggtggagctggcctag

SEQ ID NO: 78499 - DNA, 93 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagctag

SEQ ID NO: 78500 - DNA, 429 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagaggccaggtgagactggtgcagggcggcggcgccgccaacctgcagttcatccaggccctgctggacagcgaggaggagaacgacagagcctgggacggcagactgggcgacagatacaacccccccgtggacgccacccccgacaccagagagctggagttcaacgagatcaagacccaggtggagctggccaccggccagctgggcctgagaagagccgcccagaagcacagcttccccagaatgctgcaccagagagagagaggcctgtag

SEQ ID NO: 78501 - DNA, 204 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccagagacccagcgaggtgggcgccggcagaagatgcagcaagttcaccatccacagcggccccctgggcctgtag

SEQ ID NO: 78502 - DNA, 321 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagacccagctggacccagagaaagagaatgaccgagctgggcatggtggtgctgggcatcgacaccacccacctgtggatgctgcccctgacccccggcagctggaacagcatgagaagcagacacaagtggaactggccccagggcagctggggcctgggcggctag

SEQ ID NO: 78503 - DNA, 387 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggccctgctggacagcgaggaggagaacgacagagcctgggacggcagactgggcgacagatacaacccccccgtggacgccacccccgacaccagagagctggagttcaacgagatcaagacccaggtggagctggccaccggccagctgggcctgagaagagccgcccagaagcacagcttccccagaatgctgcaccagagagagagaggcctgtgccacagaggcagcttcagcctgggcgagcagagctag

SEQ ID NO: 78504 - DNA, 465 bp, Artificial Sequence
  Description of Artificial Sequence: Synthetic coding sequence
atgggcagcagaaacagcagcagcgccggcagcggcagcggcgaccccagcgagggcctgcccagaagaggcgccggcctgagaagaagcgaggaggaggaggaggaggacgaggacgtggacctggcccaggtgctggcctacctgctgagaagaggccaggtgagactggtgcagggcggcggcgccgccaacctgcagttcatccaggccctgctggacagcgaggaggagaacgacagagcctgggacggcagactgggcgacagatacaacccccccgtggacgccacccccgacaccagagagctggagttcaacgagatcaagacccaggtggagctggccaccggccagctgggcctgagaagagccgcccagaagcacagcttccccagaatgctgcaccagagagagagaggcctgtgccacagaggcagcttcagcctgggcgagcagagctag

SEQ ID NO: 78505 - DNA, 2829 bp, Artificial Sequence
  Description of Artificial Sequence: Synthetic coding sequence
atgaagagaagagccggcctgggcggcagcatgagaagcgtggtgggcttcctgagccagagaggcctgcacggcgaccccctgctgacccaggacttccagagaagaagactgagaggctgcagaaacctgtacaagaaggacctgctgggccacttcggctgcgtgaacgccatcgagttcagcaacaacggcggccagtggctggtgagcggcggcgacgacagaagagtgctgctgtggcacatggagcaggccatccacagcagagtgaagcccatccagctgaagggcgagcaccacagcaacatcttctgcctggccttcaacagcggcaacaccaaggtgttcagcggcggcaacgacgagcaggtgatcctgcacgacgtggagagcagcgagaccctggacgtgttcgcccacgaggacgccgtgtacggcctgagcgtgagccccgtgaacgacaacatcttcgccagcagcagcgacgacggcagagtgctgatctgggacatcagagagagcccccacggcgagcccttctgcctggccaactaccccagcgccttccacagcgtgatgttcaaccccgtggagcccagactgctggccaccgccaacagcaaggagggcgtgggcctgtgggacatcagaaagccccagagcagcctgctgagatacggcggcaacctgagcctgcagagcgccatgagcgtgagattcaacagcaacggcacccagctgctggccctgagaagaagactgccccccgtgctgtacgacatccacagcagactgcccgtgttccagttcgacaaccagggctacttcaacagctgcaccatgaagagctgctgcttcgccggcgacagagaccagtacatcctgagcggcagcgacgacttcaacctgtacatgtggagaatccccgccgaccccgaggccggcggcatcggcagagtggtgaacggcgccttcatggtgctgaagggccacagaagcatcgtgaaccaggtgagattcaacccccacacctacatgatctgcagcagcggcgtggagaagatcatcaagatctggagcccctacaagcagcccggctgcaccggcgacctggacggcagaatcgaggacgacagcagatgcctgtacacccacgaggagtacatcagcctggtgctgaacagcggcagcggcctgagccacgactacgccaaccagagcgtgcaggaggaccccagaatgatggccttcttcgacagcctggtgagaagagagatcgagggctggagcagcgacagcgacagcgacctgagcgagagcaccatcctgcagctgcacgccggcgtgagcgagagaagcggctacaccgacagcgagagcagcgccagcctgcccagaagccccccccccaccgtggacgagagcgccgacaacgccttccacctgggccccctgagagtgaccaccaccaacaccgtggccagcaccccccccacccccacctgcgaggacgccgccagcagacagcagagactgagcgccctgagaagataccaggacaagagactgctggccctgagcaacgagagcgacagcgaggagaacgtgtgcgaggtggagctggacaccgacctgttccccagacccagaagccccagccccgaggacgagagcagcagcagcagcagcagcagcagcagcgaggacgaggaggagctgaacgagagaagagccagcacctggcagagaaacgccatgagaagaagacagaagaccaccagagaggacaagcccagcgcccccatcaagcccaccaacacctacatcggcgaggacaactacgactacccccagatcaaggtggacgacctgagcagcagccccaccagcagccccgagagaagcaccagcaccctggagatccagcccagcagagccagccccaccagcgacatcgagagcgtggagagaaagatctacaaggcctacaagtggctgagatacagctacatcagctacagcaacaacaaggacggcgagaccagcctggtgaccggcgaggccgacgagggcagagccggcaccagccacaaggacaaccccgcccccagcagcagcaaggaggcctgcctgaacatcgccatggcccagagaaaccaggacctgccccccgagggctgcagcaaggacaccttcaaggaggagacccccagaacccccagcaacggccccggccacgagcacagcagccacgcctgggccgaggtgcccgagggcaccagccaggacaccggcaacagcggcagcgtggagcaccccttcgagaccaagaagctgaacggcaaggccctgagcagcagagccgaggagccccccagcccccccgtgcccaaggccagcggcagcaccctgaacagcggcagcggcaactgccccagaacccagagcgacgacagcgaggagagaagcctggagaccatctgcgccaaccacaacaacggcagactgcaccccagacccccccacccccacaacaacggccagaacctgggcgagctggaggtggtggcctacagcagccccggccacagcgacaccgacagagacaacagcagcctgaccggcaccctgctgcacaaggactgctgcggcagcgagatggcctgcgagacccccaacgccggcaccagagaggaccccaccgacacccccgccaccgacagcagcagagccgtgcacggccacagcggcctgaagagacagagaatcgagctggaggacaccgacagcgagaacagcagcagcgagaagaagctgaagacctag

SEQ ID NO: 78506 - DNA, 2583 bp, Artificial Sequence
  Description of Artificial Sequence: Synthetic coding sequence
atggagcaggccatccacagcagagtgaagcccatccagctgaagggcgagcaccacagcaacatcttctgcctggccttcaacagcggcaacaccaaggtgttcagcggcggcaacgacgagcaggtgatcctgcacgacgtggagagcagcgagaccctggacgtgttcgcccacgaggacgccgtgtacggcctgagcgtgagccccgtgaacgacaacatcttcgccagcagcagcgacgacggcagagtgctgatctgggacatcagagagagcccccacggcgagcccttctgcctggccaactaccccagcgccttccacagcgtgatgttcaaccccgtggagcccagactgctggccaccgccaacagcaaggagggcgtgggcctgtgggacatcagaaagccccagagcagcctgctgagatacggcggcaacctgagcctgcagagcgccatgagcgtgagattcaacagcaacggcacccagctgctggccctgagaagaagactgccccccgtgctgtacgacatccacagcagactgcccgtgttccagttcgacaaccagggctacttcaacagctgcaccatgaagagctgctgcttcgccggcgacagagaccagtacatcctgagcggcagcgacgacttcaacctgtacatgtggagaatccccgccgaccccgaggccggcggcatcggcagagtggtgaacggcgccttcatggtgctgaagggccacagaagcatcgtgaaccaggtgagattcaacccccacacctacatgatctgcagcagcggcgtggagaagatcatcaagatctggagcccctacaagcagcccggctgcaccggcgacctggacggcagaatcgaggacgacagcagatgcctgtacacccacgaggagtacatcagcctggtgctgaacagcggcagcggcctgagccacgactacgccaaccagagcgtgcaggaggaccccagaatgatggccttcttcgacagcctggtgagaagagagatcgagggctggagcagcgacagcgacagcgacctgagcgagagcaccatcctgcagctgcacgccggcgtgagcgagagaagcggctacaccgacagcgagagcagcgccagcctgcccagaagccccccccccaccgtggacgagagcgccgacaacgccttccacctgggccccctgagagtgaccaccaccaacaccgtggccagcaccccccccacccccacctgcgaggacgccgccagcagacagcagagactgagcgccctgagaagataccaggacaagagactgctggccctgagcaacgagagcgacagcgaggagaacgtgtgcgaggtggagctggacaccgacctgttccccagacccagaagccccagccccgaggacgagagcagcagcagcagcagcagcagcagcagcgaggacgaggaggagctgaacgagagaagagccagcacctggcagagaaacgccatgagaagaagacagaagaccaccagagaggacaagcccagcgcccccatcaagcccaccaacacctacatcggcgaggacaactacgactacccccagatcaaggtggacgacctgagcagcagccccaccagcagccccgagagaagcaccagcaccctggagatccagcccagcagagccagccccaccagcgacatcgagagcgtggagagaaagatctacaaggcctacaagtggctgagatacagctacatcagctacagcaacaacaaggacggcgagaccagcctggtgaccggcgaggccgacgagggcagagccggcaccagccacaaggacaaccccgcccccagcagcagcaaggaggcctgcctgaacatcgccatggcccagagaaaccaggacctgccccccgagggctgcagcaaggacaccttcaaggaggagacccccagaacccccagcaacggccccggccacgagcacagcagccacgcctgggccgaggtgcccgagggcaccagccaggacaccggcaacagcggcagcgtggagcaccccttcgagaccaagaagctgaacggcaaggccctgagcagcagagccgaggagccccccagcccccccgtgcccaaggccagcggcagcaccctgaacagcggcagcggcaactgccccagaacccagagcgacgacagcgaggagagaagcctggagaccatctgcgccaaccacaacaacggcagactgcaccccagacccccccacccccacaacaacggccagaacctgggcgagctggaggtggtggcctacagcagccccggccacagcgacaccgacagagacaacagcagcctgaccggcaccctgctgcacaaggactgctgcggcagcgagatggcctgcgagacccccaacgccggcaccagagaggaccccaccgacacccccgccaccgacagcagcagagccgtgcacggccacagcggcctgaagagacagagaatcgagctggaggacaccgacagcgagaacagcagcagcgagaagaagctgaagacctag

SEQ ID NO: 78507 - DNA, 633 bp, Artificial Sequence
  Description of Artificial Sequence: Synthetic coding sequence
atggagcaggccatccacagcagagtgaagcccatccagctgaagggcgagcaccacagcaacatcttctgcctggccttcaacagcggcaacaccaaggtgttcagcggcggcaacgacgagcaggtgatcctgcacgacgtggagagcgagaccctggacgtgttcgcccacgaggacgccgtgtacggcctgagcgtgagccccgtgaacgacaacatcttcgccagcagcagcgacgacggcagagtgctgatctgggacatcagagagagcccccacggcgagcccttctgcctggccaactaccccagcgccttccacagcgtgatgttcaaccccgtggagcccagactgctggccaccgccaacagcaaggagggcgtgggcctgtgggacatcagaaagccccagagcagcctgctgagatacggcggcaacctgagcctgcagagcgccatgagcgtgagattcaacagcaacggcacccagctgctggccctgagaagaagactgccccccgtgctgtacgacatccacagcagactgcccgtgttccagttcgacaaccagggctacttcaacagctgcaccatgaagagctgctgcttcgccggcgacagagaccagtag

SEQ ID NO: 78508 - DNA, 2583 bp, Artificial Sequence; identical to SEQ ID NO: 78506
  Description of Artificial Sequence: Synthetic coding sequence

SEQ ID NO: 78509 - DNA, 357 bp, Artificial Sequence
  Description of Artificial Sequence: Synthetic coding sequence
atgcccttcctggagctggacaccaacctgcccgccaacagagtgcccgccggcctggagaagagactgtgcgccgccgccgccagcatcctgggcaagcccgccgacagagtgaacgtgaccgtgagacccggcctggccatggccctgagcggcagcaccgagccctgcgcccagctgagcatcagcagcatcggcgtggtgggcaccgccgaggacaacagaagccacagcgcccacttcttcgagttcctgaccaaggagctggccctgggccaggacagaatcctgatcagattcttccccctggagagctggcagatcggcaagatcggcaccgtgatgaccttcctgtag

SEQ ID NO: 78510 - DNA, 357 bp, Artificial Sequence; identical to SEQ ID NO: 78509
  Description of Artificial Sequence: Synthetic coding sequence

SEQ ID NO: 78511 - DNA, 399 bp, Artificial Sequence
  Description of Artificial Sequence: Synthetic coding sequence
atgcagctgttcctgctggccgtgagcgtgcccctgcccgccatgcccttcctggagctggacaccaacctgcccgccaacagagtgcccgccggcctggagaagagactgtgcgccgccgccgccagcatcctgggcaagcccgccgacagagtgaacgtgaccgtgagacccggcctggccatggccctgagcggcagcaccgagccctgcgcccagctgagcatcagcagcatcggcgtggtgggcaccgccgaggacaacagaagccacagcgcccacttcttcgagttcctgaccaaggagctggccctgggccaggacagaatcctgatcagattcttccccctggagagctggcagatcggcaagatcggcaccgtgatgaccttcctgtag

SEQ ID NO: 78512 - DNA, 348 bp, Artificial Sequence
  Description of Artificial Sequence: Synthetic coding sequence
atgcccatgttcatcgtgaacaccaacgtgcccagagccagcgtgcccgacggcttcctgagcgagctgacccagcagctggcccaggccaccggcaagcccccccagtacatcgccgtgcacgtggtgcccgaccagctgatggccttcggcggcagcagcgagccctgcgccctgtgcagcctgcacagcatcggcaagatcggcggcgcccagaacagaagctacagcaagctgctgtgcggcctgctggccgagagactgagaatcagccccgacagagtgtacatcaactactacgacatgaacgccgccaacgtgggctggaacaacagcaccttcgcctag

SEQ ID NO: 78513 - DNA, 1224 bp, Artificial Sequence
  Description of Artificial Sequence: Synthetic coding sequence
atgaacaacagcggcgccgacgagatcggcaagctgttcgtgggcggcctggactggagcaccacccaggagaccctgagaagctacttcagccagtacggcgaggtggtggactgcgtgatcatgaaggacaagaccaccaaccagagcagaggcttcggcttcgtgaagttcaaggaccccaactgcgtgggcaccgtgctggccagcagaccccacaccctggacggcagaaacatcgaccccaagccctgcacccccagaggcatgcagcccgagagaaccagacccaaggagggctggcagaagggccccagaagcgacaacagcaagagcaacaagatcttcgtgggcggcatcccccacaactgcggcgagaccgagctgagagagtacttcaagaagttcggcgtggtgaccgaggtggtgatgatctacgacgccgagaagcagagacccagaggcttcggcttcatcaccttcgaggacgagcagagcgtggaccaggccgtgaacatgcacttccacgacatcatgggcaagaaggtggaggtgaagagagccgagcccagagacagcaagagccaggcccccggccagcccggcgccagccagtggggcagcagagtggtgcccaacgccgccaacggctgggccggccagcccccccccacctggcagcagggctacggcccccagggcatgtgggtgcccgccggccaggccatcggcggctacggccccccccccgccggcagaggcgccccccccccccccccccccttcaccagctacatcgtgagcaccccccccggcggcttcccccccccccagggcttcccccagggctacggcgcccccccccagttcagcttcggctacggcccccccccccccccccccgaccagttcgccccccccggcgtgccccccccccccgccacccccggcgccgcccccctggccttcccccccccccccagccaggccgcccccgacatgagcaagccccccaccgcccagcccgacttcccctacggccagtacgccggctacggccaggacctgagcggcttcggccagggcttcagcgaccccagccagcagccccccagctacggcggccccagcgtgcccggcagcggcggcccccccgccggcggcagcggcttcggcagaggccagaaccacaacgtgcagggcttccacccctacagaagatag

SEQ ID NO: 78514 - DNA, 2223 bp, Artificial Sequence
  Description of Artificial Sequence: Synthetic coding sequence
atggccgccttcagcgagatgggcgtgatgcccgagatcgcccaggccgtggaggagatggactggctgctgcccaccgacatccaggccgagagcatccccctgatcctgggcggcggcgacgtgctgatggccgccgagaccggcagcggcaagaccggcgccttcagcatccccgtgatccagatcgtgtacgagaccctgaaggaccagcaggagggcaagaagggcaagaccaccatcaagaccggcgccagcgtgctgaacaagtggcagatgaacccctacgacagaggcagcgccttcgccatcggcagcgacggcctgtgctgccagagcagagaggtgaaggagtggcacggctgcagagccaccaagggcctgatgaagggcaagcactactacgaggtgagctgccacgaccagggcctgtgcagagtgggctggagcaccatgcaggccagcctggacctgggcaccgacaagttcggcttcggcttcggcggcaccggcaagaagagccacaacaagcagttcgacaactacggcgaggagttcaccatgcacgacaccatcggctgctacctggacatcgacaagggccacgtgaagttcagcaagaacggcaaggacctgggcctggccttcgagatccccccccacatgaagaaccaggccctgttccccgcctgcgtgctgaagaacgccgagctgaagttcaacttcggcgaggaggagttcaagttcccccccaaggacggcttcgtggccctgagcaaggcccccgacggctacatcgtgaagagccagcacagcggcaacgcccaggtgacccagaccaagttcctgcccaacgcccccaaggccctgatcgtggagcccagcagagagctggccgagcagaccctgaacaacatcaagcagttcaagaagtacatcgacaaccccaagctgagagagctgctgatcatcggcggcgtggccgccagagaccagctgagcgtgctggagaacggcgtggacatcgtggtgggcacccccggcagactggacgacctggtgagcaccggcaagctgaacctgagccaggtgagattcctggtgctggacgaggccgacggcctgctgagccagggctacagcgacttcatcaacagaatgcacaaccagatcccccaggtgaccagcgacggcaagagactgcaggtgatcgtgtgcagcgccaccctgcacagcttcgacgtgaagaagctgagcgagaagatcatgcacttccccacctgggtggacctgaagggcgaggacagcgtgcccgacaccgtgcaccacgtggtggtgcccgtgaaccccaagaccgacagactgtgggagagactgggcaagagccacatcagaaccgacgacgtgcacgccaaggacaacaccagacccggcgccaacagccccgagatgtggagcgaggccatcaagatcctgaagggcgagtacgccgtgagagccatcaaggagcacaagatggaccaggccatcatcttctgcagaaccaagatcgactgcgacaacctggagcagtacttcatccagcagggcggcggccccgacaagaagggccaccagttcagctgcgtgtgcctgcacggcgacagaaagccccacgagagaaagcagaacctggagagattcaagaagggcgacgtgagattcctgatctgcaccgacgtggccgccagaggcatcgacatccacggcgtgccctacgtgatcaacgtgaccctgcccgacgagaagcagaactacgtgcacagaatcggcagagtgggcagagccgagagaatgggcctggccatcagcctggtggccaccgagaaggagaaggtgtggtaccacgtgtgcagcagcagaggcaagggctgctacaacaccagactgaaggaggacggcggctgcaccatctggtacaacgagatgcagctgctgagcgagatcgaggagcacctgaactgcaccatcagccaggtggagcccgacatcaaggtgcccgtggacgagttcgacggcaaggtgacctacggccagaagagagccgccggcggcggcagctacaagggccacgtggacatcctggcccccaccgtgcaggagctggccgccctggagaaggaggcccagaccagcttcctgcacctgggctacctgcccaaccagctgttcagaaccttctag

SEQ ID NO: 78515 - DNA, 51 bp, Artificial Sequence
  Description of Artificial Sequence: Synthetic coding sequence
atggccgccttcagcgagatgggcgtgatgcccgagatcgcccaggcctag

SEQ ID NO: 78516 - DNA, 1869 bp, Artificial Sequence
  Description of Artificial Sequence: Synthetic coding sequence
atggccgccttcagcgagatgggcgtgatgcccgagatcgcccaggccgtggaggagatggactggctgctgcccaccgacatccaggccgagagcatccccctgatcctgggcggcggcgacgtgctgatggccgccgagaccggcagcggcaagaccggcgccttcagcatccccgtgatccagatcgtgtacgagaccctgaaggaccagcaggagggcaagaagggcaagaccaccatcaagaccggcgccagcgtgctgaacaagtggcagatgaacccctacgacagagaggtgaaggagtggcacggctgcagagccaccaagggcctgatgaagggcaagcactactacgaggtgagctgccacgaccagggcctgtgcagagtgggctggagcaccatgcaggccagcctggacctgggcaccgacaagttcggcttcggcttcggcggcaccggcaagaagagccacaacaagcagttcgacaactacggcgaggagttcaccatgcacgacaccatcggctgctacctggacatcgacaagggccacgtgaagttcagcaagaacggcaaggacctgggcctggccttcgagatccccccccacatgaagaaccaggccctgttccccgcctgcgtgctgaagaacgccgagctgaagttcaacttcggcgaggaggagttcaagttcccccccaaggacggcttcgtggccctgagcaaggcccccgacggctacatcgtgaagagccagcacagcggcaacgcccaggtgacccagaccaagttcctgcccaacgcccccaaggccctgatcgtggagcccagcagagagctggccgagcagaccctgaacaacatcaagcagttcaagaagtacatcgacaaccccaagctgagagagctgctgatcatcggcggcgtggccgccagagaccagctgagcgtgctggagaacggcgtggacatcgtggtgggcacccccggcagactggacgacctggtgagcaccggcaagctgaacctgagccaggtgagattcctggtgctggacgaggccgacggcctgctgagccagggctacagcgacttcatcaacagaatgcacaaccagatcccccaggtgaccagcgacggcaagagactgcaggtgatcgtgtgcagcgccaccctgcacagcttcgacgtgaagaagctgagcgagaagatcatgcacttccccacctgggtggacctgaagggcgaggacagcgtgcccgacaccgtgcaccacgtggtggtgcccgtgaaccccaagaccgacagactgtgggagagactgggcaagagccacatcagaaccgacgacgtgcacgccaaggacaacaccagacccggcgccaacagccccgagatgtggagcgaggccatcaagatcctgaagggcgagtacgccgtgagagccatcaaggagcacaagatggaccaggccatcatcttctgcagaaccaagatcgactgcgacaacctggagcagtacttcatccagcagggcggcggccccgacaagaagggccaccagttcagctgcgtgtgcctgcacggcgacagaaagccccacgagagaaagcagaacctggagagattcaagaagggcgacgtgagattcctgatctgcaccgacgtggccgccagaggcatcgacatccacggcgtgccctacgtgatcaacgtgaccctgcccgacgagaagcagaactacgtgcacagaatcggcagagtgggcagagccgagagaatgggcctggccatcagcctggtggccaccgagaaggagaaggtgtggtaccacatggtgcagagagacgccgtgaccatctag

SEQ ID NO: 78517 - DNA, 2628 bp, Artificial Sequence
  Description of Artificial Sequence: Synthetic coding sequence
atgggcaagaccgccaacagccccggcagcggcgccagacccgaccccgtgagaagcttcaacagatggaagaagaagcacagccacagacagaacaagaagaagcagctgagaaagcagctgaagaagcccgagtggcaggtggagagagagagcatcagcagactgatgcagaactacgagaagatcaacgtgaacgagatcaccagattcagcgacttccccctgagcaagaagaccctgaagggcctgcaggaggcccagtacagactggtgaccgagatccagaagcagaccatcggcctggccctgcagggcaaggacgtgctgggcgccgccaagaccggcagcggcaagaccctggccttcctggtgcccgtgctggaggccctgtacagactgcagtggaccagcaccgacggcctgggcgtgctgatcatcagccccaccagagagctggcctaccagaccttcgaggtgctgagaaaggtgggcaagaaccacgacttcagcgccggcctgatcatcggcggcaaggacctgaagcacgaggccgagagaatcaacaacatcaacatcctggtgtgcacccccggcagactgctgcagcacatggacgagaccgtgagcttccacgccaccgacctgcagatgctggtgctggacgaggccgacagaatcctggacatgggcttcgccgacaccatgaacgccgtgatcgagaacctgcccaagaagagacagaccctgctgttcagcgccacccagaccaagagcgtgaaggacctggccagactgagcctgaagaaccccgagtacgtgtgggtgcacgagaaggccaagtacagcacccccgccaccctggagcagaactacatcgtgtgcgagctgcagcagaagatcagcgtgctgtacagcttcctgagaagccacctgaagaagaagagcatcgtgttcttcagcagctgcaaggaggtgcagtacctgtacagagtgttctgcagactgagacccggcgtgagcatcctggccctgcacggcagacagcagcagatgagaagaatggaggtgtacaacgagttcgtgagaaagagagccgccgtgctgttcgccaccgacatcgccgccagaggcctggacttccccgccgtgaactgggtgctgcagttcgactgccccgaggacgccaacacctacatccacagagccggcagaaccgccagatacaaggaggacggcgaggccctgctgatcctgctgcccagcgagaaggccatggtgcagcagctgctgcagaagaaggtgcccgtgaaggagatcaagatcaaccccgagaagctgatcgacgtgcagaagaagctggagagcatcctggcccaggaccaggacctgaaggagagagcccagagatgcttcgtgagctacgtgagaagcgtgtacctgatgaaggacaaggaggtgttcgacgtgagcaagctgcccatccccgagtacgccctgagcctgggcctggccgtggcccccagagtgagattcctgcagaagatgcagaagcagcccaccaaggagctggtgagaagccaggccgacaaggtgatcgagcccagagcccccagcctgaccaacgacgaggtggaggagttcagagcctacttcaacgagaagatgagcatcctgcagaagggcggcaagagactggagggcaccgagcacagacaggacaacgacaccggcaacgaggagcaggaggaggaggaggacgacgaggaggagatggaggagaagctggccaaggccaagggcagccaggcccccagcctgcccaacaccagcgaggcccagaagatcaaggaggtgcccacccagttcctggacagagacgaggaggaggaggacgccgacttcctgaaggtgaagagacacaacgtgttcggcctggacctgaaggacgagaagaccctgcagaagaaggagcccagcaagagcagcatcaagaagaagatgaccaaggtggccgaggccaagaaggtgatgaagagaaacttcaaggtgaacaagaagatcaccttcaccgacgagggcgagctggtgcagcagtggccccagatgcagaagagcgccatcaaggacgccgaggaggacgacgacaccggcggcatcaacctgcacaaggccaaggagagactgcaggaggaggacaagttcgacaaggaggagtacagaaagaagatcaaggccaagcacagagagaagagactgaaggagagagaggccagaagagaggccaacaagagacaggccaaggccaaggacgaggaggaggccttcctggactggagcgacgacgacgacgacgacgacgacggcttcgaccccagcaccctgcccgaccccgacaagtacagaagcagcgaggacagcgacagcgaggacatggagaacaagatcagcgacaccaagaagaagcagggcatgaagaagagaagcaacagcgaggtggaggacgtgggccccaccagccacaacagaaagaaggccagatgggacaccctggagcccctggacaccggcctgagcctggccgaggacgaggagctggtgctgcacctgctgagaagccagagctag

SEQ ID NO: 78518 - DNA, 2346 bp, Artificial Sequence
  Description of Artificial Sequence: Synthetic coding sequence
atgggcaagaccgccaacagccccggcagcggcgccagacccgaccccgtgagaagcttcaacagatggaagaagaagcacagccacagacagaacaagaagaagcagctgagaaagcagctgaagaagcccgagtggcaggtggagagagagagcatcagcagactgatgcagaactacgagaagatcaacgtgaacgagatcaccagattcagcgacttccccctgagcaagaagaccctgaagggcctgcaggaggcccagtacagactggtgaccgagatccagaagcagaccatcggcctggccctgcagggcaaggacgtgctgggcgccgccaagaccggcagcggcaagaccctggccttcctggtgcccgtgaacgaggccgacagaatcctggacatgggcttcgccgacaccatgaacgccgtgatcgagaacctgcccaagaagagacagaccctgctgttcagcgccacccagaccaagagcgtgaaggacctggccagactgagcctgaagaaccccgagtacgtgtgggtgcacgagaaggccaagtacagcacccccgccaccctggagcagaactacatcgtgtgcgagctgcagcagaagatcagcgtgctgtacagcttcctgagaagccacctgaagaagaagagcatcgtgttcttcagcagctgcaaggaggtgcagtacctgtacagagtgttctgcagactgagacccggcgtgagcatcctggccctgcacggcagacagcagcagatgagaagaatggaggtgtacaacgagttcgtgagaaagagagccgccgtgctgttcgccaccgacatcgccgccagaggcctggacttccccgccgtgaactgggtgctgcagttcgactgccccgaggacgccaacacctacatccacagagccggcagaaccgccagatacaaggaggacggcgaggccctgctgatcctgctgcccagcgagaaggccatggtgcagcagctgctgcagaagaaggtgcccgtgaaggagatcaagatcaaccccgagaagctgatcgacgtgcagaagaagctggagagcatcctggcccaggaccaggacctgaaggagagagcccagagatgcttcgtgagctacgtgagaagcgtgtacctgatgaaggacaaggaggtgttcgacgtgagcaagctgcccatccccgagtacgccctgagcctgggcctggccgtggcccccagagtgagattcctgcagaagatgcagaagcagcccaccaaggagctggtgagaagccaggccgacaaggtgatcgagcccagagcccccagcctgaccaacgacgaggtggaggagttcagagcctacttcaacgagaagatgagcatcctgcagaagggcggcaagagactggagggcaccgagcacagacaggacaacgacaccggcaacgaggagcaggaggaggaggaggacgacgaggaggagatggaggagaagctggccaaggccaagggcagccaggcccccagcctgcccaacaccagcgaggcccagaagatcaaggaggtgcccacccagttcctggacagagacgaggaggaggaggacgccgacttcctgaaggtgaagagacacaacgtgttcggcctggacctgaaggacgagaagaccctgcagaagaaggagcccagcaagagcagcatcaagaagaagatgaccaaggtggccgaggccaagaaggtgatgaagagaaacttcaaggtgaacaagaagatcaccttcaccgacgagggcgagctggtgcagcagtggccccagatgcagaagagcgccatcaaggacgccgaggaggacgacgacaccggcggcatcaacctgcacaaggccaaggagagactgcaggaggaggacaagttcgacaaggaggagtacagaaagaagatcaaggccaagcacagagagaagagactgaaggagagagaggccagaagagaggccaacaagagacaggccaaggccaaggacgaggaggaggccttcctggactggagcgacgacgacgacgacgacgacgacggcttcgaccccagcaccctgcccgaccccgacaagtacagaagcagcgaggacagcgacagcgaggacatggagaacaagatcagcgacaccaagaagaagcagggcatgaagaagagaagcaacagcgaggtggaggacgtgggccccaccagccacaacagaaagaaggccagatgggacaccctggagcccctggacaccggcctgagcctggccgaggacgaggagctggtgctgcacctgctgagaagccagagctag

SEQ ID NO: 78519 - DNA, 1959 bp, Artificial Sequence
  Description of Artificial Sequence: Synthetic coding sequence
atgagaggcggcggcttcggcgacagagacagagacagagacagaggcggcttcggcgccagaggcggcggcggcctgccccccaagaagttcggcaaccccggcgagagactgagaaagaagaagtgggacctgagcgagctgcccaagttcgagaagaacttctacgtggagcaccccgaggtggccagactgaccccctacgaggtggacgagctgagaagaaagaaggagatcaccgtgagaggcggcgacgtgtgccccaagcccgtgttcgccttccaccacgccaacttcccccagtacgtgatggacgtgctgatggaccagcacttcaccgagcccacccccatccagtgccagggcttccccctggccctgagcggcagagacatggtgggcatcgcccagaccggcagcggcaagaccctggcctacctgctgcccgccatcgtgcacatcaaccaccagccctacctggagagaggcgacggccccatctgcctggtgctggcccccaccagagagctggcccagcaggtgcagcaggtggccgacgactacggcaagtgcagcagactgaagagcacctgcatctacggcggcgcccccaagggcccccagatcagagacctggagagaggcgtggagatctgcatcgccacccccggcagactgatcgacttcctggagagcggcaagaccaacctgagaagatgcacctacctggtgctggacgaggccgacagaatgctggacatgggcttcgagccccagatcagaaagatcgtggaccagatcagacccgacagacagaccctgatgtggagcgccacctggcccaaggaggtgagacagctggccgaggacttcctgagagactacacccagatcaacgtgggcaacctggagctgagcgccaaccacaacatcctgcagatcgtggacgtgtgcatggagagcgagaaggaccacaagctgatccagctgatggaggagatcatggccgagaaggagaacaagaccatcatcttcgtggagaccaagagaagatgcgacgacctgaccagaagaatgagaagagacggctggcccgccatgtgcatccacggcgacaagagccagcccgagagagactgggtgctgaacgagttcagaagcggcaaggcccccatcctgatcgccaccgacgtggccagcagaggcctgggcttcgacgtggaggacgtgaagttcgtgatcaactacgactaccccaacagcagcgaggactacgtgcacagaatcggcagaaccgccagaagcaccaacaagggcaccgcctacaccttcttcacccccggcaacctgaagcaggccagagagctgatcaaggtgctggaggaggccaaccaggccatcaaccccaagctgatgcagctggtggaccacagaggcggcggcggcggcggcggcggcagaagcagatacagaaccaccagcagcgccaacaaccccaacctgatgtaccaggacgagtgcgacagaagactgagaggcgtgaaggacggcggcagaagagacagcgccagctacagagacagaagcgagaccgacagagccggctacgccaacggcagcggctacggcagccccaacagcgccttcggcgcccaggccggccagtacacctacggccagggcacctacggcgccgccgcctacggcaccagcagctacaccgcccaggagtacggcgccggcacctacggcgccagcagcaccaccagcaccggcagaagcagccagagcagcagccagcagttcagcggcatcggcagaagcggccagcagccccagcccctgatgagccagcagttcgcccagccccccggcgccaccaacatgatcggctacatgggccagaccgcctaccagtaccccccccccccccccccccccccccccagcagaaagtag

SEQ ID NO: 78520 - DNA, 2196 bp, Artificial Sequence
  Description of Artificial Sequence: Synthetic coding sequence
ctgcccaccggcttcgtggcccccatcctgtgcgtgctgctgcccagccccaccagagaggccgccaccgtggccagcgccaccggcgacagcgccagcgagagagagagcgccgcccccgccgccgcccccaccgccgaggcccccccccccagcgtggtgaccagacccgagccccaggccctgcccagccccgccatcagagcccccctgcccgacctgtaccccttcggcaccatgagaggcggcggcttcggcgacagagacagagacagagacagaggcggcttcggcgccagaggcggcggcggcctgccccccaagaagttcggcaaccccggcgagagactgagaaagaagaagtgggacctgagcgagctgcccaagttcgagaagaacttctacgtggagcaccccgaggtggccagactgaccccctacgaggtggacgagctgagaagaaagaaggagatcaccgtgagaggcggcgacgtgtgccccaagcccgtgttcgccttccaccacgccaacttcccccagtacgtgatggacgtgctgatggaccagcacttcaccgagcccacccccatccagtgccagggcttccccctggccctgagcggcagagacatggtgggcatcgcccagaccggcagcggcaagaccctggcctacctgctgcccgccatcgtgcacatcaaccaccagccctacctggagagaggcgacggccccatctgcctggtgctggcccccaccagagagctggcccagcaggtgcagcaggtggccgacgactacggcaagtgcagcagactgaagagcacctgcatctacggcggcgcccccaagggcccccagatcagagacctggagagaggcgtggagatctgcatcgccacccccggcagactgatcgacttcctggagagcggcaagaccaacctgagaagatgcacctacctggtgctggacgaggccgacagaatgctggacatgggcttcgagccccagatcagaaagatcgtggaccagatcagacccgacagacagaccctgatgtggagcgccacctggcccaaggaggtgagacagctggccgaggacttcctgagagactacacccagatcaacgtgggcaacctggagctgagcgccaaccacaacatcctgcagatcgtggacgtgtgcatggagagcgagaaggaccacaagctgatccagctgatggaggagatcatggccgagaaggagaacaagaccatcatcttcgtggagaccaagagaagatgcgacgacctgaccagaagaatgagaagagacggctggcccgccatgtgcatccacggcgacaagagccagcccgagagagactgggtgctgaacgagttcagaagcggcaaggcccccatcctgatcgccaccgacgtggccagcagaggcctggacgtggaggacgtgaagttcgtgatcaactacgactaccccaacagcagcgaggactacgtgcacagaatcggcagaaccgccagaagcaccaacaagggcaccgcctacaccttcttcacccccggcaacctgaagcaggccagagagctgatcaaggtgctggaggaggccaaccaggccatcaaccccaagctgatgcagctggtggaccacagaggcggcggcggcggcggcggcaagggcggcagaagcagatacagaaccaccagcagcgccaacaaccccaacctgatgtaccaggacgagtgcgacagaagactgagaggcgtgaaggacggcggcagaagagacagcgccagctacagagacagaagcgagaccgacagagccggctacgccaacggcagcggctacggcagccccaacagcgccttcggcgcccaggccggccagtacacctacggccagggcacctacggcgccgccgcctacggcaccagcagctacaccgcccaggagtacggcgccggcacctacggcgccagcagcaccaccagcaccggcagaagcagccagagcagcagccagcagttcagcggcatcggcagaagcggccagcagccccagcccctgatgagccagcagttcgcccagccccccggcgccaccaacatgatcggctacatgggccagaccgcctaccagtaccccccccccccccccccccccccccccagcagaaagtag

SEQ ID NO: 78521 - DNA, 2190 bp, Artificial Sequence
  Description of Artificial Sequence: Synthetic coding sequence
ctgcccaccggcttcgtggcccccatcctgtgcgtgctgctgcccagccccaccagagaggccgccaccgtggccagcgccaccggcgacagcgccagcgagagagagagcgccgcccccgccgccgcccccaccgccgaggcccccccccccagcgtggtgaccagacccgagccccaggccctgcccagccccgccatcagagcccccctgcccgacctgtaccccttcggcaccatgagaggcggcggcttcggcgacagagacagagacagagacagaggcggcttcggcgccagaggcggcggcggcctgccccccaagaagttcggcaaccccggcgagagactgagaaagaagaagtgggacctgagcgagctgcccaagttcgagaagaacttctacgtggagcaccccgaggtggccagactgaccccctacgaggtggacgagctgagaagaaagaaggagatcaccgtgagaggcggcgacgtgtgccccaagcccgtgttcgccttccaccacgccaacttcccccagtacgtgatggacgtgctgatggaccagcacttcaccgagcccacccccatccagtgccagggcttccccctggccctgagcggcagagacatggtgggcatcgcccagaccggcagcggcaagaccctggcctacctgctgcccgccatcgtgcacatcaaccaccagccctacctggagagaggcgacggccccatctgcctggtgctggcccccaccagagagctggcccagcaggtgcagcaggtggccgacgactacggcaagtgcagcagactgaagagcacctgcatctacggcggcgcccccaagggcccccagatcagagacctggagagaggcgtggagatctgcatcgccacccccggcagactgatcgacttcctggagagcggcaagaccaacctgagaagatgcacctacctggtgctggacgaggccgacagaatgctggacatgggcttcgagccccagatcagaaagatcgtggaccagatcagacccgacagacagaccctgatgtggagcgccacctggcccaaggaggtgagacagctggccgaggacttcctgagagactacacccagatcaacgtgggcaacctggagctgagcgccaaccacaacatcctgcagatcgtggacgtgtgcatggagagcgagaaggaccacaagctgatccagctgatggaggagatcatggccgagaaggagaacaagaccatcatcttcgtggagaccaagagaagatgcgacgacctgaccagaagaatgagaagagacggctggcccgccatgtgcatccacggcgacaagagccagcccgagagagactgggtgctgaacgagttcagaagcggcaaggcccccatcctgatcgccaccgacgtggccagcagaggcctggacgtggaggacgtgaagttcgtgatcaactacgactaccccaacagcagcgaggactacgtgcacagaatcggcagaaccgccagaagcaccaacaagggcaccgcctacaccttcttcacccccggcaacctgaagcaggccagagagctgatcaaggtgctggaggaggccaaccaggccatcaaccccaagctgatgcagctggtggaccacagaggcggcggcggcggcggcggcggcagaagcagatacagaaccaccagcagcgccaacaaccccaacctgatgtaccaggacgagtgcgacagaagactgagaggcgtgaaggacggcggcagaagagacagcgccagctacagagacagaagcgagaccgacagagccggctacgccaacggcagcggctacggcagccccaacagcgccttcggcgcccaggccggccagtacacctacggccagggcacctacggcgccgccgcctacggcaccagcagctacaccgcccaggagtacggcgccggcacctacggcgccagcagcaccaccagcaccggcagaagcagccagagcagcagccagcagttcagcggcatcggcagaagcggccagcagccccagcccctgatgagccagcagttcgcccagccccccggcgccaccaacatgatcggctacatgggccagaccgcctaccagtaccccccccccccccccccccccccccccagcagaaagtag

SEQ ID NO: 78522 - DNA, 2214 bp, Artificial Sequence
  Description of Artificial Sequence: Synthetic coding sequence
cccaacctgcccaccggcttcgtggcccccatcctgtgcgtgctgctgcccagccccaccagagaggccgccaccgtggccagcgccaccggcgacagcgccagcgagagagagagcgccgcccccgccgccgcccccaccgccgaggcccccccccccagcgtggtgaccagacccgagccccaggccctgcccagccccgccatcagagcccccctgcccgacctgtaccccttcggcaccatgagaggcggcggcttcggcgacagagacagagacagagacagaggcggcttcggcgccagaggcggcggcggcctgccccccaagaagttcggcaaccccggcgagagactgagaaagaagaagtgggacctgagcgagctgcccaagttcgagaagaacttctacgtggagcaccccgaggtggccagactgaccccctacgaggtggacgagctgagaagaaagaaggagatcaccgtgagaggcggcgacgtgtgccccaagcccgtgttcgccttccaccacgccaacttcccccagtacgtgatggacgtgctgatggaccagcacttcaccgagcccacccccatccagtgccagggcttccccctggccctgagcggcagagacatggtgggcatcgcccagaccggcagcggcaagaccctggcctacctgctgcccgccatcgtgcacatcaaccaccagccctacctggagagaggcgacggccccatctgcctggtgctggcccccaccagagagctggcccagcaggtgcagcaggtggccgacgactacggcaagtgcagcagactgaagagcacctgcatctacggcggcgcccccaagggcccccagatcagagacctggagagaggcgtggagatctgcatcgccacccccggcagactgatcgacttcctggagagcggcaagaccaacctgagaagatgcacctacctggtgctggacgaggccgacagaatgctggacatgggcttcgagccccagatcagaaagatcgtggaccagatcagacccgacagacagaccctgatgtggagcgccacctggcccaaggaggtgagacagctggccgaggacttcctgagagactacacccagatcaacgtgggcaacctggagctgagcgccaaccacaacatcctgcagatcgtggacgtgtgcatggagagcgagaaggaccacaagctgatccagctgatggaggagatcatggccgagaaggagaacaagaccatcatcttcgtggagaccaagagaagatgcgacgacctgaccagaagaatgagaagagacggctggcccgccatgtgcatccacggcgacaagagccagcccgagagagactgggtgctgaacgagttcagaagcggcaaggcccccatcctgatcgccaccgacgtggccagcagaggcctggacgtggaggacgtgaagttcgtgatcaactacgactaccccaacagcagcgaggactacgtgcacagaatcggcagaaccgccagaagcaccaacaagggcaccgcctacaccttcttcacccccggcaacctgaagcaggccagagagctgatcaaggtgctggaggaggccaaccaggccatcaaccccaagctgatgcagctggtggaccacagaggcggcggcggcggcggcggcaagggcggcagaagcagatacagaaccaccagcagcgccaacaaccccaacctgatgtaccaggacgagtgcgacagaagactgagaggcgtgaaggacggcggcagaagagacagcgccagctacagagacagaagcgagaccgacagagccggctacgccaacggcagcggctacggcagccccaacagcgccttcggcgcccaggccggccagtacacctacggccagggcacctacggcgccgccgcctacggcaccagcagctacaccgcccaggagtacggcgccggcacctacggcgccagcagcaccaccagcaccggcagaagcagccagagcagcagccagcagttcagcggcatcggcagaagcggccagcagccccagcccctgatgagccagcagttcgcccagccccccggcgccaccaacaccctgctgctgctgcccctgctgctgctgcacgtgaacgagaccacccaggtggtggtgacccccgccgacctgatcaccttctag

SEQ ID NO: 78523 - DNA, 546 bp, Artificial Sequence
  Description of Artificial Sequence: Synthetic coding sequence
atgcagctggtggaccacagaggcggcggcggcggcggcggcggcagaagcagatacagaaccaccagcagcgccaacaaccccaacctgatgtaccaggacgagtgcgacagaagactgagaggcgtgaaggacggcggcagaagagacagcgccagctacagagacagaagcgagaccgacagagccggctacgccaacggcagcggctacggcagccccaacagcgccttcggcgcccaggccggccagtacacctacggccagggcacctacggcgccgccgcctacggcaccagcagctacaccgcccaggagtacggcgccggcacctacggcgccagcagcaccaccagcaccggcagaagcagccagagcagcagccagcagttcagcggcatcggcagaagcggccagcagccccagcccctgatgagccagcagttcgcccagccccccggcgccaccaacatgatcggctacatgggccagaccgcctaccagtaccccccccccccccccccccccccccccagcagaaagtag

SEQ ID NO: 78524 - DNA, 2013 bp, Artificial Sequence
  Description of Artificial Sequence: Synthetic coding sequence
atgagccacctgcccatgaagctgctgagaaagaagatcgagaagagaaacctgaagctgagacagagaaacctgaagttccagggcgccagcaacctgaccctgagcgagacccagaacggcgacgtgagcgaggagaccatgggcagcagaaaggtgaagaagagcaagcagaagcccatgaacgtgggcctgagcgagacccagaacggcggcatgagccaggaggccgtgggcaacatcaaggtgaccaagagcccccagaagagcaccgtgctgaccaacggcgaggccgccatgcagagcagcaacagcgagagcaagaagaagaagaagaagaagagaaagatggtgaacgacgccgagcccgacaccaagaaggccaagaccgagaacaagggcaagagcgaggaggagagcgccgagaccaccaaggagaccgagaacaacgtggagaagcccgacaacgacgaggacgagagcgaggtgcccagcctgcccctgggcctgaccggcgccttcgaggacaccagcttcgccagcctgtgcaacctggtgaacgagaacaccctgaaggccatcaaggagatgggcttcaccaacatgaccgagatccagcacaagagcatcagacccctgctggagggcagagacctgctggccgccgccaagaccggcagcggcaagaccctggccttcctgatccccgccgtggagctgatcgtgaagctgagattcatgcccagaaacggcaccggcgtgctgatcctgagccccaccagagagctggccatgcagaccttcggcgtgctgaaggagctgatgacccaccacgtgcacacctacggcctgatcatgggcggcagcaacagaagcgccgaggcccagaagctgggcaacggcatcaacatcatcgtggccacccccggcagactgctggaccacatgcagaacacccccggcttcatgtacaagaacctgcagtgcctggtgatcgacgaggccgacagaatcctggacgtgggcttcgaggaggagctgaagcagatcatcaagctgctgcccaccagaagacagaccatgctgttcagcgccacccagaccagaaaggtggaggacctggccagaatcagcctgaagaaggagcccctgtacgtgggcgtggacgacgacaaggccaacgccaccgtggacggcctggagcagggctacgtggtgtgccccagcgagaagagattcctgctgctgttcaccttcctgaagaagaacagaaagaagaagctgatggtgttcttcagcagctgcatgagcgtgaagtaccactacgagctgctgaactacatcgacctgcccgtgctggccatccacggcaagcagaagcagaacaagagaaccaccaccttcttccagttctgcaacgccgacagcggcaccctgctgtgcaccgacgtggccgccagaggcctggacatccccgaggtggactggatcgtgcagtacgacccccccgacgaccccaaggagtacatccacagagtgggcagaaccgccagaggcctgaacggcagaggccacgccctgctgatcctgagacccgaggagctgggcttcctgagatacctgaagcagagcaaggtgcccctgagcgagttcgacttcagctggagcaagatcagcgacatccagagccagctggagaagctgatcgagaagaactacttcctgcacaagagcgcccaggaggcctacaagagctacatcagagcctacgacagccacagcctgaagcagatcttcaacgtgaacaacctgaacctgccccaggtggccctgagcttcggcttcaaggtgccccccttcgtggacctgaacgtgaacagcaacgagggcaagcagaagaagagaggcggcggcggcggcttcggctaccagaagaccaagaaggtggagaagagcaagatcttcaagcacatcagcaagaagagcagcgacagcagacagttcagccactag

SEQ ID NO: 78525 - DNA, 1230 bp, Artificial Sequence
  Description of Artificial Sequence: Synthetic coding sequence
atggagcaggagcagaccttcggcgtgctgaaggagctgatgacccaccacgtgcacacctacggcctgatcatgggcggcagcaacagaagcgccgaggcccagaagctgggcaacggcatcaacatcatcgtggccacccccggcagactgctggaccacatgcagaacacccccggcttcatgtacaagaacctgcagtgcctggtgatcgacgaggccgacagaatcctggacgtgggcttcgaggaggagctgaagcagatcatcaagctgctgcccaccagaagacagaccatgctgttcagcgccacccagaccagaaaggtggaggacctggccagaatcagcctgaagaaggagcccctgtacgtgggcgtggacgacgacaaggccaacgccaccgtggacggcctggagcagggctacgtggtgtgccccagcgagaagagattcctgctgctgttcaccttcctgaagaagaacagaaagaagaagctgatggtgttcttcagcagctgcatgagcgtgaagtaccactacgagctgctgaactacatcgacctgcccgtgctggccatccacggcaagcagaagcagaacaagagaaccaccaccttcttccagttctgcaacgccgacagcggcaccctgctgtgcaccgacgtggccgccagaggcctggacatccccgaggtggactggatcgtgcagtacgacccccccgacgaccccaaggagtacatccacagagtgggcagaaccgccagaggcctgaacggcagaggccacgccctgctgatcctgagacccgaggagctgggcttcctgagatacctgaagcagagcaaggtgcccctgagcgagttcgacttcagctggagcaagatcagcgacatccagagccagctggagaagctgatcgagaagaactacttcctgcacaagagcgcccaggaggcctacaagagctacatcagagcctacgacagccacagcctgaagcagatcttcaacgtgaacaacctgaacctgccccaggtggccctgagcttcggcttcaaggtgccccccttcgtggacctgaacgtgaacagcaacgagggcaagcagaagaagagaggcggcggcggcggcttcggctaccagaagaccaagaaggtggagaagagcaagatcttcaagcacatcagcaagaagagcagcgacagcagacagttcagccactag

SEQ ID NO: 78526 - DNA, 2475 bp, Artificial Sequence
  Description of Artificial Sequence: Synthetic coding sequence
atggccgccgccttcgaggccagcggcgccctggccgccgtggccaccgccatgcccgccgagcacgtggccgtgcaggtgcccgcccccgagcccacccccggccccgtgagaatcctgagaaccgcccaggacctgagcagccccagaaccagaaccggcgacgtgctgctggccgagcccgccgacttcgagagcctgctgctgagcagacccgtgctggagggcctgagagccgccggcttcgagagacccagccccgtgcagctgaaggccatccccctgggcagatgcggcctggacctgatcgtgcaggccaagagcggcaccggcaagacctgcgtgttcagcaccatcgccctggacagcctggtgctggagaacctgagcacccagatcctgatcctggcccccaccagagagatcgccgtgcagatccacagcgtgatcaccgccatcggcatcaagatggagggcctggagtgccacgtgttcatcggcggcacccccctgagccaggacaagaccagactgaagaagtgccacatcgccgtgggcagccccggcagaatcaagcagctgatcgagctggactacctgaaccccggcagcatcagactgttcatcctggacgaggccgacaagctgctggaggagggcagcttccaggagcagatcaactggatctacagcagcctgcccgccagcaagcagatgctggccgtgagcgccacctaccccgagttcctggccaacgccctgaccaagtacatgagagaccccaccttcgtgagactgaacagcagcgaccccagcctgatcggcctgaagcagtactacaaggtggtgaacagctaccccctggcccacaaggtgttcgaggagaagacccagcacctgcaggagctgttcagcagaatccccttcaaccaggccctggtgttcagcaacctgcacagcagagcccagcacctggccgacatcctgagcagcaagggcttccccgccgagtgcatcagcggcaacatgaaccagaaccagagactggacgccatggccaagctgaagcacttccactgcagagtgctgatcagcaccgacctgaccagcagaggcatcgacgccgagaaggtgaacctggtggtgaacctggacgtgcccctggactgggagacctacatgcacagaatcggcagagccggcagattcggcaccctgggcctgaccgtgacctactgctgcagaggcgaggaggagaacatgatgatgagaatcgcccagaagtgcaacatcaacctgctgcccctgcccgaccccatccccagcggcctgatggaggagtgcgtggactgggacgtggaggtgaaggccgccgtgcacacctacggcatcgccagcgtgcccaaccagcccctgaagaagcagatccagaagatcgagagaaccctgcagatccagaaggcccacggcgaccacatggccagcagcagaaacaacagcgtgagcggcctgagcgtgaagagcaagaacaacaccaagcagaagctgcccgtgaagagccacagcgagtgcggcatcatcgagaaggccaccagccccaaggagctgggctgcgacagacagagcgaggagcagatgaagaacagcgtgcagacccccgtggagaacagcaccaacagccagcaccaggtgaaggaggccctgcccgtgagcctgccccagatcccctgcctgagcagcttcaagatccaccagccctacaccctgaccttcgccgagctggtggaggactacgagcactacatcaaggagggcctggagaagcccgtggagatcatcagacactacaccggccccggcgaccagaccgtgaacccccagaacggcttcgtgagaaacaaggtgatcgagcagagagtgcccgtgctggccagcagcagccagagcggcgacagcgagagcgacagcgacagctacagcagcagaaccagcagccagagcaagggcaacaagagctacctggagggcagcagcgacaaccagctgaaggacagcgagagcacccccgtggacgacagaatcagcctggagcagccccccaacggcagcgacacccccaaccccgagaagtaccaggagagccccggcatccagatgaagaccagactgaaggagggcgccagccagagagccaagcagagcagaagaaacctgcccagaagaagcagcttcagactgcagaccgaggcccaggaggacgactggtacgactgccacagagagatcagactgagcttcagcgacacctaccaggactacgaggagtactggagagcctactacagagcctggcaggagtactacgccgccgccagccacagctactactggaacgcccagagacaccccagctggatggccgcctaccacatgaacaccatctacctgcaggagatgatgcacagcaaccagtag

SEQ ID NO: 78527 - DNA, 417 bp, Artificial Sequence
  Description of Artificial Sequence: Synthetic coding sequence
atggccgccgccttcgaggccagcggcgccctggccgccgtggccaccgccatgcccgccgagcacgtggccgtgcaggtgcccgcccccgagcccacccccggccccgtgagaatcctgagaaccgcccaggacctgagcagccccagaaccagaaccggcgacgtgctgctggccgagcccgccgacttcgagagcctgctgctgagcagacccgtgctggagggcctgagagccgccggcttcgagagacccagccccgtgcagctgaaggccatccccctgggcagatgcggcctggacctgatcgtgcaggccaagagcggcaccggcaagacctgcgtgttcagcaccatcgccctggacagcctggtgctggagaacctgagcacccaggccgagctgagcaacagctag

SEQ ID NO: 78528 - DNA, 2352 bp, Artificial Sequence
  Description of Artificial Sequence: Synthetic coding sequence
atgcccggcaagctgagaagcgacgccggcctggagagcgacaccgccatgaagaagggcgagaccctgagaaagcagaccgaggagaaggagaagaaggagaagcccaagagcgacaagaccgaggagatcgccgaggaggaggagaccgtgttccccaaggccaagcaggtgaagaagaaggccgagcccagcgaggtggacatgaacagccccaagagcaagaaggccaagaagaaggaggagcccagccagaacgacatcagccccaagaccaagagcctgagaaagaagaaggagcccatcgagaagaaggtggtgagcagcaagaccaagaaggtgaccaagaacgaggagcccagcgaggaggagatcgacgcccccaagcccaagaagatgaagaaggagaaggagatgaacggcgagaccagagagaagagccccaagctgaagaacggcttcccccaccccgagcccgactgcaaccccagcgaggccgccagcgaggagagcaacagcgagatcgagcaggagatccccgtggagcagaaggagggcgccttcagcaacttccccatcagcgaggagaccatcaagctgctgaagggcagaggcgtgaccttcctgttccccatccaggccaagaccttccaccacgtgtacagcggcaaggacctgatcgcccaggccagaaccggcaccggcaagaccttcagcttcgccatccccctgatcgagaagctgcacggcgagctgcaggacagaaagagaggcagagccccccaggtgctggtgctggcccccaccagagagctggccaaccaggtgagcaaggacttcagcgacatcaccaagaagctgagcgtggcctgcttctacggcggcaccccctacggcggccagttcgagagaatgagaaacggcatcgacatcctggtgggcacccccggcagaatcaaggaccacatccagaacggcaagctggacctgaccaagctgaagcacgtggtgctggacgaggtggaccagatgctggacatgggcttcgccgaccaggtggaggagatcctgagcgtggcctacaagaaggacagcgaggacaacccccagaccctgctgttcagcgccacctgcccccactgggtgttcaacgtggccaagaagtacatgaagagcacctacgagcaggtggacctgatcggcaagaagacccagaagaccgccatcaccgtggagcacctggccatcaagtgccactggacccagagagccgccgtgatcggcgacgtgatcagagtgtacagcggccaccagggcagaaccatcatcttctgcgagaccaagaaggaggcccaggagctgagccagaacagcgccatcaagcaggacgcccagagcctgcacggcgacatcccccagaagcagagagagatcaccctgaagggcttcagaaacggcagcttcggcgtgctggtggccaccaacgtggccgccagaggcctggacatccccgaggtggacctggtgatccagagcagcccccccaaggacgtggagagctacatccacagaagcggcagaaccggcagagccggcagaaccggcgtgtgcatctgcttctaccagcacaaggaggagtaccagctggtgcaggtggagcagaaggccggcatcaagttcaagagaatcggcgtgcccagcgccaccgagatcatcaaggccagcagcaaggacgccatcagactgctggacagcgtgccccccaccgccatcagccacttcaagcagagcgccgagaagctgatcgaggagaagggcgccgtggaggccctggccgccgccctggcccacatcagcggcgccaccagcgtggaccagagaagcctgatcaacagcaacgtgggcttcgtgaccatgatcctgcagtgcagcatcgagatgcccaacatcagctacgcctggaaggagctgaaggagcagctgggcgaggagatcgacagcaaggtgaagggcatggtgttcctgaagggcaagctgggcgtgtgcttcgacgtgcccaccgccagcgtgaccgagatccaggagaagtggcacgacagcagaagatggcagctgagcgtggccaccgagcagcccgagctggagggccccagagagggctacggcggcttcagaggccagagagagggcagcagaggcttcagaggccagagagacggcaacagaagattcagaggccagagagagggcagcagaggccccagaggccagagaagcggcggcggcaacaagagcaacagaagccagaacaagggccagaagagaagcttcagcaaggccttcggccagtag

SEQ ID NO: 78529 - DNA, 249 bp, Artificial Sequence
  Description of Artificial Sequence: Synthetic coding sequence
atgcccggcaagctgagaagcgacgccggcctggagagcgacaccgccatgaagaagggcgagaccctgagaaagcagaccgaggagaaggagaagaaggagaagcccaagagcgacaagaccgaggagatcgccgaggaggaggagaccgtgttccccaaggccaagcaggtgaagaagaaggccgagcccagcgaggtggacatgaacagccccaagagcaagaagaagaagaagaagaagaagtag

SEQ ID NO: 78530 - DNA, 2463 bp, Artificial Sequence
  Description of Artificial Sequence: Synthetic coding sequence
atggccggcgagctggccgacaagaaggacagagacgccagccccagcaaggaggagagaaagagaagcagaacccccgacagagagagagacagagacagagacagaaagagcagccccagcaaggacagaaagagacacagaagcagagacagaagaagaggcggcagcagaagcagaagcagaagcagaagcaagagcgccgagagagagagaagacacaaggagagagagagagacaaggagagagacagaaacaagaaggacagagacagagacaaggacggccacagaagagacaaggacagaaagagaagcagcctgagccccggcagaggcaaggacttcaagagcagaaaggacagagacagcaagaaggacgaggaggacgagcacggcgacaagaagcccaaggcccagcccctgagcctggaggagctgctggccaagaagaaggccgaggaggaggccgaggccaagcccaagttcctgagcaaggccgagagagaggccgaggccctgaagagaagacagcaggaggtggaggagagacagagaatgctggaggaggagagaaagaagagaaagcagttccaggacctgggcagaaagatgctggaggacccccaggagagagagagaagagagagaagagagagaatggagagagagaccaacggcaacgaggacgaggagggcagacagaagatcagagaggagaaggacaagagcaaggagctgcacgccatcaaggagagatacctgggcggcatcaagaagagaagaagaaccagacacctgaacgacagaaagttcgtgttcgagtgggacgccagcgaggacaccagcatcgactacaaccccctgtacaaggagagacaccaggtgcagctgctgggcagaggcttcatcgccggcatcgacctgaagcagcagaagagagagcagagcagattctacggcgacctgatggagaagagaagaaccctggaggagaaggagcaggaggaggccagactgagaaagctgagaaagaaggaggccaagcagagatgggacgacagacactggagccagaagaagctggacgagatgaccgacagagactggagaatcttcagagaggactacagcatcaccaccaagggcggcaagatccccaaccccatcagaagctggaaggacagcagcctgcccccccacatcctggaggtgatcgacaagtgcggctacaaggagcccacccccatccagagacaggccatccccatcggcctgcagaacagagacatcatcggcgtggccgagaccggcagcggcaagaccgccgccttcctgatccccctgctggtgtggatcaccaccctgcccaagatcgacagaatcgaggagagcgaccagggcccctacgccatcatcctggcccccaccagagagctggcccagcagatcgaggaggagaccatcaagttcggcaagcccctgggcatcagaaccgtggccgtgatcggcggcatcagcagagaggaccagggcttcagactgagaatgggctgcgagatcgtgatcgccacccccggcagactgatcgacgtgctggagaacagatacctggtgctgagcagatgcacctacgtggtgctggacgaggccgacagaatgatcgacatgggcttcgagcccgacgtgcagaagatcctggagcacatgcccgtgagcaaccagaagcccgacaccgacgaggccgaggaccccgagaagatgctggccaacttcgagagcggcaagcacaagtacagacagaccgtgatgttcaccgccaccatgccccccgccgtggagagactggccagaagctacctgagaagacccgccgtggtgtacatcggcagcgccggcaagccccacgagagagtggagcagaaggtgttcctgatgagcgagagcgagaagagaaagaagctgctggccatcctggagcagggcttcgacccccccatcatcatcttcgtgaaccagaagaagggctgcgacgtgctggccaagagcctggagaagatgggctacaacgcctgcaccctgcacggcggcaagggccaggagcagagagagttcgccctgagcaacctgaaggccggcgccaaggacatcctggtggccaccgacgtggccggcagaggcatcgacatccaggacgtgagcatggtggtgaactacgacatggccaagaacatcgaggactacatccacagaatcggcagaaccggcagagccggcaagagcggcgtggccatcaccttcctgaccaaggaggacagcgccgtgttctacgagctgaagcaggccatcctggagagccccgtgagcagctgcccccccgagctggccaaccaccccgacgcccagcacaagcccggcaccatcctgaccaagaagagaagagaggagaccatcttcgcctag

SEQ ID NO: 78531 - DNA, 417 bp, Artificial Sequence
  Description of Artificial Sequence: Synthetic coding sequence
atggccggcgagctggccgacaagaaggacagagacgccagccccagcaaggaggagagaaagagaagcagaacccccgacagagagagagacagagacagagacagaaagagcagccccagcaaggacagaaagagacacagaagcagagacagaagaagaggcggcagcagaagcagaagcagaagcagaagcaagagcgccgagagagagagaagacacaaggagagagagagagacaaggagagagacagaaacaagaaggacagagacagagacaaggacggccacagaagagacaaggacagaaagagaagcagcctgagccccggcagaggcaaggacttcaagagcagaaaggacagagacagcaagaaggacgaggaggacgagcacggcgacaagaagcccaagtag

SEQ ID NO: 78532 - DNA, 549 bp, Artificial Sequence
  Description of Artificial Sequence: Synthetic coding sequence
atggccggcgagctggccgacaagaaggacagagacgccagccccagcaaggaggagagaaagagaagcagaacccccgacagagagagagacagagacagagacagaaagagcagccccagcaaggacagaaagagacacagaagcagagacagaagaagaggcggcagcagaagcagaagcagaagcagaagcaagagcgccgagagagagagaagacacaaggagagagagagagacaaggagagagacagaaacaagaaggacagagacagagacaaggacggccacagaagagacaaggacagaaagagaagcagcctgagccccggcagaggcaaggacttcaagagcagaaaggacagagacagcaagaaggacgaggaggacgagcacggcgacaagaagcccaaggcccagcccctgagcctggaggagctgctggccaagaagaaggccgaggaggaggccgaggccaagcccaagttcctgagcaaggccgagagagaggccgaggccctgaagagaagacagcaggaggtggagtag

SEQ ID NO: 78533 - DNA, 2580 bp, Artificial Sequence
  Description of Artificial Sequence: Synthetic coding sequence
atgaagctgaaggacaccaagagcagacccaagcagagcagctgcggcaagttccagaccaagggcatcaaggtggtgggcaagtggaaggaggtgaagatcgaccccaacatgttcgccgacggccagatggacgacctggtgtgcttcgaggagctgaccgactaccagctggtgagccccgccaagaaccccagcagcctgttcagcaaggaggcccccaagagaaaggcccaggccgtgagcgaggaggaggaggaggaggagggcaagagcagcagccccaagaagaagatcaagctgaagaagagcaagaacgtggccaccgagggcaccagcacccagaaggagttcgaggtgaaggaccccgagctggaggcccagggcgacgacatggtgtgcgacgaccccgaggccggcgagatgaccagcgagaacctggtgcagaccgcccccaagaagaagaagaacaagggcaagaagggcctggagcccagccagagcaccgccgccaaggtgcccaagaaggccaagacctggatccccgaggtgcacgaccagaaggccgacgtgagcgcctggaaggacctgttcgtgcccagacccgtgctgagagccctgagcttcctgggcttcagcgcccccacccccatccaggccctgaccctggcccccgccatcagagacaagctggacatcctgggcgccgccgagaccggcagcggcaagaccctggccttcgccatccccatgatccacgccgtgctgcagtggcagaagagaaacgccgcccccccccccagcaacaccgaggccccccccggcgagaccagaaccgaggccggcgccgagaccagaagccccggcaaggccgaggccgagagcgacgccctgcccgacgacaccgtgatcgagagcgaggccctgcccagcgacatcgccgccgaggccagagccaagaccggcggcaccgtgagcgaccaggccctgctgttcggcgacgacgacgccggcgagggccccagcagcctgatcagagagaagcccgtgcccaagcagaacgagaacgaggaggagaacctggacaaggagcagaccggcaacctgaagcaggagctggacgacaagagcgccacctgcaaggcctaccccaagagacccctgctgggcctggtgctgacccccaccagagagctggccgtgcaggtgaagcagcacatcgacgccgtggccagattcaccggcatcaagaccgccatcctggtgggcggcatgagcacccagaagcagcagagaatgctgaacagaagacccgagatcgtggtggccacccccggcagactgtgggagctgatcaaggagaagcactaccacctgagaaacctgagacagctgagatgcctggtggtggacgaggccgacagaatggtggagaagggccacttcgccgagctgagccagctgctggagatgctgaacgacagccagtacaaccccaagagacagaccctggtgttcagcgccaccctgaccctggtgcaccaggcccccgccagaatcctgcacaagaagcacaccaagaagatggacaagaccgccaagctggacctgctgatgcagaagatcggcatgagaggcaagcccaaggtgatcgacctgaccagaaacgaggccaccgtggagaccctgaccgagaccaagatccactgcgagaccgacgagaaggacttctacctgtactacttcctgatgcagtaccccggcagaagcctggtgttcgccaacagcatcagctgcatcaagagactgagcggcctgctgaaggtgctggacatcatgcccctgaccctgcacgcctgcatgcaccagaagcagagactgagaaacctggagcagttcgccagactggaggactgcgtgctgctggccaccgacgtggccgccagaggcctggacatccccaaggtgcagcacgtgatccactaccaggtgcccagaaccagcgagatctacgtgcacagaagcggcagaaccgccagagccaccaacgagggcctgagcctgatgctgatcggccccgaggacgtgatcaacttcaagaagatctacaagaccctgaagaaggacgaggacatccccctgttccccgtgcagaccaagtacatggacgtggtgaaggagagaatcagactggccagacagatcgagaagagcgagtacagaaacttccaggcctgcctgcacaacagctggatcgagcaggccgccgccgccctggagatcgagctggaggaggacatgtacaagggcggcaaggccgaccagcaggaggagagaagaagacagaagcagatgaaggtgctgaagaaggagctgagacacctgctgagccagcccctgttcaccgagagccagaagaccaagtaccccacccagagcggcaagccccccctgctggtgagcgcccccagcaagagcgagagcgccctgagctgcctgagcaagcagaagaagaagaagaccaagaagcccaaggagccccagcccgagcagccccagcccagcaccagcgccaactag

SEQ ID NO: 78534 - DNA, 2415 bp, Artificial Sequence
  Description of Artificial Sequence: Synthetic coding sequence
atgaagctgaaggacaccaagagcagacccaagcagagcagctgcggcaagttccagaccaagggcatcaaggtggtgggcaagtggaaggaggtgaagatcgaccccaacatgttcgccgacggccagatggacgacctggtgtgcttcgaggagctgaccgactaccagctggtgagccccgccaagaaccccagcagcctgttcagcaaggaggcccccaagagaaaggcccaggccgtgagcgaggaggaggaggaggaggagggcaagagcagcagccccaagaagaagatcaagctgaagaagagcaagaacgtggccaccgagggcaccagcacccagaaggagttcgaggtgaaggaccccgagctggaggcccagggcgacgacatggtgtgcgacgaccccgaggccggcgagatgaccagcgagaacctggtgcagaccgcccccaagaagaagaagaacaagggcaagaagggcctggagcccagccagagcaccgccgccatcagagacaagctggacatcctgggcgccgccgagaccggcagcggcaagaccctggccttcgccatccccatgatccacgccgtgctgcagtggcagaagagaaacgccgcccccccccccagcaacaccgaggccccccccggcgagaccagaaccgaggccggcgccgagaccagaagccccggcaaggccgaggccgagagcgacgccctgcccgacgacaccgtgatcgagagcgaggccctgcccagcgacatcgccgccgaggccagagccaagaccggcggcaccgtgagcgaccaggccctgctgttcggcgacgacgacgccggcgagggccccagcagcctgatcagagagaagcccgtgcccaagcagaacgagaacgaggaggagaacctggacaaggagcagaccggcaacctgaagcaggagctggacgacaagagcgccacctgcaaggcctaccccaagagacccctgctgggcctggtgctgacccccaccagagagctggccgtgcaggtgaagcagcacatcgacgccgtggccagattcaccggcatcaagaccgccatcctggtgggcggcatgagcacccagaagcagcagagaatgctgaacagaagacccgagatcgtggtggccacccccggcagactgtgggagctgatcaaggagaagcactaccacctgagaaacctgagacagctgagatgcctggtggtggacgaggccgacagaatggtggagaagggccacttcgccgagctgagccagctgctggagatgctgaacgacagccagtacaaccccaagagacagaccctggtgttcagcgccaccctgaccctggtgcaccaggcccccgccagaatcctgcacaagaagcacaccaagaagatggacaagaccgccaagctggacctgctgatgcagaagatcggcatgagaggcaagcccaaggtgatcgacctgaccagaaacgaggccaccgtggagaccctgaccgagaccaagatccactgcgagaccgacgagaaggacttctacctgtactacttcctgatgcagtaccccggcagaagcctggtgttcgccaacagcatcagctgcatcaagagactgagcggcctgctgaaggtgctggacatcatgcccctgaccctgcacgcctgcatgcaccagaagcagagactgagaaacctggagcagttcgccagactggaggactgcgtgctgctggccaccgacgtggccgccagaggcctggacatccccaaggtgcagcacgtgatccactaccaggtgcccagaaccagcgagatctacgtgcacagaagcggcagaaccgccagagccaccaacgagggcctgagcctgatgctgatcggccccgaggacgtgatcaacttcaagaagatctacaagaccctgaagaaggacgaggacatccccctgttccccgtgcagaccaagtacatggacgtggtgaaggagagaatcagactggccagacagatcgagaagagcgagtacagaaacttccaggcctgcctgcacaacagctggatcgagcaggccgccgccgccctggagatcgagctggaggaggacatgtacaagggcggcaaggccgaccagcaggaggagagaagaagacagaagcagatgaaggtgctgaagaaggagctgagacacctgctgagccagcccctgttcaccgagagccagaagaccaagtaccccacccagagcggcaagccccccctgctggtgagcgcccccagcaagagcgagagcgccctgagctgcctgagcaagcagaagaagaagaagaccaagaagcccaaggagccccagcccgagcagccccagcccagcaccagcgccaactag

SEQ ID NO: 78535 - DNA, 2292 bp, Artificial Sequence
  Description of Artificial Sequence: Synthetic coding sequence
atggacgacctggtgtgcttcgaggagctgaccgactaccagctggtgagccccgccaagaaccccagcagcctgttcagcaaggaggcccccaagagaaaggcccaggccgtgagcgaggaggaggaggaggaggagggcaagagcagcagccccaagaagaagatcaagctgaagaagagcaagaacgtggccaccgagggcaccagcacccagaaggagttcgaggtgaaggaccccgagctggaggcccagggcgacgacatggtgtgcgacgaccccgaggccggcgagatgaccagcgagaacctggtgcagaccgcccccaagaagaagaagaacaagggcaagaagggcctggagcccagccagagcaccgccgccaaggtgcccaagaaggccaagacctggatccccgaggtgcacgaccagaaggccgacgtgagcgcctggaaggacctgttcgtgcccagacccgtgctgagagccctgagcttcctgggcttcagcgcccccacccccatccaggccctgaccctggcccccgccatcagagacaagctggacatcctgggcgccgccgagaccggcagcggcaagaccctggccttcgccatccccatgatccacgccgtgctgcagtggcagaagagaaacgccgcccccccccccagcaacaccgaggccccccccggcgagaccagaaccgaggccggcgccgagaccagaagccccggcaaggccgaggccgagagcgacgccctgcccgacgacaccgtgatcgagagcgaggccctgcccagcgacatcgccgccgaggccagagccaagaccggcggcaccgtgagcgaccaggccctgctgttcggcgacgacgacgccggcgagggccccagcagcctgatcagagagaagcccgtgcccaagcagaacgagaacgaggaggagaacctggacaaggagcagaccggcaacctgaagcaggagctggacgacaagagcgccacctgcaaggcctaccccaagagacccctgctgggcctggtgctgacccccaccagagagctggccgtgcaggtgaagcagcacatcgacgccgtggccagattcaccggcatcaagaccgccatcctggtgggcggcatgagcacccagaagcagcagagaatgctgaacagaagacccgagatcgtggtggccacccccggcagactgtgggagctgatcaaggagaagcactaccacctgagaaacctgagacagctgagatgcctggtggtggacgaggccgacagaatggtggagaagggccacttcgccgagctgagccagctgctggagatgctgaacgacagccagtacaaccccaagagacagaccctggtgttcagcgccaccctgaccctggtgcaccaggcccccgccagaatcctgcacaagaagcacaccaagaagatggacaagaccgccaagctggacctgctgatgcagaagatcggcatgagaggcaagcccaaggtgatcgacctgaccagaaacgaggccaccgtggagaccctgaccgagaccaagatccactgcgagaccgacgagaaggacttctacctgtactacttcctgatgcagtaccccggcagaagcctggtgttcgccaacagcatcagctgcatcaagagactgagcggcctgctgaaggtgctggacatcatgcccctgaccctgcacgcctgcatgcaccagaagcagagactgagaaacctggagcagttcgccagactggaggactgcgtgctgctggccaccgacgtggccgccagaggcctggacatccccaaggtgcagcacgtgatccactaccaggtgcccagaaccagcgagatctacgtgcacagaagcggcagaaccgccagagccaccaacgagggcctgagcctgatgctgatcggccccgaggacgtgatcaacttcaagaagatctacaagaccctgaagaaggacgaggacatccccctgttccccgtgcagaccaagtacatggacgtggtgaaggagagaatcagactggccagacagatcgagaagagcgagtacagaaacttccaggcctgcctgcacaacagctggatcgagcaggccgccgccgccctggagatcgagctggaggaggacatgtacaagggcggcaaggccgaccagcaggaggagagaagaagacagaagcagatgaaggtgctgaagaaggagctgagacacctgctgagccagccccagcccagcaccagcgccaactag

SEQ ID NO: 78536 - DNA, 1458 bp, Artificial Sequence
  Description of Artificial Sequence: Synthetic coding sequence
atgaccaaggccccctgcaaggcctaccccaagagacccctgctgggcctggtgctgacccccaccagagagctggccgtgcaggtgaagcagcacatcgacgccgtggccagattcaccggcatcaagaccgccatcctggtgggcggcatgagcacccagaagcagcagagaatgctgaacagaagacccgagatcgtggtggccacccccggcagactgtgggagctgatcaaggagaagcactaccacctgagaaacctgagacagctgagatgcctggtggtggacgaggccgacagaatggtggagaagggccacttcgccgagctgagccagctgctggagatgctgaacgacagccagtacaaccccaagagacagaccctggtgttcagcgccaccctgaccctggtgcaccaggcccccgccagaatcctgcacaagaagcacaccaagaagatggacaagaccgccaagctggacctgctgatgcagaagatcggcatgagaggcaagcccaaggtgatcgacctgaccagaaacgaggccaccgtggagaccctgaccgagaccaagatccactgcgagaccgacgagaaggacttctacctgtactacttcctgatgcagtaccccggcagaagcctggtgttcgccaacagcatcagctgcatcaagagactgagcggcctgctgaaggtgctggacatcatgcccctgaccctgcacgcctgcatgcaccagaagcagagactgagaaacctggagcagttcgccagactggaggactgcgtgctgctggccaccgacgtggccgccagaggcctggacatccccaaggtgcagcacgtgatccactaccaggtgcccagaaccagcgagatctacgtgcacagaagcggcagaaccgccagagccaccaacgagggcctgagcctgatgctgatcggccccgaggacgtgatcaacttcaagaagatctacaagaccctgaagaaggacgaggacatccccctgttccccgtgcagaccaagtacatggacgtggtgaaggagagaatcagactggccagacagatcgagaagagcgagtacagaaacttccaggcctgcctgcacaacagctggatcgagcaggccgccgccgccctggagatcgagctggaggaggacatgtacaagggcggcaaggccgaccagcaggaggagagaagaagacagaagcagatgaaggtgctgaagaaggagctgagacacctgctgagccagcccctgttcaccgagagccagaagaccaagtaccccacccagagcggcaagccccccctgctggtgagcgcccccagcaagagcgagagcgccctgagctgcctgagcaagcagaagaagaagaagaccaagaagcccaaggagccccagcccgagcagccccagcccagcaccagcgccaactag

SEQ ID NO: 78537 - DNA, 1623 bp, Artificial Sequence
  Description of Artificial Sequence: Synthetic coding sequence
atggccctgaccagacccgtgagactgttcagcctggtgaccagactgctgctggcccccagaagaggcctgaccgtgagaagccccgacgagcccctgcccgtggtgagaatccccgtggccctgcagagacagctggagcagagacagagcagaagaagaaacctgcccagacccgtgctggtgagacccggccccctgctggtgagcgccagaagacccgagctgaaccagcccgccagactgaccctgggcagatgggagagagcccccctggccagccagggctggaagagcagaagagccagaagagaccacttcagcatcgagagagcccagcaggaggcccccgccgtgagaaagctgagcagcaagggcagcttcgccgacctgggcctggagcccagagtgctgcacgccctgcaggaggccgcccccgaggtggtgcagcccaccaccgtgcagagcagcaccatccccagcctgctgagaggcagacacgtggtgtgcgccgccgagaccggcagcggcaagaccctgagctacctgctgcccctgctgcagagactgctgggccagcccagcctggacagcctgcccatccccgcccccagaggcctggtgctggtgcccagcagagagctggcccagcaggtgagagccgtggcccagcccctgggcagaagcctgggcctgctggtgagagacctggagggcggccacggcatgagaagaatcagactgcagctgagcagacagcccagcgccgacgtgctggtggccacccccggcgccctgtggaaggccctgaagagcagactgatcagcctggagcagctgagcttcctggtgctggacgaggccgacaccctgctggacgagagcttcctggagctggtggactacatcctggagaagagccacatcgccgagggccccgccgacctggaggaccccttcaaccccaaggcccagctggtgctggtgggcgccaccttccccgagggcgtgggccagctgctgaacaaggtggccagccccgacgccgtgaccaccatcaccagcagcaagctgcactgcatcatgccccacgtgaagcagaccttcctgagactgaagggcgccgacaaggtggccgagctggtgcacatcctgaagcacagagacagagccgagagaaccggccccagcggcaccgtgctggtgttctgcaacagcagcagcaccgtgaactggctgggctacatcctggacgaccacaagatccagcacctgagactgcagggccagatgcccgccctgatgagagtgggcatcttccagagcttccagaagagcagcagagacatcctgctgtgcaccgacatcgccagcagaggcctggacagcaccggcgtggagctggtggtgaactacgacttcccccccaccctgcaggactacatccacagagccggcagagtgggcagagtgggcagcgaggtgcccggcaccgtgatcagcttcgtgacccacccctgggacgtgagcctggtgcagaagatcgagctggccgccagaagaagaagaagcctgcccggcctggccagcagcgtgaaggagcccctgccccaggccacctag

SEQ ID NO: 78538 - DNA, 1989 bp, Artificial Sequence
  Description of Artificial Sequence: Synthetic coding sequence
atgagccacgtggccgtggagaacgccctgggcctggaccagcagttcgccggcctggacctgaacagcagcgacaaccagagcggcggcagcaccgccagcaagggcagatacatccccccccacctgagaaacagagaggccaccaagggcttctacgacaaggacagcagcggctggagcagcagcaaggacaaggacgcctacagcagcttcggcagcagaagcgacagcagaggcaagagcagcttcttcagcgacagaggcagcggcagcagaggcagattcgacgacagaggcagaagcgactacgacggcatcggcagcagaggcgacagaagcggcttcggcaagttcgagagaggcggcaacagcagatggtgcgacaagagcgacgaggacgactggagcaagcccctgccccccagcgagagactggagcaggagctgttcagcggcggcaacaccggcatcaacttcgagaagtacgacgacatccccgtggaggccaccggcaacaactgccccccccacatcgagagcttcagcgacgtggagatgggcgagatcatcatgggcaacatcgagctgaccagatacaccagacccacccccgtgcagaagcacgccatccccatcatcaaggagaagagagacctgatggcctgcgcccagaccggcagcggcaagaccgccgccttcctgctgcccatcctgagccagatctacagcgacggccccggcgaggccctgagagccatgaaggagaacggcagatacggcagaagaaagcagtaccccatcagcctggtgctggcccccaccagagagctggccgtgcagatctacgaggaggccagaaagttcagctacagaagcagagtgagaccctgcgtggtgtacggcggcgccgacatcggccagcagatcagagacctggagagaggctgccacctgctggtggccacccccggcagactggtggacatgatggagagaggcaagatcggcctggacttctgcaagtacctggtgctggacgaggccgacagaatgctggacatgggcttcgagccccagatcagaagaatcgtggagcaggacaccatgccccccaagggcgtgagacacaccatgatgttcagcgccaccttccccaaggagatccagatgctggccagagacttcctggacgagtacatcttcctggccgtgggcagagtgggcagcaccagcgagaacatcacccagaaggtggtgtgggtggaggagagcgacaagagaagcttcctgctggacctgctgaacgccaccggcaaggacagcctgaccctggtgttcgtggagaccaagaagggcgccgacagcctggaggacttcctgtaccacgagggctacgcctgcaccagcatccacggcgacagaagccagagagacagagaggaggccctgcaccagttcagaagcggcaagagccccatcctggtggccaccgccgtggccgccagaggcctggacatcagcaacgtgaagcacgtgatcaacttcgacctgcccagcgacatcgaggagtacgtgcacagaatcggcagaaccggcagagtgggcaacctgggcctggccaccagcttcttcaacgagagaaacatcaacatcaccaaggacctgctggacctgctggtggaggccaagcaggaggtgcccagctggctggagaacatggcctacgagcaccactacaagggcagcagcagaggcagaagcaagagcagcagattcagcggcggcttcggcgccagagactacagacagagcagcggcgccagcagcagcagcttcagcagcagcagagccagcagcagcagaagcggcggcggcggccacggcagcagcagaggcttcggcggcggcggctacggcggcttctacaacagcgacggctacggcggcaactacaacagccagggcgtggactggtggggcaactag

SEQ ID NO: 78539 - DNA, 420 bp, Artificial Sequence
  Description of Artificial Sequence: Synthetic coding sequence
atgagccacgtggccgtggagaacgccctgggcctggaccagcagttcgccggcctggacctgaacagcagcgacaaccagagcggcggcagcaccgccagcaagggcagatacatccccccccacctgagaaacagagaggccaccaagggcttctacgacaaggacagcagcggctggagcagcagcaaggacaaggacgcctacagcagcttcggcagcagaagcgacagcagaggcaagagcagcttcttcagcgacagaggcagcggcagcagaggcagattcgacgacagaggcagaagcgactacgacggcatcggcagcagaggcgacagaagcggctacggcggcttctacaacagcgacggctacggcggcaactacaacagccagggcgtggactggtggggcaactag

SEQ ID NO: 78540 - DNA, 1941 bp, Artificial Sequence
  Description of Artificial Sequence: Synthetic coding sequence
atgagccacgtggccgtggagaacgccctgggcctggaccagcagttcgccggcctggacctgaacagcagcgacaaccagagcggcggcagcaccgccagcagcttctacgacaaggacagcagcggctggagcagcagcaaggacaaggacgcctacagcagcttcggcagcagaagcgacagcagaggcaagagcagcttcttcagcgacagaggcagcggcagcagaggcagattcgacgacagaggcagaagcgactacgacggcatcggcagcagaggcgacagaagcggcttcggcaagttcgagagaggcggcaacagcagatggtgcgacaagagcgacgaggacgactggagcaagcccctgccccccagcgagagactggagcaggagctgttcagcggcggcaacaccggcatcaacttcgagaagtacgacgacatccccgtggaggccaccggcaacaactgccccccccacatcgagagcttcagcgacgtggagatgggcgagatcatcatgggcaacatcgagctgaccagatacaccagacccacccccgtgcagaagcacgccatccccatcatcaaggagaagagagacctgatggcctgcgcccagaccggcagcggcaagaccgccgccttcctgctgcccatcctgagccagatctacagcgacggccccggcgaggccctgagagccatgaaggagaacggcagatacggcagaagaaagcagtaccccatcagcctggtgctggcccccaccagagagctggccgtgcagatctacgaggaggccagaaagttcagctacagaagcagagtgagaccctgcgtggtgtacggcggcgccgacatcggccagcagatcagagacctggagagaggctgccacctgctggtggccacccccggcagactggtggacatgatggagagaggcaagatcggcctggacttctgcaagtacctggtgctggacgaggccgacagaatgctggacatgggcttcgagccccagatcagaagaatcgtggagcaggacaccatgccccccaagggcgtgagacacaccatgatgttcagcgccaccttccccaaggagatccagatgctggccagagacttcctggacgagtacatcttcctggccgtgggcagagtgggcagcaccagcgagaacatcacccagaaggtggtgtgggtggaggagagcgacaagagaagcttcctgctggacctgctgaacgccaccggcaaggacagcctgaccctggtgttcgtggagaccaagaagggcgccgacagcctggaggacttcctgtaccacgagggctacgcctgcaccagcatccacggcgacagaagccagagagacagagaggaggccctgcaccagttcagaagcggcaagagccccatcctggtggccaccgccgtggccgccagaggcctggacatcagcaacgtgaagcacgtgatcaacttcgacctgcccagcgacatcgaggagtacgtgcacagaatcggcagaaccggcagagtgggcaacctgggcctggccaccagcttcttcaacgagagaaacatcaacatcaccaaggacctgctggacctgctggtggaggccaagcaggaggtgcccagctggctggagaacatggcctacgagcaccactacaagggcagcagcagaggcagaagcaagagcagcagattcagcggcggcttcggcgccagagactacagacagagcagcggcgccagcagcagcagcttcagcagcagcagagccagcagcagcagaagcggcggcggcggccacggcagcagcagaggcttcggcggcggcggctacggcggcttctacaacagcgacggctacggcggcaactacaacagccagggcgtggactggtggggcaactag

SEQ ID NO: 78541 - DNA, 927 bp, Artificial Sequence
  Description of Artificial Sequence: Synthetic coding sequence
atgagagagagcagactgatcagcgacctgggcggcttcgccggcgtgagaagcgccgccggcagagactggagacccttctggctgggcggcctgagacccagcagactggcccagcccggcttccccagcggcggccccggcggcaccagatgcctgagagcctgcgagcagggcttcgccggcctggacctgaacagcagcgacaaccagagcggcggcagcaccgccagcaagggcagatacatccccccccacctgagaaacagagaggccaccaagggcttctacgacaaggacagcagcggctggagcagcagcaaggacaaggacgcctacagcagcttcggcagcagaagcgacagcagaggcaagagcagcttcttcagcgacagaggcagcggcagcagaggcagattcgacgacagaggcagaagcgactacgacggcatcggcagcagaggcgacagaagcggcttcggcaagttcgagagaggcggcaacagcagatggtgcgacaagagcgacgaggacgactggagcaagcccctgccccccagcgagagactggagcaggagctgttcagcggcggcaacaccggcatcaacttcgagaagtacgacgacatccccgtggaggccaccggcaacaactgccccccccacatcgagagcttcagcgacgtggagatgggcgagatcatcatgggcaacatcgagctgaccagatacaccagacccacccccgtgcagaagcacgccatccccatcatcaaggagaagagagacctgatggcctgcgcccagaccggcaagtggaaggtgtgggccccccagaccatccccaacctgctgggcatcagcaccaacgagagagtgggcagcaccgacctgagaggcagccagaagatcttcatccccatctag

SEQ ID NO: 78542 - DNA, 1983 bp, Artificial Sequence
  Description of Artificial Sequence: Synthetic coding sequence
atgagccacgtggtggtgaagaacgaccccgagctggaccagcagctggccaacctggacctgaacagcgagaagcagagcggcggcgccagcaccgccagcaagggcagatacatccccccccacctgagaaacagagaggccagcaagggcttccacgacaaggacagcagcggctggagctgcagcaaggacaaggacgcctacagcagcttcggcagcagagacagcagaggcaagcccggctacttcagcgagagaggcagcggcagcagaggcagattcgacgacagaggcagaagcgactacgacggcatcggcaacagagagagacccggcttcggcagattcgagagaagcggccacagcagatggtgcgacaagagcgtggaggacgactggagcaagcccctgccccccagcgagagactggagcaggagctgttcagcggcggcaacaccggcatcaacttcgagaagtacgacgacatccccgtggaggccaccggcagcaactgccccccccacatcgagaacttcagcgacatcgacatgggcgagatcatcatgggcaacatcgagctgaccagatacaccagacccacccccgtgcagaagcacgccatccccatcatcaagggcaagagagacctgatggcctgcgcccagaccggcagcggcaagaccgccgccttcctgctgcccatcctgagccagatctacaccgacggccccggcgaggccctgaaggccgtgaaggagaacggcagatacggcagaagaaagcagtaccccatcagcctggtgctggcccccaccagagagctggccgtgcagatctacgaggaggccagaaagttcagctacagaagcagagtgagaccctgcgtggtgtacggcggcgccgacatcggccagcagatcagagacctggagagaggctgccacctgctggtggccacccccggcagactggtggacatgatggagagaggcaagatcggcctggacttctgcaagtacctggtgctggacgaggccgacagaatgctggacatgggcttcgagccccagatcagaagaatcgtggagcaggacaccatgccccccaagggcgtgagacacaccatgatgttcagcgccaccttccccaaggagatccagatgctggccagagacttcctggacgagtacatcttcctggccgtgggcagagtgggcagcaccagcgagaacatcacccagaaggtggtgtgggtggaggacctggacaagagaagcttcctgctggacatcctgggcgccaccggcagcgacagcctgaccctggtgttcgtggagaccaagaagggcgccgacagcctggaggacttcctgtaccacgagggctacgcctgcaccagcatccacggcgacagaagccagagagacagagaggaggccctgcaccagttcagaagcggcaagagccccatcctggtggccaccgccgtggccgccagaggcctggacatcagcaacgtgagacacgtgatcaacttcgacctgcccagcgacatcgaggagtacgtgcacagaatcggcagaaccggcagagtgggcaacctgggcctggccaccagcttcttcaacgagaagaacatgaacatcaccaaggacctgctggacctgctggtggaggccaagcaggaggtgcccagctggctggagaacatggcctacgagcaccactacaagggcggcagcagaggcagaagcaagagcaacagattcagcggcggcttcggcgccagagactacagacagagcagcggcagcagcagcagcggcttcggcgccagcagaggcagcagcagcagaagcggcggcggcggctacggcaacagcagaggcttcggcggcggcggctacggcggcttctacaacagcgacggctacggcggcaactacaacagccagggcgtggactggtggggcaactag

SEQ ID NO: 78543 - DNA, 1983 bp, Artificial Sequence; identical to SEQ ID NO: 78542
  Description of Artificial Sequence: Synthetic coding sequence

SEQ ID NO: 78544 - DNA, 753 bp, Artificial Sequence
  Description of Artificial Sequence: Synthetic coding sequence
atggagatcggcagacccagaaaggacacctggaagctggccaacctggacctgaacagcgagaagcagagcggcggcgccagcaccgccagcaagggcagatacatccccccccacctgagaaacagagaggccagcaagggcttccacgacaaggacagcagcggctggagctgcagcaaggacaaggacgcctacagcagcttcggcagcagagacagcagaggcaagcccggctacttcagcgagagaggcagcggcagcagaggcagattcgacgacagaggcagaagcgactacgacggcatcggcaacagagagagacccggcttcggcagattcgagagaagcggccacagcagatggtgcgacaagagcgtggaggacgactggagcaagcccctgccccccagcgagagactggagcaggagctgttcagcggcggcaacaccggcatcaacttcgagaagtacgacgacatccccgtggaggccaccggcagcaactgccccccccacatcgagaacttcagcgacatcgacatgggcgagatcatcatgggcaacatcgagctgaccagatacaccagacccacccccgtgcagaagcacgccatccccatcatcaagggcaagagagacctgatggcctgcgcccagaccggcagcggcaagaccgccgccttcctgctgcccatcctgagccagatctacaccgacggccccggcgaggccctgaaggccgtgaagtag

SEQ ID NO: 78545 - DNA, 675 bp, Artificial Sequence
  Description of Artificial Sequence: Synthetic coding sequence
atgagccacgtggtggtgaagaacgaccccgagctggaccagcagctggccaacctggacctgaacagcgagaagcagagcggcggcgccagcaccgccagcaagggcagatacatccccccccacctgagaaacagagaggccagcaagggcttccacgacaaggacagcagcggctggagctgcagcaaggacaaggacgcctacagcagcttcggcagcagagacagcagaggcaagcccggctacttcagcgagagaggcagcggcagcagaggcagattcgacgacagaggcagaagcgactacgacggcatcggcaacagagagagacccggcttcggcagattcgagagaagcggccacagcagatggtgcgacaagagcgtggaggacgactggagcaagcccctgccccccagcgagagactggagcaggagctgttcagcggcggcaacaccggcatcaacttcgagaagtacgacgacatccccgtggaggccaccggcagcaactgccccccccacatcgagaacttcagcgacatcgacatgggcgagatcatcatgggcaacatcgagctgaccagatacaccagacccacccccgtgcagaagcacgccatccccatcatcaagggcaagagagacctgatggcctgcgcccagacctag

SEQ ID NO: 78546 - DNA, 1974 bp, Artificial Sequence
  Description of Artificial Sequence: Synthetic coding sequence
atggagatcggcagacccagaaaggacacctggaagctggccaacctggacctgaacagcgagaagcagagcggcggcgccagcaccgccagcaagggcagatacatccccccccacctgagaaacagagaggccagcaagggcttccacgacaaggacagcagcggctggagctgcagcaaggacaaggacgcctacagcagcttcggcagcagagacagcagaggcaagcccggctacttcagcgagagaggcagcggcagcagaggcagattcgacgacagaggcagaagcgactacgacggcatcggcaacagagagagacccggcttcggcagattcgagagaagcggccacagcagatggtgcgacaagagcgtggaggacgactggagcaagcccctgccccccagcgagagactggagcaggagctgttcagcggcggcaacaccggcatcaacttcgagaagtacgacgacatccccgtggaggccaccggcagcaactgccccccccacatcgagaacttcagcgacatcgacatgggcgagatcatcatgggcaacatcgagctgaccagatacaccagacccacccccgtgcagaagcacgccatccccatcatcaagggcaagagagacctgatggcctgcgcccagaccggcagcggcaagaccgccgccttcctgctgcccatcctgagccagatctacaccgacggccccggcgaggccctgaaggccgtgaaggagaacggcagatacggcagaagaaagcagtaccccatcagcctggtgctggcccccaccagagagctggccgtgcagatctacgaggaggccagaaagttcagctacagaagcagagtgagaccctgcgtggtgtacggcggcgccgacatcggccagcagatcagagacctggagagaggctgccacctgctggtggccacccccggcagactggtggacatgatggagagaggcaagatcggcctggacttctgcaagtacctggtgctggacgaggccgacagaatgctggacatgggcttcgagccccagatcagaagaatcgtggagcaggacaccatgccccccaagggcgtgagacacaccatgatgttcagcgccaccttccccaaggagatccagatgctggccagagacttcctggacgagtacatcttcctggccgtgggcagagtgggcagcaccagcgagaacatcacccagaaggtggtgtgggtggaggacctggacaagagaagcttcctgctggacatcctgggcgccaccggcagcgacagcctgaccctggtgttcgtggagaccaagaagggcgccgacagcctggaggacttcctgtaccacgagggctacgcctgcaccagcatccacggcgacagaagccagagagacagagaggaggccctgcaccagttcagaagcggcaagagccccatcctggtggccaccgccgtggccgccagaggcctggacatcagcaacgtgagacacgtgatcaacttcgacctgcccagcgacatcgaggagtacgtgcacagaatcggcagaaccggcagagtgggcaacctgggcctggccaccagcttcttcaacgagaagaacatgaacatcaccaaggacctgctggacctgctggtggaggccaagcaggaggtgcccagctggctggagaacatggcctacgagcaccactacaagggcggcagcagaggcagaagcaagagcaacagattcagcggcggcttcggcgccagagactacagacagagcagcggcagcagcagcagcggcttcggcgccagcagaggcagcagcagcagaagcggcggcggcggctacggcaacagcagaggcttcggcggcggcggctacggcggcttctacaacagcgacggctacggcggcaactacaacagccagggcgtggactggtggggcaactag

SEQ ID NO: 78547 - DNA, 1278 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagactgagcagataccagcagttcaaggacttccagagaagaatcctggtggccaccaacctgttcggcagaggcatggacatcgagagagtgaacatcgccttcaactacgacatgcccgaggacagcgacacctacctgcacagatgctaccccctgagccccagcagatggcccgagcaggccggcctggcccccagagcctggctgagccacctgtgccccatgagaatgatgcccagaagcagcatgatgtgcagaatcgccctgagaagcatcctggtgagctgcctgatgagatag

SEQ ID NO: 78548 - DNA, 1287 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagactgagcagataccagcagttcaaggacttccagagaagaatcctggtggccaccaacctgttcggcagaggcatggacatcgagagagtgaacatcgccttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacatcagcgagctgcccgacgagatcgacatcagcagctacatcgagcagaccagatag

SEQ ID NO: 78549 - DNA, 1287 bp, Artificial Sequence; identical to SEQ ID NO: 78548
  Description of Artificial Sequence: Synthetic coding sequence

SEQ ID NO: 78550 - DNA, 1278 bp, Artificial Sequence; identical to SEQ ID NO: 78547
  Description of Artificial Sequence: Synthetic coding sequence

SEQ ID NO: 78551 - DNA, 1287 bp, Artificial Sequence; identical to SEQ ID NO: 78548
  Description of Artificial Sequence: Synthetic coding sequence

SEQ ID NO: 78552 - DNA, 1287 bp, Artificial Sequence; identical to SEQ ID NO: 78548
  Description of Artificial Sequence: Synthetic coding sequence

SEQ ID NO: 78553 - DNA, 564 bp, Artificial Sequence
  Description of Artificial Sequence: Synthetic coding sequence
atgggcagcagccacatcggcggcctgagcatcaacgagagaagatgcagcgccagcctgggcctggtgatggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactag

SEQ ID NO: 78554 - DNA, 1287 bp, Artificial Sequence; identical to SEQ ID NO: 78548
  Description of Artificial Sequence: Synthetic coding sequence

SEQ ID NO: 78555 - DNA, 378 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctgtag

SEQ ID NO: 78556 - DNA, 1287 bp, Artificial Sequence; identical to SEQ ID NO: 78548
  Description of Artificial Sequence: Synthetic coding sequence

SEQ ID NO: 78557 - DNA, 564 bp, Artificial Sequence
  Description of Artificial Sequence: Synthetic coding sequence
tgaagcgaggagagagacatcggcaagcccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagactgagcagataccagcagttcaaggacttccagagaagaatcctggtggccaccaacctgttcggcagaggcatggacatcgagagagtgaacatcgccttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacatcagcgagctgcccgacgagatcgacatcagcagctactag

SEQ ID NO: 78558 - DNA, 378 bp, Artificial Sequence; identical to SEQ ID NO: 78555
  Description of Artificial Sequence: Synthetic coding sequence

SEQ ID NO: 78559 - DNA, 1287 bp, Artificial Sequence; identical to SEQ ID NO: 78548
  Description of Artificial Sequence: Synthetic coding sequence

SEQ ID NO: 78560 - DNA, 870 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccagtag

SEQ ID NO: 78561 - DNA, 1287 bp, Artificial Sequence; identical to SEQ ID NO: 78548
  Description of Artificial Sequence: Synthetic coding sequence

SEQ ID NO: 78562 - DNA, 291 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagacctag

SEQ ID NO: 78563 - DNA, 378 bp, Artificial Sequence; identical to SEQ ID NO: 78555
  Description of Artificial Sequence: Synthetic coding sequence

SEQ ID NO: 78564 - DNA, 696 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgtag

SEQ ID NO: 78565 - DNA, 399 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgtgcttctgcgacagccacttccccagaggcgacaacgaggagctgcacctgccctag

SEQ ID NO: 78566 - DNA, 1053 bp, Artificial Sequence
  Description of Artificial Sequence: Synthetic coding sequence
atgtggaccatgagcagctggaccatgaagatgatgagatggagacagcagctgggcgagatgggcctgagacccctgcccagaagaatgagcagagcccccatgagccccagcaccgccctggccttcgtgaccagctgcagcagccagagctgcagcggccccctgagcaccgtggccctgagcatcagacagaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagactgagcagataccagcagttcaaggacttccagagaagaatcctggtggccaccaacctgttcggcagaggcatggacatcgagagagtgaacatcgccttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacatcagcgagctgcccgacgagatcgacatcagcagctacatcgagcagaccagatag

SEQ ID NO: 78567 - DNA, 738 bp, Artificial Sequence
  Description of Artificial Sequence: Synthetic coding sequence
atgtggaccatgagcagctggaccatgaagatgatgagatggagacagcagctgggcgagatgggcctgagacccctgcccagaagaatgagcagagcccccatgagccccagcaccgccctggccttcgtgaccagctgcagcagccagagctgcagcggccccctgagcaccgtggccctgagcatcagacagaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccagtag

SEQ ID NO: 78568 - DNA, 411 bp, Artificial Sequence
  Description of Artificial Sequence: Synthetic coding sequence
atgggcggcggcagaagaccctacgacgtgttcttcagcaaggtgatggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccactag

SEQ ID NO: 78569 - DNA, 1287 bp, Artificial Sequence; identical to SEQ ID NO: 78548
  Description of Artificial Sequence: Synthetic coding sequence

SEQ ID NO: 78570 - DNA, 594 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgtgcttctgcgacagccacttccccagaggcgacaacgaggagctgcacctgccctacgtgagcgtgtacttcctgcccaaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtgtag

SEQ ID NO: 78571 - DNA, 570 bp, Artificial Sequence
  Description of Artificial Sequence: Synthetic coding sequence
tgagccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccagtag

SEQ ID NO: 78572 - DNA, 1287 bp, Artificial Sequence; identical to SEQ ID NO: 78548
  Description of Artificial Sequence: Synthetic coding sequence

SEQ ID NO: 78573 - DNA, 711 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagatag

SEQ ID NO: 78574 - DNA, 564 bp, Artificial Sequence
  Description of Artificial Sequence: Synthetic coding sequence
atgggcagcagccacatcggcggcctgagcatcaacgagagaagaagaagcgccagcctgggcctggtgatggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactag

SEQ ID NO: 78575 - DNA, 399 bp, Artificial Sequence; identical to SEQ ID NO: 78565
  Description of Artificial Sequence: Synthetic coding sequence

SEQ ID NO: 78576 - DNA, 1332 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgtacctgggcagagtgctgggcagaggcttctggtgcgtgttcgtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagactgagcagataccagcagttcaaggacttccagagaagaatcctggtggccaccaacctgttcggcagaggcatggacatcgagagagtgaacatcgccttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacatcagcgagctgcccgacgagatcgacatcagcagctacatcgagcagaccagatag

SEQ ID NO: 78577 - DNA, 870 bp, Artificial Sequence; identical to SEQ ID NO: 78560
  Description of Artificial Sequence: Synthetic coding sequence

SEQ ID NO: 78578 - DNA, 564 bp, Artificial Sequence; identical to SEQ ID NO: 78557
  Description of Artificial Sequence: Synthetic coding sequence

SEQ ID NO: 78579 - DNA, 411 bp, Artificial Sequence; identical to SEQ ID NO: 78568
  Description of Artificial Sequence: Synthetic coding sequence

SEQ ID NO: 78580 - DNA, 411 bp, Artificial Sequence; identical to SEQ ID NO: 78568
  Description of Artificial Sequence: Synthetic coding sequence

SEQ ID NO: 78581 - DNA, 399 bp, Artificial Sequence; identical to SEQ ID NO: 78565
  Description of Artificial Sequence: Synthetic coding sequence

SEQ ID NO: 78582 - DNA, 711 bp, Artificial Sequence; identical to SEQ ID NO: 78573
  Description of Artificial Sequence: Synthetic coding sequence

SEQ ID NO: 78583 - DNA, 378 bp, Artificial Sequence; identical to SEQ ID NO: 78555
  Description of Artificial Sequence: Synthetic coding sequence

SEQ ID NO: 78584 - DNA, 987 bp, Artificial Sequence
  Description of Artificial Sequence: Synthetic coding sequence
tgagccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagactgagcagataccagcagttcaaggacttccagagaagaatcctggtggccaccaacctgttcggcagaggcatggacatcgagagagtgaacatcgccttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacatcagcgagctgcccgacgagatcgacatcagcagctacatcgagcagaccagatag

SEQ ID NO: 78585 - DNA, 711 bp, Artificial Sequence; identical to SEQ ID NO: 78573
  Description of Artificial Sequence: Synthetic coding sequence

SEQ ID NO: 78586 - DNA, 564 bp, Artificial Sequence; identical to SEQ ID NO: 78557
  Description of Artificial Sequence: Synthetic coding sequence

SEQ ID NO: 78587 - DNA, 378 bp, Artificial Sequence; identical to SEQ ID NO: 78555
  Description of Artificial Sequence: Synthetic coding sequence

SEQ ID NO: 78588 - DNA, 291 bp, Artificial Sequence; identical to SEQ ID NO: 78562
  Description of Artificial Sequence: Synthetic coding sequence

SEQ ID NO: 78589 - DNA, 378 bp, Artificial Sequence; identical to SEQ ID NO: 78555
  Description of Artificial Sequence: Synthetic coding sequence

SEQ ID NO: 78590 - DNA, 987 bp, Artificial Sequence; identical to SEQ ID NO: 78584
  Description of Artificial Sequence: Synthetic coding sequence

SEQ ID NO: 78591 - DNA, 870 bp, Artificial Sequence; identical to SEQ ID NO: 78560
  Description of Artificial Sequence: Synthetic coding sequence

SEQ ID NO: 78592 - DNA, 738 bp, Artificial Sequence; identical to SEQ ID NO: 78567
  Description of Artificial Sequence: Synthetic coding sequence

SEQ ID NO: 78593 - DNA, 738 bp, Artificial Sequence; identical to SEQ ID NO: 78567
  Description of Artificial Sequence: Synthetic coding sequence

SEQ ID NO: 78594 - DNA, 396 bp, Artificial Sequence
  Description of Artificial Sequence: Synthetic coding sequence
tgagccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgtag

SEQ ID NO: 78595 - DNA, 411 bp, Artificial Sequence
  Description of Artificial Sequence: Synthetic coding sequence
tgagccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagatag

SEQ ID NO: 78596 - DNA, 717 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtag

SEQ ID NO: 78597 - DNA, 564 bp, Artificial Sequence; identical to SEQ ID NO: 78557
  Description of Artificial Sequence: Synthetic coding sequence

SEQ ID NO: 78598 - DNA, 594 bp, Artificial Sequence; identical to SEQ ID NO: 78570
  Description of Artificial Sequence: Synthetic coding sequence

SEQ ID NO: 78599 - DNA, 594 bp, Artificial Sequence; identical to SEQ ID NO: 78570
  Description of Artificial Sequence: Synthetic coding sequence

SEQ ID NO: 78600 - DNA, 411 bp, Artificial Sequence; identical to SEQ ID NO: 78568
  Description of Artificial Sequence: Synthetic coding sequence

SEQ ID NO: 78601 - DNA, 1278 bp, Artificial Sequence; identical to SEQ ID NO: 78547
  Description of Artificial Sequence: Synthetic coding sequence

SEQ ID NO: 78602 - DNA, 1287 bp, Artificial Sequence; identical to SEQ ID NO: 78548
  Description of Artificial Sequence: Synthetic coding sequence

SEQ ID NO: 78603 - DNA, 1287 bp, Artificial Sequence; identical to SEQ ID NO: 78548
  Description of Artificial Sequence: Synthetic coding sequence

SEQ ID NO: 78604 - DNA, 738 bp, Artificial Sequence; identical to SEQ ID NO: 78567
  Description of Artificial Sequence: Synthetic coding sequence

SEQ ID NO: 78605 - DNA, 696 bp, Artificial Sequence; identical to SEQ ID NO: 78564
  Description of Artificial Sequence: Synthetic coding sequence

SEQ ID NO: 78606 - DNA, 594 bp, Artificial Sequence; identical to SEQ ID NO: 78570
  Description of Artificial Sequence: Synthetic coding sequence

SEQ ID NO: 78607 - DNA, 594 bp, Artificial Sequence; identical to SEQ ID NO: 78570
  Description of Artificial Sequence: Synthetic coding sequence

SEQ ID NO: 78608 - DNA, 540 bp, Artificial Sequence
  Description of Artificial Sequence: Synthetic coding sequence
gtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccagtag

SEQ ID NO: 78609 - DNA, 594 bp, Artificial Sequence; identical to SEQ ID NO: 78570
  Description of Artificial Sequence: Synthetic coding sequence

SEQ ID NO: 78610 - DNA, 564 bp, Artificial Sequence; identical to SEQ ID NO: 78557
  Description of Artificial Sequence: Synthetic coding sequence

SEQ ID NO: 78611 - DNA, 195 bp, Artificial Sequence
  Description of Artificial Sequence: Synthetic coding sequence
tgagccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactag

SEQ ID NO: 78612 - DNA, 78 bp, Artificial Sequence
  Description of Artificial Sequence: Synthetic coding sequence
tgagccaccctgcagcagctggagcccgtgaccggccaggtgagcgtgctggtgatgtgccacaccagagagctgtag

SEQ ID NO: 78613 - DNA, 66 bp, Artificial Sequence
  Description of Artificial Sequence: Synthetic coding sequence
tgagccaccctgcagcagctggagcccgtgaccggccaggtgagcgtgctggtgatgtgccactag

SEQ ID NO: 78614 - DNA, 870 bp, Artificial Sequence; identical to SEQ ID NO: 78560
  Description of Artificial Sequence: Synthetic coding sequence

SEQ ID NO: 78615 - DNA, 711 bp, Artificial Sequence; identical to SEQ ID NO: 78573
  Description of Artificial Sequence: Synthetic coding sequence

SEQ ID NO: 78616 - DNA, 711 bp, Artificial Sequence; identical to SEQ ID NO: 78573
  Description of Artificial Sequence: Synthetic coding sequence

SEQ ID NO: 78617 - DNA, 978 bp, Artificial Sequence
  Description of Artificial Sequence: Synthetic coding sequence
tgagccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagactgagcagataccagcagttcaaggacttccagagaagaatcctggtggccaccaacctgttcggcagaggcatggacatcgagagagtgaacatcgccttcaactacgacatgcccgaggacagcgacacctacctgcacagatgctaccccctgagccccagcagatggcccgagcaggccggcctggcccccagagcctggctgagccacctgtgccccatgagaatgatgcccagaagcagcatgatgtgcagaatcgccctgagaagcatcctggtgagctgcctgatgagatag

SEQ ID NO: 78618 - DNA, 717 bp, Artificial Sequence; identical to SEQ ID NO: 78596
  Description of Artificial Sequence: Synthetic coding sequence

SEQ ID NO: 78619 - DNA, 717 bp, Artificial Sequence; identical to SEQ ID NO: 78596
  Description of Artificial Sequence: Synthetic coding sequence

SEQ ID NO: 78620 - DNA, 870 bp, Artificial Sequence; identical to SEQ ID NO: 78560
  Description of Artificial Sequence: Synthetic coding sequence

SEQ ID NO: 78621 - DNA, 1278 bp, Artificial Sequence; identical to SEQ ID NO: 78547
  Description of Artificial Sequence: Synthetic coding sequence

SEQ ID NO: 78622 - DNA, 411 bp, Artificial Sequence; identical to SEQ ID NO: 78568
  Description of Artificial Sequence: Synthetic coding sequence

SEQ ID NO: 78623 - DNA, 564 bp, Artificial Sequence; identical to SEQ ID NO: 78553
  Description of Artificial Sequence: Synthetic coding sequence

SEQ ID NO: 78624 - DNA, 399 bp, Artificial Sequence; identical to SEQ ID NO: 78565
  Description of Artificial Sequence: Synthetic coding sequence

SEQ ID NO: 78625 - DNA, 870 bp, Artificial Sequence; identical to SEQ ID NO: 78560
  Description of Artificial Sequence: Synthetic coding sequence

SEQ ID NO: 78626 - DNA, 1287 bp, Artificial Sequence; identical to SEQ ID NO: 78548
  Description of Artificial Sequence: Synthetic coding sequence

SEQ ID NO: 78627 - DNA, 564 bp, Artificial Sequence; identical to SEQ ID NO: 78553
  Description of Artificial Sequence: Synthetic coding sequence

SEQ ID NO: 78628 - DNA, 291 bp, Artificial Sequence; identical to SEQ ID NO: 78562
  Description of Artificial Sequence: Synthetic coding sequence

SEQ ID NO: 78629 - DNA, 564 bp, Artificial Sequence; identical to SEQ ID NO: 78553
  Description of Artificial Sequence: Synthetic coding sequence

SEQ ID NO: 78630 - DNA, 594 bp, Artificial Sequence; identical to SEQ ID NO: 78570
  Description of Artificial Sequence: Synthetic coding sequence

SEQ ID NO: 78631 - DNA, 291 bp, Artificial Sequence; identical to SEQ ID NO: 78562
  Description of Artificial Sequence: Synthetic coding sequence

SEQ ID NO: 78632 - DNA, 696 bp, Artificial Sequence; identical to SEQ ID NO: 78564
  Description of Artificial Sequence: Synthetic coding sequence

SEQ ID NO: 78633 - DNA, 696 bp, Artificial Sequence; identical to SEQ ID NO: 78564
  Description of Artificial Sequence: Synthetic coding sequence

SEQ ID NO: 78634 - DNA, 717 bp, Artificial Sequence; identical to SEQ ID NO: 78596
  Description of Artificial Sequence: Synthetic coding sequence

SEQ ID NO: 78635 - DNA, 1287 bp, Artificial Sequence; identical to SEQ ID NO: 78548
  Description of Artificial Sequence: Synthetic coding sequence

SEQ ID NO: 78636 - DNA, 564 bp, Artificial Sequence; identical to SEQ ID NO: 78557
  Description of Artificial Sequence: Synthetic coding sequence

SEQ ID NO: 78637 - DNA, 564 bp, Artificial Sequence; identical to SEQ ID NO: 78553
  Description of Artificial Sequence: Synthetic coding sequence

SEQ ID NO: 78638 - DNA, 717 bp, Artificial Sequence; identical to SEQ ID NO: 78596
  Description of Artificial Sequence: Synthetic coding sequence

SEQ ID NO: 78639 - DNA, 738 bp, Artificial Sequence; identical to SEQ ID NO: 78567
  Description of Artificial Sequence: Synthetic coding sequence

SEQ ID NO: 78640 - DNA, 1278 bp, Artificial Sequence; identical to SEQ ID NO: 78547
  Description of Artificial Sequence: Synthetic coding sequence

SEQ ID NO: 78641 - DNA, 711 bp, Artificial Sequence; identical to SEQ ID NO: 78573
  Description of Artificial Sequence: Synthetic coding sequence

SEQ ID NO: 78642 - DNA, 738 bp, Artificial Sequence; identical to SEQ ID NO: 78567
  Description of Artificial Sequence: Synthetic coding sequence

SEQ ID NO: 78643 - DNA, 1287 bp, Artificial Sequence; identical to SEQ ID NO: 78548
  Description of Artificial Sequence: Synthetic coding sequence

SEQ ID NO: 78644 - DNA, 411 bp, Artificial Sequence; identical to SEQ ID NO: 78568
  Description of Artificial Sequence: Synthetic coding sequence

SEQ ID NO: 78645 - DNA, 987 bp, Artificial Sequence; identical to SEQ ID NO: 78584
  Description of Artificial Sequence: Synthetic coding sequence

SEQ ID NO: 78646 - DNA, 399 bp, Artificial Sequence; identical to SEQ ID NO: 78565
  Description of Artificial Sequence: Synthetic coding sequence

SEQ ID NO: 78647 - DNA, 420 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccagagccacgagcacatgaccagcgtgaccctggacaacctgaccgccgtgggcgacgtgctgagccaggcctggggcagctag

SEQ ID NO: 78648 - DNA, 717 bp, Artificial Sequence; identical to SEQ ID NO: 78596
  Description of Artificial Sequence: Synthetic coding sequence

SEQ ID NO: 78649 - DNA, 564 bp, Artificial Sequence; identical to SEQ ID NO: 78574
  Description of Artificial Sequence: Synthetic coding sequence

SEQ ID NO: 78650 - DNA, 711 bp, Artificial Sequence; identical to SEQ ID NO: 78573
  Description of Artificial Sequence: Synthetic coding sequence

SEQ ID NO: 78651 - DNA, 1278 bp, Artificial Sequence; identical to SEQ ID NO: 78547
  Description of Artificial Sequence: Synthetic coding sequence

SEQ ID NO: 78652 - DNA, 696 bp, Artificial Sequence; identical to SEQ ID NO: 78564
  Description of Artificial Sequence: Synthetic coding sequence

SEQ ID NO: 78653 - DNA, 99 bp, Artificial Sequence
  Description of Artificial Sequence: Synthetic coding sequence
tgagccaccctgcagcagctggagcccgtgaccggccaggtgtgcttctgcgacagccacttccccagaggcgacaacgaggagctgcacctgccctag

SEQ ID NO: 78654 - DNA, 399 bp, Artificial Sequence; identical to SEQ ID NO: 78565
  Description of Artificial Sequence: Synthetic coding sequence

SEQ ID NO: 78655 - DNA, 399 bp, Artificial Sequence; identical to SEQ ID NO: 78565
  Description of Artificial Sequence: Synthetic coding sequence

SEQ ID NO: 78656 - DNA, 738 bp, Artificial Sequence; identical to SEQ ID NO: 78567
  Description of Artificial Sequence: Synthetic coding sequence

SEQ ID NO: 78657 - DNA, 696 bp, Artificial Sequence; identical to SEQ ID NO: 78564
  Description of Artificial Sequence: Synthetic coding sequence

SEQ ID NO: 78658 - DNA, 732 bp, Artificial Sequence
  Description of Artificial Sequence: Synthetic coding sequence
atgtggaccatgagcagctggaccatgaagatgatgagatggagacagcagctgggcgagatgggcctgagacccctgcccagaagaatgagcagagcccccatgagccccagcaccgccctggccttcgtgaccagctgcagcagccagagctgcagcggccccctgagcaccgtggccctgagcatcagacagaaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggacgtgaacaccctgctgcccagcctgccccccctgcccgccagatgcctgctgcccttcctggccctgttcctgagactgccctgccacagcagcgccaagaaggccgcctgcgcccagctgggcgtgatgaccccctag

SEQ ID NO: 78659 - DNA, 1287 bp, Artificial Sequence; identical to SEQ ID NO: 78548
  Description of Artificial Sequence: Synthetic coding sequence

SEQ ID NO: 78660 - DNA, 1278 bp, Artificial Sequence; identical to SEQ ID NO: 78547
  Description of Artificial Sequence: Synthetic coding sequence

SEQ ID NO: 78661 - DNA, 291 bp, Artificial Sequence; identical to SEQ ID NO: 78562
  Description of Artificial Sequence: Synthetic coding sequence

SEQ ID NO: 78662 - DNA, 411 bp, Artificial Sequence; identical to SEQ ID NO: 78568
  Description of Artificial Sequence: Synthetic coding sequence

SEQ ID NO: 78663 - DNA, 564 bp, Artificial Sequence; identical to SEQ ID NO: 78557
  Description of Artificial Sequence: Synthetic coding sequence

SEQ ID NO: 78664 - DNA, 717 bp, Artificial Sequence; identical to SEQ ID NO: 78596
  Description of Artificial Sequence: Synthetic coding sequence

SEQ ID NO: 78665 - DNA, 417 bp, Artificial Sequence
  Description of Artificial Sequence: Synthetic coding sequence
tgagccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtag

SEQ ID NO: 78666 - DNA, 870 bp, Artificial Sequence; identical to SEQ ID NO: 78560
  Description of Artificial Sequence: Synthetic coding sequence

SEQ ID NO: 78667 - DNA, 1287 bp, Artificial Sequence; identical to SEQ ID NO: 78548
  Description of Artificial Sequence: Synthetic coding sequence

SEQ ID NO: 78668 - DNA, 696 bp, Artificial Sequence; identical to SEQ ID NO: 78564
  Description of Artificial Sequence: Synthetic coding sequence

SEQ ID NO: 78669 - DNA, 1287 bp, Artificial Sequence; identical to SEQ ID NO: 78548
  Description of Artificial Sequence: Synthetic coding sequence

SEQ ID NO: 78670 - DNA, 378 bp, Artificial Sequence; identical to SEQ ID NO: 78555
  Description of Artificial Sequence: Synthetic coding sequence

SEQ ID NO: 78671 - DNA, 294 bp, Artificial Sequence
  Description of Artificial Sequence: Synthetic coding sequence
tgagccaccctgcagcagctggagcccgtgaccggccaggtgtgcttctgcgacagccacttccccagaggcgacaacgaggagctgcacctgccctacgtgagcgtgtacttcctgcccaaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtgtag

SEQ ID NO: 78672 - DNA, 291 bp, Artificial Sequence; identical to SEQ ID NO: 78562
  Description of Artificial Sequence: Synthetic coding sequence

SEQ ID NO: 78673 - DNA, 291 bp, Artificial Sequence; identical to SEQ ID NO: 78562
  Description of Artificial Sequence: Synthetic coding sequence

SEQ ID NO: 78674 - DNA, 1287 bp, Artificial Sequence; identical to SEQ ID NO: 78548
  Description of Artificial Sequence: Synthetic coding sequence

SEQ ID NO: 78675 - DNA, 732 bp, Artificial Sequence; identical to SEQ ID NO: 78658
  Description of Artificial Sequence: Synthetic coding sequence

SEQ ID NO: 78676 - DNA, 972 bp, Artificial Sequence
  Description of Artificial Sequence: Synthetic coding sequence
atggccgagaacgacgtggacaacgagctgctggactacgaggacgacgaggtggagaccgccgccggcggcgacggcgccgaggcccccgccaagaaggacgtgaagggcagctacgtgagcatccacagcagcggcttcagagacttcctgctgaagcccgagctgctgagagccatcgtggactgcggcttcgagcaccccagcgaggtgcagcacgagtgcatcccccaggccatcctgggcatggacgtgctgtgccaggccaagagcggcatgggcaagaccgccgtgttcgtgctggccaccctgcagcagctggagcccgtgaccggccaggtgagcgtgctggtgatgtgccacaccagagagctggccttccagatcagcaaggagtacgagagattcagcaagtacatgcccaacgtgaaggtggccgtgttcttcggcggcctgagcatcaagaaggacgaggaggtgctgaagaagaactgcccccacatcgtggtgggcacccccggcagaatcctggccctggccagaaacaagagcctgaacctgaagcacatcaagcacttcatcctggacgagtgcgacaagatgctggagcagctggacatgagaagagacgtgcaggagatcttcagaatgaccccccacgagaagcaggtgatgatgttcagcgccaccctgagcaaggagatcagacccgtgtgcagaaagttcatgcaggaccccatggagatcttcgtggacgacgagaccaagctgaccctgcacggcctgcagcagtactacgtgaagctgaaggacaacgagaagaacagaaagctgttcgacctgctggacgtgctggagttcaaccaggagatcacctgcaagagcgtgcagagattcagcaccaccaacagctgcggctaccagcccatctggcccagacacggccacagagccggcgagcactgcttctag

SEQ ID NO: 78677 - DNA, 972 bp, Artificial Sequence; identical to SEQ ID NO: 78676
  Description of Artificial Sequence: Synthetic coding sequence

SEQ ID NO: 78678 - DNA, 1332 bp, Artificial Sequence; identical to SEQ ID NO: 78576
  Description of Artificial Sequence: Synthetic coding sequence

SEQ ID NO: 78679 - DNA, 732 bp, Artificial Sequence; identical to SEQ ID NO: 78658
  Description of Artificial Sequence: Synthetic coding sequence

SEQ ID NO: 78680 - DNA, 1332 bp, Artificial Sequence; identical to SEQ ID NO: 78576
  Description of Artificial Sequence: Synthetic coding sequence

SEQ ID NO: 78681 - DNA, 420 bp, Artificial Sequence; identical to SEQ ID NO: 78647
  Description of Artificial Sequence: Synthetic coding sequence

SEQ ID NO: 78682 - DNA, 732 bp, Artificial Sequence; identical to SEQ ID NO: 78658
  Description of Artificial Sequence: Synthetic coding sequence

SEQ ID NO: 78683 - DNA, 732 bp, Artificial Sequence; identical to SEQ ID NO: 78658
  Description of Artificial Sequence: Synthetic coding sequence

SEQ ID NO: 78684 - DNA, 420 bp, Artificial Sequence; identical to SEQ ID NO: 78647
  Description of Artificial Sequence: Synthetic coding sequence

SEQ ID NO: 78685 - DNA, 972 bp, Artificial Sequence; identical to SEQ ID NO: 78676
  Description of Artificial Sequence: Synthetic coding sequence

SEQ ID NO: 78686 - DNA, 1332 bp, Artificial Sequence; identical to SEQ ID NO: 78576
  Description of Artificial Sequence: Synthetic coding sequence

SEQ ID NO: 78687 - DNA, 732 bp, Artificial Sequence; identical to SEQ ID NO: 78658
  Description of Artificial Sequence: Synthetic coding sequence

SEQ ID NO: 78688 - DNA, 1053 bp, Artificial Sequence; identical to SEQ ID NO: 78566
  Description of Artificial Sequence: Synthetic coding sequence

SEQ ID NO: 78689 - DNA, 1332 bp, Artificial Sequence; identical to SEQ ID NO: 78576
  Description of Artificial Sequence: Synthetic coding sequence

SEQ ID NO: 78690 - DNA, 1053 bp, Artificial Sequence; identical to SEQ ID NO: 78566
  Description of Artificial Sequence: Synthetic coding sequence

SEQ ID NO: 78691 - DNA, 732 bp, Artificial Sequence; identical to SEQ ID NO: 78658
  Description of Artificial Sequence: Synthetic coding sequence

SEQ ID NO: 78692 - DNA, 420 bp, Artificial Sequence; identical to SEQ ID NO: 78647
  Description of Artificial Sequence: Synthetic coding sequence

SEQ ID NO: 78693 - DNA, 1053 bp, Artificial Sequence; identical to SEQ ID NO: 78566
  Description of Artificial Sequence: Synthetic coding sequence

SEQ ID NO: 78694 - DNA, 972 bp, Artificial Sequence; identical to SEQ ID NO: 78676
  Description of Artificial Sequence: Synthetic coding sequence

SEQ ID NO: 78695 - DNA, 1053 bp, Artificial Sequence; identical to SEQ ID NO: 78566
  Description of Artificial Sequence: Synthetic coding sequence

SEQ ID NO: 78696 - DNA, 420 bp, Artificial Sequence; identical to SEQ ID NO: 78647
  Description of Artificial Sequence: Synthetic coding sequence

SEQ ID NO: 78697 - DNA, 1332 bp, Artificial Sequence; identical to SEQ ID NO: 78576
  Description of Artificial Sequence: Synthetic coding sequence

SEQ ID NO: 78698 - DNA, 972 bp, Artificial Sequence; identical to SEQ ID NO: 78676
  Description of Artificial Sequence: Synthetic coding sequence

SEQ ID NO: 78699 - DNA, 972 bp, Artificial Sequence; identical to SEQ ID NO: 78676
  Description of Artificial Sequence: Synthetic coding sequence

SEQ ID NO: 78700 - DNA, 1053 bp, Artificial Sequence; identical to SEQ ID NO: 78566
  Description of Artificial Sequence: Synthetic coding sequence

SEQ ID NO: 78701 - DNA, 420 bp, Artificial Sequence; identical to SEQ ID NO: 78647
  Description of Artificial Sequence: Synthetic coding sequence

SEQ ID NO: 78702 - DNA, 1053 bp, Artificial Sequence; identical to SEQ ID NO: 78566
  Description of Artificial Sequence: Synthetic coding sequence

SEQ ID NO: 78703 - DNA, 420 bp, Artificial Sequence; identical to SEQ ID NO: 78647
  Description of Artificial Sequence: Synthetic coding sequence

SEQ ID NO: 78704 - DNA, 1332 bp, Artificial Sequence; identical to SEQ ID NO: 78576
  Description of Artificial Sequence: Synthetic coding sequence

SEQ ID NO: 78705 - DNA, 552 bp, Artificial Sequence
  Description of Artificial Sequence: Synthetic coding sequence
atggagatcttcgtggacgacgagaccaagctgaccctgcacggcctgcagcagtactacgtgaagctgaaggacaacgagaagaacagaaagctgttcgacctgctggacgtgctggagttcaaccaggtggtgatcttcgtgaagagcgtgcagagatgcatcgccctggcccagctgctggtggagcagaacttccccgccatcgccatccacagaggcatgccccaggaggagagatggctgagcagataccagcagttcaaggacttccagagaagaatcctggtggccaccaacctgttcggcagaggcatggacatcgagagagtgaacatcgccttcaactacgacatgcccgaggacagcgacacctacctgcacagagtggccagagccggcagattcggcaccaagggcctggccatcaccttcgtgagcgacgagaacgacgccaagatcctgaacgacgtgcaggacagattcgaggtgaacatcagcgagctgcccgacgagatcgacatcagcagctacatcgagcagaccagatag

SEQ ID NO: 78706 - DNA, 2073 bp, Artificial Sequence
  Description of Artificial Sequence: Synthetic coding sequence
atgggcgacgaggactgggaggccgagatcaacccccacatgagcagctacgtgcccatcttcgagaaggacagatacagcggcgagaacggcgacaacttcaacagaacccccgccagcagcagcgagatggacgacggccccagcagaagagaccacttcatgaagagcggcttcgccagcggcagaaacttcggcaacagagacgccggcgagtgcaacaagagagacaacaccagcaccatgggcggcttcggcgtgggcaagagcttcggcaacagaggcttcagcaacagcagattcgaggacggcgacagcagcggcttctggagagagagcagcaacgactgcgaggacaaccccaccagaaacagaggcttcagcaagagaggcgacaacgacctggaccccgacgagtgcatgcagagaaccggcggcctgttcggcagcagaagacccgtgctgagcggcaccggcaacggcgacaccagccagagcagaagcggcagcggcagcgagagaggcggctacaagggcctgaacgaggaggtgatcaccggcagcggcaagaacagctggaagagcgaggccgagggcggcgagagcagcgacacccagggccccaaggtgacctacatccccccccccccccccgaggacgaggacagcatcttcgcccactaccagaccggcatcaacttcgacaagtacgacaccatcctggtggaggtgagcggccacgacgccccccccgccatcctgaccttcgaggaggccaacctgtgccagaccctgaacaacaacatcgccaaggccggctacaccaagctgacccccgtgcagaagtacagcatccccatcatcctggccggcagagacctgatggcctgcgcccagaccggcagcggcaagaccgccgccttcctgctgcccatcctggcccacatgatgcacgacggcatcaccgccagcagattcaaggagctgcaggagcccgagtgcatcatcgtggcccccaccagagagctggtgaaccagatctacctggaggccagaaagttcagcttcggcacctgcgtgagagccgtggtgatctacggcggcacccagctgggccacagcatcagacagatcgtgcagggctgcaacatcctgtgcgccacccccggcagactgatggacatcatcggcaaggagaagatcggcctgaagcagatcaagtacctggtgctggacgaggccgacagaatgctggacatgggcttcggccccgagatgaagaagctgatcagctgccccggcatgcccagcaaggagcagagacagaccctgatgttcagcgccaccttccccgaggagatccagagactggccgccgagttcctgaagagcaactacctgttcgtggccgtgggccaggtgggcggcgcctgcagagacgtgcagcagaccgtgctgcaggtgggccagttcagcaagagagagaagctggtggagatcctgagaaacatcggcgacgagagaaccatggtgttcgtggagaccaagaagaaggccgacttcatcgccaccttcctgtgccaggagaagatcagcaccaccagcatccacggcgacagagagcagagagagagagagcaggccctgggcgacttcagattcggcaagtgccccgtgctggtggccaccagcgtggccgccagaggcctggacatcgagaacgtgcagcacgtgatcaacttcgacctgcccagcaccatcgacgagtacgtgcacagaatcggcagaaccggcagatgcggcaacaccggcagagccatcagcttcttcgacctggagagcgacaaccacctggcccagcccctggtgaaggtgctgaccgacgcccagcaggacgtgcccgcctggctggaggagatcgccttcagcacctacatccccggcttcagcggcagcaccagaggcaacgtgttcgccagcgtggacaccagaaagggcaagagcaccctgaacaccgccggcttcagcagcagccaggcccccaaccccgtggacgacgagagctgggactag

SEQ ID NO: 78707 - DNA, 2073 bp, Artificial Sequence; identical to SEQ ID NO: 78706
  Description of Artificial Sequence: Synthetic coding sequence

SEQ ID NO: 78708 - DNA, 2175 bp, Artificial Sequence
  Description of Artificial Sequence: Synthetic coding sequence
atgggcgacgaggactgggaggccgagatcaacccccacatgagcagctacgtgcccatcttcgagaaggacagatacagcggcgagaacggcgacaacttcaacagaacccccgccagcagcagcgagatggacgacggccccagcagaagagaccacttcatgaagagcggcttcgccagcggcagaaacttcggcaacagagacgccggcgagtgcaacaagagagacaacaccagcaccatgggcggcttcggcgtgggcaagagcttcggcaacagaggcttcagcaacagcagattcgaggacggcgacagcagcggcttctggagagagagcagcaacgactgcgaggacaaccccaccagaaacagaggcttcagcaagagaggcggctacagagacggcaacaacagcgaggccagcggcccctacagaagaggcggcagaggcagcttcagaggctgcagaggcggcttcggcctgggcagccccaacaacgacctggaccccgacgagtgcatgcagagaaccggcggcctgttcggcagcagaagacccgtgctgagcggcaccggcaacggcgacaccagccagagcagaagcggcagcggcagcgagagaggcggctacaagggcctgaacgaggaggtgatcaccggcagcggcaagaacagctggaagagcgaggccgagggcggcgagagcagcgacacccagggccccaaggtgacctacatccccccccccccccccgaggacgaggacagcatcttcgcccactaccagaccggcatcaacttcgacaagtacgacaccatcctggtggaggtgagcggccacgacgccccccccgccatcctgaccttcgaggaggccaacctgtgccagaccctgaacaacaacatcgccaaggccggctacaccaagctgacccccgtgcagaagtacagcatccccatcatcctggccggcagagacctgatggcctgcgcccagaccggcagcggcaagaccgccgccttcctgctgcccatcctggcccacatgatgcacgacggcatcaccgccagcagattcaaggagctgcaggagcccgagtgcatcatcgtggcccccaccagagagctggtgaaccagatctacctggaggccagaaagttcagcttcggcacctgcgtgagagccgtggtgatctacggcggcacccagctgggccacagcatcagacagatcgtgcagggctgcaacatcctgtgcgccacccccggcagactgatggacatcatcggcaaggagaagatcggcctgaagcagatcaagtacctggtgctggacgaggccgacagaatgctggacatgggcttcggccccgagatgaagaagctgatcagctgccccggcatgcccagcaaggagcagagacagaccctgatgttcagcgccaccttccccgaggagatccagagactggccgccgagttcctgaagagcaactacctgttcgtggccgtgggccaggtgggcggcgcctgcagagacgtgcagcagaccgtgctgcaggtgggccagttcagcaagagagagaagctggtggagatcctgagaaacatcggcgacgagagaaccatggtgttcgtggagaccaagaagaaggccgacttcatcgccaccttcctgtgccaggagaagatcagcaccaccagcatccacggcgacagagagcagagagagagagagcaggccctgggcgacttcagattcggcaagtgccccgtgctggtggccaccagcgtggccgccagaggcctggacatcgagaacgtgcagcacgtgatcaacttcgacctgcccagcaccatcgacgagtacgtgcacagaatcggcagaaccggcagatgcggcaacaccggcagagccatcagcttcttcgacctggagagcgacaaccacctggcccagcccctggtgaaggtgctgaccgacgcccagcaggacgtgcccgcctggctggaggagatcgccttcagcacctacatccccggcttcagcggcagcaccagaggcaacgtgttcgccagcgtggacaccagaaagggcaagagcaccctgaacaccgccggcttcagcagcagccaggcccccaaccccgtggacgacgagagctgggactag

SEQ ID NO: 78709 - DNA, 318 bp, Artificial Sequence
  Description of Artificial Sequence: Synthetic coding sequence
atgggcgacgaggactgggaggccgagatcaacccccacatgagcagctacgtgcccatcttcgagaaggacagatacagcggcgagaacggcgacaacttcaacagaacccccgccagcagcagcgagatggacgacggccccagcagaagagaccacttcatgaagagcggcttcgccagcggcagaaacttcggcaacagagacgccggcgagtgcaacaagagagacaacaccagcaccatgggcggcttcggcgtgggcaagagcttcggcaacagaggcttcagcaacagcagattcgaggacggcgactag

SEQ ID NO: 78710 - DNA, 2115 bp, Artificial Sequence
  Description of Artificial Sequence: Synthetic coding sequence
atgggcgacgaggactgggaggccgagatcaacccccacatgagcagctacgtgcccatcttcgagaaggacagatacagcggcgagaacggcgacaacttcaacagaacccccgccagcagcagcgagatggacgacggccccagcagaagagaccacttcatgaagagcggcttcgccagcggcagaaacttcggcaacagagacgccggcgagtgcaacaagagagacaacaccagcaccatgggcggcttcggcgtgggcaagagcttcggcaacagaggcttcagcaacagcagattcgaggacggcgacagcagcggcttctggagaggctacagagacggcaacaacagcgaggccagcggcccctacagaagaggcggcagaggcagcttcagaggctgcagaggcggcttcggcctgggcagccccaacaacgacctggaccccgacgagtgcatgcagagaaccggcggcctgttcggcagcagaagacccgtgctgagcggcaccggcaacggcgacaccagccagagcagaagcggcagcggcagcgagagaggcggctacaagggcctgaacgaggaggtgatcaccggcagcggcaagaacagctggaagagcgaggccgagggcggcgagagcagcgacacccagggccccaaggtgacctacatccccccccccccccccgaggacgaggacagcatcttcgcccactaccagaccggcatcaacttcgacaagtacgacaccatcctggtggaggtgagcggccacgacgccccccccgccatcctgaccttcgaggaggccaacctgtgccagaccctgaacaacaacatcgccaaggccggctacaccaagctgacccccgtgcagaagtacagcatccccatcatcctggccggcagagacctgatggcctgcgcccagaccggcagcggcaagaccgccgccttcctgctgcccatcctggcccacatgatgcacgacggcatcaccgccagcagattcaaggagctgcaggagcccgagtgcatcatcgtggcccccaccagagagctggtgaaccagatctacctggaggccagaaagttcagcttcggcacctgcgtgagagccgtggtgatctacggcggcacccagctgggccacagcatcagacagatcgtgcagggctgcaacatcctgtgcgccacccccggcagactgatggacatcatcggcaaggagaagatcggcctgaagcagatcaagtacctggtgctggacgaggccgacagaatgctggacatgggcttcggccccgagatgaagaagctgatcagctgccccggcatgcccagcaaggagcagagacagaccctgatgttcagcgccaccttccccgaggagatccagagactggccgccgagttcctgaagagcaactacctgttcgtggccgtgggccaggtgggcggcgcctgcagagacgtgcagcagaccgtgctgcaggtgggccagttcagcaagagagagaagctggtggagatcctgagaaacatcggcgacgagagaaccatggtgttcgtggagaccaagaagaaggccgacttcatcgccaccttcctgtgccaggagaagatcagcaccaccagcatccacggcgacagagagcagagagagagagagcaggccctgggcgacttcagattcggcaagtgccccgtgctggtggccaccagcgtggccgccagaggcctggacatcgagaacgtgcagcacgtgatcaacttcgacctgcccagcaccatcgacgagtacgtgcacagaatcggcagaaccggcagatgcggcaacaccggcagagccatcagcttcttcgacctggagagcgacaaccacctggcccagcccctggtgaaggtgctgaccgacgcccagcaggacgtgcccgcctggctggaggagatcgccttcagcacctacatccccggcttcagcggcagcaccagaggcaacgtgttcgccagcgtggacaccagaaagggcaagagcaccctgaacaccgccggcttcagcagcagccaggcccccaaccccgtggacgacgagagctgggactag

SEQ ID NO: 78711 - DNA, 480 bp, Artificial Sequence
  Description of Artificial Sequence: Synthetic coding sequence
atgggcgacgaggactgggaggccgagatcaacccccacatgagcagctacgtgcccatcttcgagaaggacagatacagcggcgagaacggcgacaacttcaacagaacccccgccagcagcagcgagatggacgacggccccagcagaagagaccacttcatgaagagcggcttcgccagcggcagaaacttcggcaacagagacgccggcgagtgcaacaagagagacaacaccagcaccatgggcggcttcggcgtgggcaagagcttcggcaacagaggcttcagcaacagcagattcgaggacggcgacagcagcggcttctggagagagagcagcaacgactgcgaggacaaccccaccagaaacagaggcttcagcaagagaggcggctacagagacggcaacaacagcgaggccagcggcccctacagaagaggcggcagaggcagcttcagaggctgcagaggcggctag

SEQ ID NO: 78712 - DNA, 1728 bp, Artificial Sequence
  Description of Artificial Sequence: Synthetic coding sequence
atgggcagcagaaacctgttcctgaccaacagccccgagagcagcaacgactgcgaggacaaccccaccagaaacagaggcttcagcaagagaggcgacaacgacctggaccccgacgagtgcatgcagagaaccggcggcctgttcggcagcagaagacccgtgctgagcggcaccggcaacggcgacaccagccagagcagaagcggcagcggcagcgagagagacagctggaagagcgaggccgagggcggcgagagcagcgacacccagggccccaaggtgacctacatccccccccccccccccgaggacgaggacagcatcttcgcccactaccagaccggcatcaacttcgacaagtacgacaccatcctggtggaggtgagcggccacgacgccccccccgccatcctgaccttcgaggaggccaacctgtgccagaccctgaacaacaacatcgccaaggccggctacaccaagctgacccccgtgcagaagtacagcatccccatcatcctggccggcagagacctgatggcctgcgcccagaccggcagcggcaagaccgccgccttcctgctgcccatcctggcccacatgatgcacgacggcatcaccgccagcagattcaaggagctgcaggagcccgagtgcatcatcgtggcccccaccagagagctggtgaaccagatctacctggaggccagaaagttcagcttcggcacctgcgtgagagccgtggtgatctacggcggcacccagctgggccacagcatcagacagatcgtgcagggctgcaacatcctgtgcgccacccccggcagactgatggacatcatcggcaaggagaagatcggcctgaagcagatcaagtacctggtgctggacgaggccgacagaatgctggacatgggcttcggccccgagatgaagaagctgatcagctgccccggcatgcccagcaaggagcagagacagaccctgatgttcagcgccaccttccccgaggagatccagagactggccgccgagttcctgaagagcaactacctgttcgtggccgtgggccaggtgggcggcgcctgcagagacgtgcagcagaccgtgctgcaggtgggccagttcagcaagagagagaagctggtggagatcctgagaaacatcggcgacgagagaaccatggtgttcgtggagaccaagaagaaggccgacttcatcgccaccttcctgtgccaggagaagatcagcaccaccagcatccacggcgacagagagcagagagagagagagcaggccctgggcgacttcagattcggcaagtgccccgtgctggtggccaccagcgtggccgccagaggcctggacatcgagaacgtgcagcacgtgatcaacttcgacctgcccagcaccatcgacgagtacgtgcacagaatcggcagaaccggcagatgcggcaacaccggcagagccatcagcttcttcgacctggagagcgacaaccacctggcccagcccctggtgaaggtgctgaccgacgcccagcaggacgtgcccgcctggctggaggagatcgccttcagcacctacatccccggcttcagcggcagcaccagaggcaacgtgttcgccagcgtggacaccagaaagggcaagagcaccctgaacaccgccggcttcagcagcagccaggcccccaaccccgtggacgacgagagctgggactag

SEQ ID NO: 78713 - DNA, 1869 bp, Artificial Sequence
  Description of Artificial Sequence: Synthetic coding sequence
atggaggagagcgagcccgagagaaagagagccagaaccgacgaggtgcccgccggcggcagcagaagcgaggccgaggacgaggacgacgaggactacgtgccctacgtgcccctgagacagagaagacagctgctgctgcagaagctgctgcagagaagaagaaagggcgccgccgaggaggagcagcaggacagcggcagcgagcccagaggcgacgaggacgacatccccctgggcccccagagcaacgtgagcctgctggaccagcaccagcacctgaaggagaaggccgaggccagaaaggagagcgccaaggagaagcagctgaaggaggaggagaagatcctggagagcgtggccgagggcagagccctgatgagcgtgaaggagatggccaagggcatcacctacgacgaccccatcaagaccagctggaccccccccagatacgtgctgagcatgagcgaggagagacacgagagagtgagaaagaagtaccacatcctggtggagggcgacggcatccccccccccatcaagagcttcaaggagatgaagttccccgccgccatcctgagaggcctgaagaagaagggcatccaccaccccacccccatccagatccagggcatccccaccatcctgagcggcagagacatgatcggcatcgccttcaccggcagcggcaagaccctggtgttcaccctgcccgtgatcatgttctgcctggagcaggagaagagactgcccttcagcaagagagagggcccctacggcctgatcatctgccccagcagagagctggccagacagacccacggcatcctggagtactactgcagactgctgcaggaggacagcagccccctgctgagatgcgccctgtgcatcggcggcatgagcgtgaaggagcagatggagaccatcagacacggcgtgcacatgatggtggccacccccggcagactgatggacctgctgcagaagaagatggtgagcctggacatctgcagatacctggccctggacgaggccgacagaatgatcgacatgggcttcgagggcgacatcagaaccatcttcagctacttcaagggccagagacagaccctgctgttcagcgccaccatgcccaagaagatccagaacttcgccaagagcgccctggtgaagcccgtgaccatcaacgtgggcagagccggcgccgccagcctggacgtgatccaggaggtggagtacgtgaaggaggaggccaagatggtgtacctgctggagtgcctgcagaagacccccccccccgtgctgatcttcgccgagaagaaggccgacgtggacgccatccacgagtacctgctgctgaagggcgtggaggccgtggccatccacggcggcaaggaccaggaggagagaaccaaggccatcgaggccttcagagagggcaagaaggacgtgctggtggccaccgacgtggccagcaagggcctggacttccccgccatccagcacgtgatcaactacgacatgcccgaggagatcgagaactacgtgcacagaatcggcagaaccggcagaagcggcaacaccggcatcgccaccaccttcatcaacaaggcctgcgacgagagcgtgctgatggacctgaaggccctgctgctggaggccaagcagaaggtgccccccgtgctgcaggtgctgcactgcggcgacgagagcatgctggacatcggcggcgagagaggctgcgccttctgcggcggcctgggccacagaatcaccgactgccccaagctggaggccatgcagaccaagcaggtgagcaacatcggcagaaaggactacctggcccacagcagcatggacttctag

SEQ ID NO: 78714 - DNA, 1881 bp, Artificial Sequence
  Description of Artificial Sequence: Synthetic coding sequence
atgcaccagatcagaaagagcgagtacacccagcccacccccatccagtgccagggcgtgcccgtggccctgagcggcagagacatgatcggcatcgccaagaccggcagcggcaagaccgccgccttcatctggcccatgctgatccacatcatggaccagaaggagctggagcccggcgacggccccatcgccgtgatcgtgtgccccaccagagagctgtgccagcagatccacgccgagtgcaagagattcggcaaggcctacaacctgagaagcgtggccgtgtacggcggcggcagcatgtgggagcaggccaaggccctgcaggagggcgccgagatcgtggtgtgcacccccggcagactgatcgaccacgtgaagaagaaggccaccaacctgcagagagtgagctacctggtgttcgacgaggccgacagaatgttcgacatgggcttcgagtaccaggtgagaagcatcgccagccacgtgagacccgacagacagaccctgctgttcagcgccaccttcagaaagaagatcgagaagctggccagagacatcctgatcgaccccatcagagtggtgcagggcgacatcggcgaggccaacgaggacgtgacccagatcgtggagatcctgcacagcggccccagcaagtggaactggctgaccagaagactggtggagttcaccagcagcggcagcgtgctgctgttcgtgaccaagaaggccaacgccgaggagctggccaacaacctgaagcaggagggccacaacctgggcctgctgcacggcgacatggaccagagcgagagaaacaaggtgatcagcgacttcaagaagaaggacatccccgtgctggtggccaccgacgtggccgccagaggcctggacatccccagcatcaagaccgtgatcaactacgacgtggccagagacatcgacaccctgctgacccccaaggacagcaacttcgccggcgacctggtgagaaacctggagggcgccaaccagcacgtgagcaaggagctgctggacctggccatgcagaacgcctggttcagaaagagcagattcaagggcggcaagggcaagaagctgaacatcggcggcggcggcctgggctacagagagagacccggcctgggcagcgagaacatggacagaggcaacaacaacgtgatgagcaactacgaggcctacaagcccagcaccggcgccatgggcgacagactgaccgccatgaaggccgccttccagagccagtacaagagccacttcgtggccgccagcctgagcaaccagaaggccggcagcagcgccgccggcgccagcggctggaccagcgccggcagcctgaacagcgtgcccaccaacagcgcccagcagggccacaacagccccgacagccccgtgaccagcgccgccaagggcatccccggcttcggcaacaccggcaacatcagcggcgcccccgtgacctaccccagcgccggcgcccagggcgtgaacaacaccgccagcggcaacaacagcagagagggcaccggcggcagcaacggcaagagagagagatacaccgagaacagaggcagcagcagacacagccacggcgagaccggcaacagacacagcgacagccccagacacggcgacggcggcagacacggcgacggctacagacaccccgagagcagcagcagacacaccgacggccacagacacggcgagaacagacacggcggcagcgccggcagacacggcgagaacagaggcgccaacgacggcagaaacggcgagagcagaaaggaggccttcaacagagagagcaagatggagcccccccccaagagaaagaagagcagatgggacagctag

SEQ ID NO: 78715 - DNA, 2817 bp, Artificial Sequence
  Description of Artificial Sequence: Synthetic coding sequence
atgaactggaacaagggcggccccggcaccaagagaggcttcggcttcggcggcttcgccatcagcgccggcaagaaggaggagcccaagctgccccagcagagccacagcgccttcggcgccaccagcagcagcagcggcttcggcaagagcgcccccccccagctgcccagcttctacaagatcggcagcaagagagccaacttcgacgaggagaacgcctacttcgaggacgaggaggaggacagcagcaacgtggacctgccctacatccccgccgagaacagccccaccagacagcagttccacagcaagcccgtggacagcgacagcgacgacgaccccctggaggccttcatggccgaggtggaggaccaggccgccagagacatgaagagactggaggagaaggacaaggagagaaagaacgtgaagggcatcagagacgacatcgaggaggaggacgaccaggaggcctacttcagatacatggccgagaaccccaccgccggcgtggtgcaggaggaggaggaggacaacctggagtacgacagcgacggcaaccccatcgcccccaccaagaagatcatcgaccccctgccccccatcgaccacagcgagatcgactacccccccttcgagaagaacttctacaacgagcacgaggagatcaccaacctgaccccccagcagctgatcgacctgagacacaagctgaacctgagagtgagcggcgccgccccccccagacccggcagcagcttcgcccacttcggcttcgacgagcagctgatgcaccagatcagaaagagcgagtacacccagcccacccccatccagtgccagggcgtgcccgtggccctgagcggcagagacatgatcggcatcgccaagaccggcagcggcaagaccgccgccttcatctggcccatgctgatccacatcatggaccagaaggagctggagcccggcgacggccccatcgccgtgatcgtgtgccccaccagagagctgtgccagcagatccacgccgagtgcaagagattcggcaaggcctacaacctgagaagcgtggccgtgtacggcggcggcagcatgtgggagcaggccaaggccctgcaggagggcgccgagatcgtggtgtgcacccccggcagactgatcgaccacgtgaagaagaaggccaccaacctgcagagagtgagctacctggtgttcgacgaggccgacagaatgttcgacatgggcttcgagtaccaggtgagaagcatcgccagccacgtgagacccgacagacagaccctgctgttcagcgccaccttcagaaagaagatcgagaagctggccagagacatcctgatcgaccccatcagagtggtgcagggcgacatcggcgaggccaacgaggacgtgacccagatcgtggagatcctgcacagcggccccagcaagtggaactggctgaccagaagactggtggagttcaccagcagcggcagcgtgctgctgttcgtgaccaagaaggccaacgccgaggagctggccaacaacctgaagcaggagggccacaacctgggcctgctgcacggcgacatggaccagagcgagagaaacaaggtgatcagcgacttcaagaagaaggacatccccgtgctggtggccaccgacgtggccgccagaggcctggacatccccagcatcaagaccgtgatcaactacgacgtggccagagacatcgacacccacacccacagaatcggcagaaccggcagagccggcgagaagggcgtggcctacaccctgctgacccccaaggacagcaacttcgccggcgacctggtgagaaacctggagggcgccaaccagcacgtgagcaaggagctgctggacctggccatgcagaacgcctggttcagaaagagcagattcaagggcggcaagggcaagaagctgaacatcggcggcggcggcctgggctacagagagagacccggcctgggcagcgagaacatggacagaggcaacaacaacgtgatgagcaactacgaggcctacaagcccagcaccggcgccatgggcgacagactgaccgccatgaaggccgccttccagagccagtacaagagccacttcgtggccgccagcctgagcaaccagaaggccggcagcagcgccgccggcgccagcggctggaccagcgccggcagcctgaacagcgtgcccaccaacagcgcccagcagggccacaacagccccgacagccccgtgaccagcgccgccaagggcatccccggcttcggcaacaccggcaacatcagcggcgcccccgtgacctaccccagcgccggcgcccagggcgtgaacaacaccgccagcggcaacaacagcagagagggcaccggcggcagcaacggcaagagagagagatacaccgagaacagaggcagcagcagacacagccacggcgagaccggcaacagacacagcgacagccccagacacggcgacggcggcagacacggcgacggctacagacaccccgagagcagcagcagacacaccgacggccacagacacggcgagaacagacacggcggcagcgccggcagacacggcgagaacagaggcgccaacgacggcagaaacggcgagagcagaaaggaggccttcaacagagagagcaagatggagcccaagatggagcccaaggtggacagcagcaagatggacaaggtggacagcaagaccgacaagaccgccgacggcttcgccgtgcccgagccccccaagagaaagaagagcagatgggacagctag

SEQ ID NO: 78716 - DNA, 2817 bp, Artificial Sequence; identical to SEQ ID NO: 78715
  Description of Artificial Sequence: Synthetic coding sequence

SEQ ID NO: 78717 - DNA, 2817 bp, Artificial Sequence; identical to SEQ ID NO: 78715
  Description of Artificial Sequence: Synthetic coding sequence

SEQ ID NO: 78718 - DNA, 2817 bp, Artificial Sequence; identical to SEQ ID NO: 78715
  Description of Artificial Sequence: Synthetic coding sequence

SEQ ID NO: 78719 - DNA, 1947 bp, Artificial Sequence
  Description of Artificial Sequence: Synthetic coding sequence
atgagccaccacggcggcgcccccaaggccagcacctgggtggtggccagcagaagaagcagcaccgtgagcagagcccccgagagaagacccgccgaggagctgaacagaaccggccccgagggctacagcgtgggcagaggcggcagatggagaggcaccagcagaccccccgaggccgtggccgccggccacgaggagctgcccctgtgcttcgccctgaagagccacttcgtgggcgccgtgatcggcagaggcggcagcaagatcaagaacatccagagcaccaccaacaccaccatccagatcatccaggagcagcccgagagcctggtgaagatcttcggcagcaaggccatgcagaccaaggccaaggccgtgatcgacaacttcgtgaagaagctggaggagaactacaacagcgagtgcggcatcgacaccgccttccagcccagcgtgggcaaggacggcagcaccgacaacaacgtggtggccggcgacagacccctgatcgactgggaccagatcagagaggagggcctgaagtggcagaagaccaagtgggccgacctgccccccatcaagaagaacttctacaaggagagcaccgccaccagcgccatgagcaaggtggaggccgacagctggagaaaggagaacttcaacatcacctgggacgacctgaaggacggcgagaagagacccatccccaaccccacctgcaccttcgacgacgccttccagtgctaccccgaggtgatggagaacatcaagaaggccggcttccagaagcccacccccatccagagccaggcctggcccatcgtgctgcagggcatcgacctgatcggcgtggcccagaccggcaccggcaagaccctgtgctacctgatgcccggcttcatccacctggtgctgcagcccagcctgaagggccagagaaacagacccggcatgctggtgctgacccccaccagagagctggccctgcaggtggagggcgagtgctgcaagtacagctacaagggcctgagaagcgtgtgcgtgtacggcggcggcaacagagacgagcagatcgaggagctgaagaagggcgtggacatcatcatcgccacccccggcagactgaacgacctgcagatgagcaacttcgtgaacctgaagaacatcacctacctggtgctggacgaggccgacaagatgctggacatgggcttcgagccccagatcatgaagatcctgctggacgtgagacccgacagacagaccgtgatgaccagcgccacctggccccacagcgtgcacagactggcccagagctacctgaaggagcccatgatcgtgtacgtgggcaccctggacctggtggccgtgagcagcgtgaagcagaacatcatcgtgaccaccgaggaggagaagtggagccacatgcagaccttcctgcagagcatgagcagcaccgacaaggtgatcgtgttcgtgagcagaaaggccgtggccgaccacctgagcagcgacctgatcctgggcaacatcagcgtggagagcctgcacggcgacagagagcagagagacagagagaaggccctggagaacttcaagaccggcaaggtgagaatcctgatcgccaccgacctggccagcagaggcctggacgtgcacgacgtgacccacgtgtacaacttcgacttccccagaaacatcgaggagtacgtgcacagaatcggcagaaccggcagagccggcagaaccggcgtgagcatcaccaccctgaccagaaacgactggagagtggccagcgagctgatcaacatcctggagagagccaaccagagcatccccgaggagctggtgagcatggccgagagattcaaggcccaccagcagaagagagagatggagagaaagatggagagaccccagggcagacccaagaagttccactag

SEQ ID NO: 78720 - DNA, 588 bp, Artificial Sequence
  Description of Artificial Sequence: Synthetic coding sequence
atgagccaccacggcggcgcccccaaggccagcacctgggtggtggccagcagaagaagcagcaccgtgagcagagcccccgagagaagacccgccgaggagctgaacagaaccggccccgagggctacagcgtgggcagaggcggcagatggagaggcaccagcagaccccccgaggccgtggccgccggccacgaggagctgcccctgtgcttcgccctgaagagccacttcgtgggcgccgtgatcggcagaggcggcagcaagatcaagaacatccagagcaccaccaacaccaccatccagatcatccaggagcagcccgagagcctggtgaagatcttcggcagcaaggccatgcagaccaaggccaaggccgtgatcgacaacttcgtgaagaagctggaggagaactacaacagcgagtgcggcatcgacaccgccttccagcccagcgtgggcaaggacggcagcaccgacaacaacgtggtggccggcgacagacccctgatcgactgggaccagatcagagaggagggcctgaagtggcagaagaccaagtgggccggcaagaagatcctgatctag

SEQ ID NO: 78721 - DNA, 675 bp, Artificial Sequence
  Description of Artificial Sequence: Synthetic coding sequence
atggagagcggcgcctacggcgccgccaaggccggcggcagcttcgacctgagaagattcctgacccagccccaggtggtggccagagccgtgtgcctggtgttcgccctgatcgtgttcagctgcatctacggcgagggctacagcaacgcccacgagagcaagcagatgtactgcgtgttcaacagaaacgaggacgcctgcagatacggcagcgccatcggcgtgctggccttcctggccagcgccttcttcctggtggtggacgcctacttcccccagatcagcaacgccaccgacagaaagtacctggtgatcggcgacctgctgttcagcgccctgtggaccttcctgtggttcgtgggcttctgcttcctgaccaaccagtgggccgtgaccaaccccaaggacgtgctggtgggcgccgacagcgtgagagccgccatcaccttcagcttcttcagcatcttcagctggggcgtgctggccagcctggcctaccagagatacaaggccggcgtggacgacttcatccagaactacgtggaccccacccccgaccccaacaccgcctacgccagctaccccggcgccagcgtggacaactaccagcagccccccttcacccagaacgccgagaccaccgagggctaccagcccccccccgtgtactag

SEQ ID NO: 78722 - DNA, 1635 bp, Artificial Sequence
  Description of Artificial Sequence: Synthetic coding sequence
atgagcggctacagcagcgacagagacagaggcagagacagaggcttcggcgcccccagattcggcggcagcagagccggccccctgagcggcaagaagttcggcaaccccggcgagaagctggtgaagaagaagtggaacctggacgagctgcccaagttcgagaagaacttctaccaggagcaccccgacctggccagaagaaccgcccaggaggtggagacctacagatacctgctgcccgccatcgtgcacatcaaccaccagcccttcctggagagaggcgacggccccatctgcctggtgctggcccccaccagagagctggcccagcaggtgcagcaggtggccgccgagtactgcagagcctgcagactgaagagcacctgcatctacggcggcgcccccaagggcccccagatcagagacctggagagaggcgtggagatctgcatcgccacccccggcagactgatcgacttcctggagtgcggcaagaccaacctgagaagaaccacctacctggtgctggacgaggccgacagaatgctggacatgggcttcgagccccagatcagaaagatcgtggaccagatcagacccgacagacagaccctgatgtggagcgccacctggcccaaggaggtgagacagctggccgaggacttcctgaaggactacatccacatcaacatcggcgccctggagctgagcgccaaccacaacatcctgcagatcgtggacgtgtgccacgacgtggagaaggacgagaagctgatcagactgatggaggagatcatgagcgagaaggagaacaagaccatcgtgttcgtggagaccaagagaagatgcgacgagctgaccagaaagatgagaagagacggctggcccgccatgggcatccacggcgacaagagccagcaggagagagactgggtgctgaacgagttcaagcacggcaaggcccccatcctgatcgccaccgacgtggccagcagaggcctggacgtggaggacgtgaagttcgtgatcaactacgactaccccaacagcagcgaggactacatccacagaatcggcagaaccgccagaagcaccaagaccggcaccgcctacaccttcttcacccccaacaacatcaagcaggtgagcgacctgatcagcgtgctgagagaggccaaccaggccatcaaccccaagctgctgcagctggtggaggacagaggcagcggcagaagcagaggcagaggcggcatgaaggacgacagaagagacagatacagcgccggcaagagaggcggcttcaacaccttcagagacagagagaactacgacagaggctacagcagcctgctgaagagagacttcggcgccaagacccagaacggcgtgtacagcgccgccaactacaccaacggcagcttcggcagcaacttcgtgagcgccggcatccagaccagcttcagaaccggcaaccccaccggcacctaccagaacggctacgacagcacccagcagtacggcagcaacgtgcccaacatgcacaacggcatgaaccagcaggcctacgcctaccccgccaccgccgccgcccccatgatcggctaccccatgcccaccggctacagccagtag

SEQ ID NO: 78723 - DNA, 1845 bp, Artificial Sequence
  Description of Artificial Sequence: Synthetic coding sequence
atgagcggctacagcagcgacagagacagaggcagagacagaggcttcggcgcccccagattcggcggcagcagagccggccccctgagcggcaagaagttcggcaaccccggcgagaagctggtgaagaagaagtggaacctggacgagctgcccaagttcgagaagaacttctaccaggagcaccccgacctggccagaagaaccgcccaggaggtggagacctacagaagaagcaaggagatcaccgtgagaggccacaactgccccaagcccgtgctgaacttctacgaggccaacttccccgccaacgtgatggacgtgatcgccagacagaacttcaccgagcccaccgccatccaggcccagggctggcccgtggccctgagcggcctggacatggtgggcgtggcccagaccggcagcggcaagaccctgagctacctgctgcccgccatcgtgcacatcaaccaccagcccttcctggagagaggcgacggccccatctgcctggtgctggcccccaccagagagctggcccagcaggtgcagcaggtggccgccgagtactgcagagcctgcagactgaagagcacctgcatctacggcggcgcccccaagggcccccagatcagagacctggagagaggcgtggagatctgcatcgccacccccggcagactgatcgacttcctggagtgcggcaagaccaacctgagaagaaccacctacctggtgctggacgaggccgacagaatgctggacatgggcttcgagccccagatcagaaagatcgtggaccagatcagacccgacagacagaccctgatgtggagcgccacctggcccaaggaggtgagacagctggccgaggacttcctgaaggactacatccacatcaacatcggcgccctggagctgagcgccaaccacaacatcctgcagatcgtggacgtgtgccacgacgtggagaaggacgagaagctgatcagactgatggaggagatcatgagcgagaaggagaacaagaccatcgtgttcgtggagaccaagagaagatgcgacgagctgaccagaaagatgagaagagacggctggcccgccatgggcatccacggcgacaagagccagcaggagagagactgggtgctgaacgagttcaagcacggcaaggcccccatcctgatcgccaccgacgtggccagcagaggcctggacgtggaggacgtgaagttcgtgatcaactacgactaccccaacagcagcgaggactacatccacagaatcggcagaaccgccagaagcaccaagaccggcaccgcctacaccttcttcacccccaacaacatcaagcaggtgagcgacctgatcagcgtgctgagagaggccaaccaggccatcaaccccaagctgctgcagctggtggaggacagaggcagcggcagaagcagaggcagaggcggcatgaaggacgacagaagagacagatacagcgccggcaagagaggcggcttcaacaccttcagagacagagagaactacgacagaggctacagcagcctgctgaagagagacttcggcgccaagacccagaacggcgtgtacagcgccgccaactacaccaacggcagcttcggcagcaacttcgtgagcgccggcatccagaccagcttcagaaccggcaaccccaccggcacctaccagaacggctacgacagcacccagcagtacggcagcaacgtgcccaacatgcacaacggcatgaaccagcaggcctacgcctaccccgccaccgccgccgcccccatgatcggctaccccatgcccaccggctacagccagtag

SEQ ID NO: 78724 - DNA, 1800 bp, Artificial Sequence
  Description of Artificial Sequence: Synthetic coding sequence
atggacgtgcacgacctgttcagaagactgggcgccggcgccaagttcgacaccagaagattcagcgccgacgccgccagattccagatcggcaagagaaagtacgacttcgacagcagcgaggtgctgcagggcctggacttcttcggcaacaagaagagcgtgcccggcgtgtgcggcgccagccagacccaccagaagccccagaacggcgagaagaaggaggagagcctgaccgagagaaagagagagcagagcaagaagaagagaaagaccatgaccagcgagatcgccagccaggaggagggcgccaccatccagtggatgagcagcgtggaggccaagatcgaggacaagaaggtgcagagagagagcaagctgaccagcggcaagctggagaacctgagaaaggagaagatcaacttcctgagaaacaagcacaagatccacgtgcagggcaccgacctgcccgaccccatcgccaccttccagcagctggaccaggagtacaagatcaacagcagactgctgcagaacatcctggacgccggcttccagatgcccacccccatccagatgcaggccatccccgtgatgctgcacggcagagagctgctggccagcgcccccaccggcagcggcaagaccctggccttcagcatccccatcctgatgcagctgaagcagcccgccaacaagggcttcagagccctgatcatcagccccaccagagagctggccagccagatccacagagagctgatcaagatcagcgagggcaccggcttcagaatccacatgatccacaaggccgccgtggccgccaagaagttcggccccaagagcagcaagaagttcgacatcctggtgaccacccccaacagactgatctacctgctgaagcaggacccccccggcatcgacctggccagcgtggagtggctggtggtggacgagagcgacaagctgttcgaggacggcaagaccggcttcagagaccagctggccagcatcttcctggcctgcaccagccacaaggtgagaagagccatgttcagcgccaccttcgcctacgacgtggagcagtggtgcaagctgaacctggacaacgtgatcagcgtgagcatcggcgccagaaacagcgccgtggagaccgtggagcaggagctgctgttcgtgggcagcgagaccggcaagctgctggccatgagagagctggtgaagaagggcttcaacccccccgtgctggtgttcgtgcagagcatcgagagagccaaggagctgttccacgagctgatctacgagggcatcaacgtggacgtgatccacgccgagagaacccagcagcagagagacaacaccgtgcacagcttcagagccggcaagatctgggtgctgatctgcaccgccctgctggccagaggcatcgacttcaagggcgtgaacctggtgatcaactacgacttccccaccagcagcgtggagtacatccacagaatcggcagaaccggcagagccggcaacaagggcaaggccatcaccttcttcaccgaggacgacaagcccctgctgagaagcgtggccaacgtgatccagcaggccggctgccccgtgcccgagtacatcaagggcttccagaagctgctgagcaagcagaagaagaagatgatcaagaagcccctggagagagagagcatcagcaccacccccaagtgcttcctggagaaggccaaggacaagcagaagaaggtgaccggccagaacagcaagaagaaggtggccctggaggacaagagctag

SEQ ID NO: 78725 - DNA, 1476 bp, Artificial Sequence
  Description of Artificial Sequence: Synthetic coding sequence
atgagcagcgtggaggccaagatcgaggacaagaaggtgcagagagagagcaagctgaccagcggcaagctggagaacctgagaaaggagaagatcaacttcctgagaaacaagcacaagatccacgtgcagggcaccgacctgcccgaccccatcgccaccttccagcagctggaccaggagtacaagatcaacagcagactgctgcagaacatcctggacgccggcttccagatgcccacccccatccagatgcaggccatccccgtgatgctgcacggcagagagctgctggccagcgcccccaccggcagcggcaagaccctggccttcagcatccccatcctgatgcagctgaagcagcccgccaacaagggcttcagagccctgatcatcagccccaccagagagctggccagccagatccacagagagctgatcaagatcagcgagggcaccggcttcagaatccacatgatccacaaggccgccgtggccgccaagaagttcggccccaagagcagcaagaagttcgacatcctggtgaccacccccaacagactgatctacctgctgaagcaggacccccccggcatcgacctggccagcgtggagtggctggtggtggacgagagcgacaagctgttcgaggacggcaagaccggcttcagagaccagctggccagcatcttcctggcctgcaccagccacaaggtgagaagagccatgttcagcgccaccttcgcctacgacgtggagcagtggtgcaagctgaacctggacaacgtgatcagcgtgagcatcggcgccagaaacagcgccgtggagaccgtggagcaggagctgctgttcgtgggcagcgagaccggcaagctgctggccatgagagagctggtgaagaagggcttcaacccccccgtgctggtgttcgtgcagagcatcgagagagccaaggagctgttccacgagctgatctacgagggcatcaacgtggacgtgatccacgccgagagaacccagcagcagagagacaacaccgtgcacagcttcagagccggcaagatctgggtgctgatctgcaccgccctgctggccagaggcatcgacttcaagggcgtgaacctggtgatcaactacgacttccccaccagcagcgtggagtacatccacagaatcggcagaaccggcagagccggcaacaagggcaaggccatcaccttcttcaccgaggacgacaagcccctgctgagaagcgtggccaacgtgatccagcaggccggctgccccgtgcccgagtacatcaagggcttccagaagctgctgagcaagcagaagaagaagatgatcaagaagcccctggagagagagagcatcagcaccacccccaagtgcttcctggagaaggccaaggacaagcagaagaaggtgaccggccagaacagcaagaagaaggtggccctggaggacaagagctag

SEQ ID NO: 78726 - DNA, 2646 bp, Artificial Sequence
  Description of Artificial Sequence: Synthetic coding sequence
atggccgccgacaagggccccgccgccggccccagaagcagagccgccatggcccagtggagaaagaagaagggcctgagaaagagaagaggcgccgccagccaggccagaggcagcgacagcgaggacggcgagttcgagatccaggccgaggacgacgccagagccagaaagctgggccccggcagacccctgcccaccttccccaccagcgagtgcaccagcgacgtggagcccgacaccagagagatggtgagagcccagaacaagaagaagaagaagagcggcggcttccagagcatgggcctgagctaccccgtgttcaagggcatcatgaagaagggctacaaggtgcccacccccatccagagaaagaccatccccgtgatcctggacggcaaggacgtggtggccatggccagaaccggcagcggcaagaccgcctgcttcctgctgcccatgttcgagagactgaagacccacagcgcccagaccggcgccagagccctgatcctgagccccaccagagagctggccctgcagaccctgaagttcaccaaggagctgggcaagttcaccggcctgaagaccgccctgatcctgggcggcgacagaatggaggaccagttcgccgccctgcacgagaaccccgacatcatcatcgccacccccggcagactggtgcacgtggccgtggagatgagcctgaagctgcagagcgtggagtacgtggtgttcgacgaggccgacagactgttcgagatgggcttcgccgagcagctgcaggagatcatcgccagactgcccggcggccaccagaccgtgctgttcagcgccaccctgcccaagctgctggtggagttcgccagagccggcctgaccgagcccgtgctgatcagactggacgtggacaccaagctgaacgagcagctgaagaccagcttcttcctggtgagagaggacaccaaggccgccgtgctgctgcacctgctgcacaacgtggtgagaccccaggaccagaccgtggtgttcgtggccaccaagcaccacgccgagtacctgaccgagctgctgaccacccagagagtgagctgcgcccacatctacagcgccctggaccccaccgccagaaagatcaacctggccaagttcaccctgggcaagtgcagcaccctgatcgtgaccgacctggccgccagaggcctggacatccccctgctggacaacgtgatcaactacagcttccccgccaagggcaagctgttcctgcacagagtgggcagagtggccagagccggcagaagcggcaccgcctacagcctggtggcccccgacgagatcccctacctgctggacctgcacctgttcctgggcagaagcctgaccctggccagacccctgaaggagcccagcggcgtggccggcgtggacggcatgctgggcagagtgccccagagcgtggtggacgaggaggacagcggcctgcagagcaccctggaggccagcctggagctgagaggcctggccagagtggccgacaacgcccagcagcagtacgtgagaagcagacccgcccccagccccgagagcatcaagagagccaaggagatggacctggtgggcctgggcctgcaccccctgttcagcagcagattcgaggaggaggagctgcagagactgagactggtggacagcatcaagaactacagaagcagagccaccatcttcgagatcaacgccagcagcagagacctgtgcagccaggtgatgagagccaagagacagaaggacagaaaggccatcgccagattccagcagggccagcagggcagacaggagcagcaggagggccccgtgggccccgcccccagcagacccgccctgcaggagaagcagcccgagaaggaggaggaggaggaggccggcgagagcgtggaggacatcttcagcgaggtggtgggcagaaagagacagagaagcggccccaacagaggcgccaagagaagaagagaggaggccagacagagagaccaggagttctacatcccctacagacccaaggacttcgacagcgagagaggcctgagcatcagcggcgagggcggcgccttcgagcagcaggccgccggcgccgtgctggacctgatgggcgacgaggcccagaacctgaccagaggcagacagcagctgaagtgggacagaaagaagaagagattcgtgggccagagcggccaggaggacaagaagaagatcaagaccgagagcggcagatacatcagcagcagctacaagagagacctgtaccagaagtggaagcagaagcagaagatcgacgacagagacagcgacgaggagggcgccagcgacagaagaggccccgagagaagaggcggcaagagagacagaggccagggcgccagcagaccccacgcccccggcacccccgccggcagagtgagacccgagctgaagaccaagcagcagatcctgaagcagagaagaagagcccagaagctgcacttcctgcagagaggcggcctgaagcagctgagcgccagaaacagaagaagagtgcaggagctgcagcagggcgccttcggcagaggcgccagaagcaagaagggcaagatgagaaagagaatgtag

SEQ ID NO: 78727 - DNA, 2649 bp, Artificial Sequence
  Description of Artificial Sequence: Synthetic coding sequence
atggccgccgacaagggccccgccgccggccccagaagcagagccgccatggcccagtggagaaagaagaagggcctgagaaagagaagaggcgccgccagccaggccagaggcagcgacagcgaggacggcgagttcgagatccaggccgaggacgacgccagagccagaaagctgggccccggcagacccctgcccaccttccccaccagcgagtgcaccagcgacgtggagcccgacaccagagagatggtgagagcccagaacaagaagaagaagaagagcggcggcttccagagcatgggcctgagctaccccgtgttcaagggcatcatgaagaagggctacaaggtgcccacccccatccagagaaagaccatccccgtgatcctggacggcaaggacgtggtggccatggccagaaccggcagcggcaagaccgcctgcttcctgctgcccatgttcgagagactgaagacccacagcgcccagaccggcgccagagccctgatcctgagccccaccagagagctggccctgcagaccctgaagttcaccaaggagctgggcaagttcaccggcctgaagaccgccctgatcctgggcggcgacagaatggaggaccagttcgccgccctgcacgagaaccccgacatcatcatcgccacccccggcagactggtgcacgtggccgtggagatgagcctgaagctgcagagcgtggagtacgtggtgttcgacgaggccgacagactgttcgagatgggcttcgccgagcagctgcaggagatcatcgccagactgcccggcggccaccagaccgtgctgttcagcgccaccctgcccaagctgctggtggagttcgccagagccggcctgaccgagcccgtgctgatcagactggacgtggacaccaagctgaacgagcagctgaagaccagcttcttcctggtgagagaggacaccaaggccgccgtgctgctgcacctgctgcacaacgtggtgagaccccaggaccagaccgtggtgttcgtggccaccaagcaccacgccgagtacctgaccgagctgctgaccacccagagagtgagctgcgcccacatctacagcgccctggaccccaccgccagaaagatcaacctggccaagttcaccctgggcaagtgcagcaccctgatcgtgaccgacctggccgccagaggcctggacatccccctgctggacaacgtgatcaactacagcttccccgccaagggcaagctgttcctgcacagagtgggcagagtggccagagccggcagaagcggcaccgcctacagcctggtggcccccgacgagatcccctacctgctggacctgcacctgttcctgggcagaagcctgaccctggccagacccctgaaggagcccagcggcgtggccggcgtggacggcatgctgggcagagtgccccagagcgtggtggacgaggaggacagcggcctgcagagcaccctggaggccagcctggagctgagaggcctggccagagtggccgacaacgcccagcagcagtacgtgagaagcagacccgcccccagccccgagagcatcaagagagccaaggagatggacctggtgggcctgggcctgcaccccctgttcagcagcagattcgaggaggaggagctgcagagactgagactggtggacagcatcaagaactacagaagcagagccaccatcttcgagatcaacgccagcagcagagacctgtgcagccaggtgatgagagccaagagacagaaggacagaaaggccatcgccagattccagcagggccagcagggcagacaggagcagcaggagggccccgtgggccccgcccccagcagacccgccctgcaggagaagcagcccgagaaggaggaggaggaggaggccggcgagagcgtggaggacatcttcagcgaggtggtgggcagaaagagacagagaagcggccccaacagaggcgccaagagaagaagagaggaggccagacagagagaccaggagttctacatcccctacagacccaaggacttcgacagcgagagaggcctgagcatcagcggcgagggcggcgccttcgagcagcaggccgccggcgccgtgctggacctgatgggcgacgaggcccagaacctgaccagaggcagacagcagctgaagtgggacagaaagaagaagagattcgtgggccagagcggccaggaggacaagaagaagatcaagaccgagagcggcagatacatcagcagcagctacaagagagacctgtaccagaagtggaagcagaagcagaagatcgacgacagagacagcgacgaggagggcgccagcgacagaagaggccccgagagaagaggcggcaagagagacagaggccaggccggcgccagcagaccccacgcccccggcacccccgccggcagagtgagacccgagctgaagaccaagcagcagatcctgaagcagagaagaagagcccagaagctgcacttcctgcagagaggcggcctgaagcagctgagcgccagaaacagaagaagagtgcaggagctgcagcagggcgccttcggcagaggcgccagaagcaagaagggcaagatgagaaagagaatgtag

SEQ ID NO: 78728 - DNA, 1452 bp, Artificial Sequence
  Description of Artificial Sequence: Synthetic coding sequence
atgagcaccgccagaaccgagaaccccgtgatcatgggcctgagcagccagaacggccagctgagaggccccgtgaagcccaccggcggccccggcggcggcggcacccagacccagcagcagatgaaccagctgaagaacaccaacaccatcaacaacggcacccagcagcaggcccagagcatgaccaccaccatcaagcccggcgacgactggaagaagaccctgaagctgccccccaaggacctgagaatcaagaccagcgacgtgaccagcaccaagggcaacgagttcgaggactactgcctgaagagagagctgctgatgggcatcttcgagatgggctgggagaagcccagccccatccaggaggagagcatccccatcgccctgagcggcagagacatcctggccagagccaagaacggcaccggcaagagcggcgcctacctgatccccctgctggagagactggacctgaagaaggacaacatccaggccatggtgatcgtgcccaccagagagctggccctgcaggtgagccagatctgcatccaggtgagcaagcacatgggcggcgccaaggtgatggccaccaccggcggcaccaacctgagagacgacatcatgagactggacgacaccgtgcacgtggtgatcgccacccccggcagaatcctggacctgatcaagaagggcgtggccaaggtggaccacgtgcagatgatcgtgctggacgaggccgacaagctgctgagccaggacttcgtgcagatcatggaggacatcatcctgaccctgcccaagaacagacagatcctgctgtacagcgccaccttccccctgagcgtgcagaagttcatgaacagccacctgcagaagccctacgagatcaacctgatggaggagctgaccctgaagggcgtgacccagtactacgcctacgtgaccgagagacagaaggtgcactgcctgaacaccctgttcagcagactgcagatcaaccagagcatcatcttctgcaacagcagccagagagtggagctgctggccaagaagatcagccagctgggctacagctgcttctacatccacgccaagatgagacaggagcacagaaacagagtgttccacgacttcagaaacggcctgtgcagaaacctggtgtgcaccgacctgttcaccagaggcatcgacatccaggccgtgaacgtggtgatcaacttcgacttccccaagctggccgagacctacctgcacagaatcggcagaagcggcagattcggccacctgggcctggccatcaacctgatcacctacgacgacagattcaacctgaagagcatcgaggagcagctgggcaccgagatcaagcccatccccagcaacatcgacaagagcctgtacgtggccgagtaccacagcgagcccgtggaggacgagaagccctag

SEQ ID NO: 78729 - DNA, 1452 bp, Artificial Sequence; identical to SEQ ID NO: 78728
  Description of Artificial Sequence: Synthetic coding sequence

SEQ ID NO: 78730 - DNA, 1452 bp, Artificial Sequence; identical to SEQ ID NO: 78728
  Description of Artificial Sequence: Synthetic coding sequence

SEQ ID NO: 78731 - DNA, 564 bp, Artificial Sequence
  Description of Artificial Sequence: Synthetic coding sequence
atgagcaccgccagaaccgagaaccccgtgatcatgggcctgagcagccagaacggccagctgagaggccccgtgaagcccaccggcggccccggcggcggcggcacccagacccagcagcagatgaaccagctgaagaacaccaacaccatcaacaacggcacccagcagcaggcccagagcatgaccaccaccatcaagcccggcgacgactggaagaagaccctgaagctgccccccaaggacctgagaatcaagaccagcgacgtgaccagcaccaagggcaacgagttcgaggactactgcctgaagagagagctgctgatgggcatcttcgagatgggctgggagaagcccagccccatccaggaggagagcatccccatcgccctgagcggcagagacatcctggccagagccaagaacggcaccggcaagagcggcgcctacctgatccccctgctggagagactggacctgaagaaggacaacatccaggccatggtgatcgtgcccaccagagagctggccctgcaggtgagccagatctgcaccgtgtgctag

SEQ ID NO: 78732 - DNA, 5139 bp, Artificial Sequence
  Description of Artificial Sequence: Synthetic coding sequence
atggagagaaacgtgctgaccaccttcagccaggagatgagccagctgatcctgaacgagatgcccaaggccgagtacagcagcctgttcaacgacttcgtggagagcgagttcttcctgatcgacggcgacagcctgctgatcacctgcatctgcgagatcagcttcaagcccggccagaacctgcacttcttctacctggtggagagatacctggtggacctgatcagcaagggcggccagttcaccatcgtgttcttcaaggacgccgagtacgcctacttcaacttccccgagctgctgagcctgagaaccgccctgatcctgcacctgcagaagaacaccaccatcgacgtgagaaccaccttcagcagatgcctgagcaaggagtggggcagcttcctggaggagagctacccctacttcctgatcgtggccgacgagggcctgaacgacctgcagacccagctgttcaacttcctgatcatccacagctgggccagaaaggtgaacgtggtgctgagcagcggccaggagagcgacgtgctgtgcctgtacgcctacctgctgcccagcatgtacagacaccagatcttcagctggaagaacaagcagaacatcaaggacgcctacaccaccctgctgaaccagctggagagattcaagctgagcgccctggcccccctgttcggcagcctgaagtggaacaacatcaccgaggaggcccacaagaccgtgagcctgctgacccaggtgtggcccgagggcagcgacatcagaagagtgttctgcgtgaccagctgcagcctgagcctgagaatgtaccacagattcctgggcaacagagagcccagcagcggccaggagaccgagatccagcaggtgaacagcaactgcctgaccctgcaggagatggaggacctgtgcaagctgcactgcctgaccgtggtgttcctgctgcacctgcccctgagccagagagcctgcgccagagtgatcaccagccactgggccgaggacatgaagcccctgctgcagatgaagaagtggtgcgagtacttcatcctgagaaacatccacaccttcgagttctggaacctgaacctgatccacctgagcgacctgaacgacgagctgctgctgaagaacatcgccttctactacgagaacgagaacgtgaagggcctgcacctgaacctgggcgacaccatcatgaaggactacgagtacctgtggaacaccgtgagcaagctggtgagagacttcgaggtgggccagcccttccccctgagaaccaccaaggtgtgcttcctggagaagaagcccagccccatcaaggacagcagcaacgagatggtgcccaacctgggcttcatccccaccagcagcttcgtggtggacaagttcgccggcgacatcctgaaggacctgcccttcctgaagagcgacgaccccatcgtgaccagcctggtgaagcagaaggagttcgacgagctggtgcactggcacagccacaagcccctgagcgacgactacgacagaagcagatgccagttcgacgagaagagcagagaccccagagtgctgagaagcgtgcagaagtaccacgtgttccagagattctacggcaacagcctggagaccgtgagcagcaagatcatcgtgacccagaccatcaagagcaagaaggacttcagcggccccaagagcaagaaggcccacgagaccaaggccgagatcatcgccagagagaacaagaagagactgttcgccagagaggagcagaaggaggagcagaagtggaacgccctgagcttcagcatcgaggagcagctgaaggagaacctgcacagcggcatcaagagcctggaggacttcctgaagagctgcaagagcagctgcgtgaagctgcaggtggagatggtgggcctgaccgcctgcctgaaggcctggaaggagcactgcagaagcgaggagggcaagaccaccaaggacctgagcatcgccgtgcaggtgatgaagagaatccacagcctgatggagaagtacagcgagctgctgcaggaggacgacagacagctgatcgccagatgcctgaagtacctgggcttcgacgagctggccagcagcctgcaccccgcccaggacgccgagaacgacgtgaaggtgaagaagagaaacaagtacagcgtgggcatcggccccgccagattccagctgcagtacatgggccactacctgatcagagacgagagaaaggaccccgaccccagagtgcaggacttcatccccgacacctggcagagagagctgctggacgtggtggacaagaacgagagcgccgtgatcgtggcccccaccagcagcggcaagacctacgccagctactactgcatggagaaggtgctgaaggagagcgacgacggcgtggtggtgtacgtggcccccaccaaggccctggtgaaccaggtggccgccaccgtgcagaacagattcaccaagaacctgcccagcggcgaggtgctgtgcggcgtgttcaccagagagtacagacacgacgccctgaactgccaggtgctgatcaccgtgcccgcctgcttcgagatcctgctgctggccccccacagacagaactgggtgaagaagatcagatacgtgatcttcgacgaggtgcactgcctgggcggcgagatcggcgccgagatctgggagcacctgctggtgatgatcagatgccccttcctggccctgagcgccaccatcagcaaccccgagcacctgaccgagtggctgcagagcgtgaagtggtactggaagcaggaggacaagatcatcgagaacaacaccgccagcaagagacacgtgggcagacaggccggcttccccaaggactacctgcaggtgaagcagagctacaaggtgagactggtgctgtacggcgagagatacaacgacctggagaagcacgtgtgcagcatcaagcacggcgacatccacttcgaccacttccacccctgcgccgccctgaccaccgaccacatcgagagatacggcttcccccccgacctgaccctgagccccagagagagcatccagctgtacgacgccatgttccagatctggaagagctggcccagagcccaggagctgtgccccgagaacttcatccacttcaacaacaagctggtgatcaagaagatggacgccagaaagtacgaggagagcctgaaggccgagctgaccagctggatcaagaacggcaacgtggagcaggccagaatggtgctgcagaacctgagccccgaggccgacctgagccccgagaacatgatcaccatgttccccctgctggtggagaagctgagaaagatggagaagctgcccgccctgttcttcctgttcaagctgggcgccgtggagaacgccgccgagagcgtgagcaccttcctgaagaagaagcaggagaccaagagaccccccaaggccgacaaggaggcccacgtgatggccaacaagctgagaaaggtgaagaagagcatcgagaagcagaagatcatcgacgagaagagccagaagaagaccagaaacgtggaccagagcctgatccacgaggccgagcacgacaacctggtgaagtgcctggagaagaacctggagatcccccaggactgcacctacgccgaccagaaggccgtggacaccgagaccctgcagaaggtgttcggcagagtgaagttcgagagaaagggcgaggagctgaaggccctggccgagagaggcatcggctaccaccacagcgccatgagcttcaaggagaagcagctggtggagatcctgttcagaaagggctacctgagagtggtgaccgccaccggcaccctggccctgggcgtgaacatgccctgcaagagcgtggtgttcgcccagaacagcgtgtacctggacgccctgaactacagacagatgagcggcagagccggcagaagaggccaggacctgatgggcgacgtgtacttcttcgacatccccttccccaagatcggcaagctgatcaagagcaacgtgcccgagctgagaggccacttccccctgagcatcaccctggtgctgagactgatgctgctggccagcaagggcgacgaccccgaggacgccaaggccaaggtgctgagcgtgctgaagcacagcctgctgagcttcaagcagcccagagtgatggacatgctgaagctgtacttcctgttcagcctgcagttcctggtgaaggagggctacctggaccaggagggcaaccccatgggcttcgccggcctggtgagccacctgcactaccacgagcccagcaacctggtgttcgtgagcttcctggtgaacggcctgttccacgacctgtgccagcccaccagaaagggcagcaagcacttcagccaggacgtgatggagaagctggtgctggtgctggcccacctgttcggcagaagatacttcccccccaagttccaggacgcccacttcgagttctaccagagcaaggtgttcctggacgacctgcccgaggacttcagcgacgccctggacgagtacaacatgaagatcatggaggacttcaccaccttcctgagaatcgtgagcaagctggccgacatgaaccaggagtaccagctgcccctgagcaagatcaagttcaccggcaaggagtgcgaggacagccagctggtgagccacctgatgagctgcaaggagggcagagtggccatcagccccttcgtgtgcctgagcggcaacttcgacgacgacctgctgagactggagacccccaaccacgtgaccctgggcaccatcggcgtgaacagaagccaggcccccgtgctgctgagccagaagttcgacaacagaggcagaaagatgagcctgaacgcctacgccctggacttctacaagcacggcagcctgatcggcctggtgcaggacaacagaatgaacgagggcgacgcctactacctgctgaaggacttcgccctgaccatcaagagcatcagcgtgagcctgagagagctgtgcgagaacgaggacgacaacgtggtgctggccttcgagcagctgagcaccaccttctgggagaagctgaacaaggtgtag

SEQ ID NO: 78733 - DNA, 363 bp, Artificial Sequence
  Description of Artificial Sequence: Synthetic coding sequence
atggagagaaacgtgctgaccaccttcagccaggagatgagccagctgatcctgaacgagatgcccaaggccgagtacagcagcctgttcaacgacttcgtggagagcgagttcttcctgatcgacggcgacagcctgctgatcacctgcatctgcgagatcagcttcaagcccggccagaacctgcacttcttctacctggtggagagatacctggtggacctgatcagcaagggcggccagttcaccatcgtgttcttcaaggacgccgagtacgcctacttcaacttccccgagctgctgagcctgagaaccgccctgatcctgcacctgcagaagaacaccaccatcgacgtgagatag

SEQ ID NO: 78734 - DNA, 885 bp, Artificial Sequence
  Description of Artificial Sequence: Synthetic coding sequence
atgatcagatgccccttcctggccctgagcgccaccatcagcaaccccgagcacctgaccgagtggctgcagagcgtgaagtggtactggaagcaggaggacaagatcatcgagaacaacaccgccagcaagagacacgtgggcagacaggccggcttccccaaggactacctgcaggtgaagcagagctacaaggtgagactggtgctgtacggcgagagatacaacgacctggagaagcacgtgtgcagcatcaagcacggcgacatccacttcgaccacttccacccctgcgccgccctgaccaccgaccacatcgagagatacggcttcccccccgacctgaccctgagccccagagagagcatccagctgtacgacgccatgttccagatctggaagagctggcccagagcccaggagctgtgccccgagaacttcatccacttcaacaacaagctggtgatcaagaagatggacgccagaaagtacgaggagagcctgaaggccgagctgaccagctggatcaagaacggcaacgtggagcaggccagaatggtgctgcagaacctgagccccgaggccgacctgagccccgagaacatgatcaccatgttccccctgctggtggagaagctgagaaagatggagaagctgcccgccctgttcttcctgttcaagctgggcgccgtggagaacgccgccgagagcgtgagcaccttcctgaagaagaagcaggagaccaagagaccccccaaggccgacaaggaggcccacgtgatggccaacaagctgagaaaggtgaagaagagcatcgagaagcagaagatcatcgacgagaagagccagaagaaccagaagtgcggcagcaagcccaacacctag

SEQ ID NO: 78735 - DNA, 1062 bp, Artificial Sequence
  Description of Artificial Sequence: Synthetic coding sequence
atgcagagcaagagagactgcgagctgtggtgcgagagagtgaaccccgagaacaaggccgccctggaggcctgggtgagagagaccggcatcagactggtgcaggtgaacggccagagaaagtacggcggccccccccccggctgggtgggcagccccccccccgccggcagcgaggtgttcatcggcagactgccccaggacgtgtacgagcaccagctgatccccctgttccagagagtgggcagactgtacgagttcagactgatgatgaccttcagcggcctgaacagaggcttcgcctacgccagatacagcagcagaagaggcgcccaggccgccatcgccaccctgcacaaccaccccctgagacccagctgccccctgctggtgtgcagaagcaccgagaagtgcgagctgagcgtggacggcctgccccccaacctgaccagaagcgccctgctgctggccctgcagcccctgggccccggcctgcaggaggccagactgctgcccagccccggccccgcccccggccagatcgccctgctgaagttcagcagccacagagccgccgccatggccaagaaggccctggtggagggccagagccacctgtgcggcgagcaggtggccgtggagtggctgaagcccgacctgaagcagagactgagacagcagctggtgggccccttcctgagaagcccccagcccgagggcagccagctggccctggccagagacaagctgggcttccagggcgccagagccaccctgcagctgctgtgccagagaatgaagctgggcagccccgtgttcctgaccaagtgcctgggcatcggccccgccggctggcacagattctggtaccaggtggtgatccccggccaccccgtgcccttcagcggcctgatctgggtggtgctgaccctggacggcagagacggccacgaggtggccaaggacgccgtgagcgtgagactgctgcaggccctgagcgagagcggcgccaacctgctgtggagcgccggcgccgaggccggcaccatggtgaagcagtag

SEQ ID NO: 78736 - DNA, 1491 bp, Artificial Sequence
  Description of Artificial Sequence: Synthetic coding sequence
atgttcgccaaggccaccagaaacttcctgagagaggtggacgccgacggcgacctgatcgccgtgagcaacctgaacgacagcgacaagctgcagctgctgagcctggtgaccaagaagaagagattctggtgctggcagagacccaagtaccagttcctgagcctgaccctgggcgacgtgctgatcgaggaccagttccccagccccgtggtggtggagagcgacttcgtgaagtacgagggcaagttcgccaaccacgtgagcggcaccctggagaccgccctgggcaaggtgaagctgaacctgggcggcagcagcagagtggagagccagagcagcttcggcaccctgagaaagcaggaggtggacctgcagcagctgatcagagacagcgccgagagaaccatcaacctgagaaaccccgtgctgcagcaggtgctggagggcagaaacgaggtgctgtgcgtgctgacccagaagatcaccaccatgcagaagtgcgtgatcagcgagcacatgcaggtggaggagaagtgcggcggcatcgtgggcatccagaccaagaccgtgcaggtgagcgccaccgaggacggcaacgtgaccaaggacagcaacgtggtgctggagatccccgccgccaccaccatcgcctacggcgtgatcgagctgtacgtgaagctggacggccagttcgagttctgcctgctgagaggcaagcagggcggcttcgagaacaagaagagaatcgacagcgtgtacctggaccccctggtgttcagagagttcgccttcatcgacatgcccgacgccgcccacggcatcagcagccaggacggccccctgagcgtgctgaagcaggccaccctgctgctggagagaaacttccaccccttcgccgagctgcccgagccccagcagaccgccctgagcgacatcttccaggccgtgctgttcgacgacgagctgctgatggtgctggagcccgtgtgcgacgacctggtgagcggcctgagccccaccgtggccgtgctgggcgagctgaagcccagacagcagcaggacctggtggccttcctgcagctggtgggctgcagcctgcagggcggctgccccggccccgaggacgccggcagcaagcagctgttcatgaccgcctacttcctggtgagcgccctggccgagatgcccgacagcgccgccgccctgctgggcacctgctgcaagctgcagatcatccccaccctgtgccacctgctgagagccctgagcgacgacggcgtgagcgacctggaggaccccaccctgacccccctgaaggacaccgagagattcggcatcgtgcagagactgttcgccagcgccgacatcagcctggagagactgaagagcagcgtgaaggccgtgatcctgaaggacagcaaggtgttccccctgctgctgtgcatcaccctgaacggcctgtgcgccctgggcagagagcacagctag

SEQ ID NO: 78737 - DNA, 1491 bp, Artificial Sequence; identical to SEQ ID NO: 78736
  Description of Artificial Sequence: Synthetic coding sequence

SEQ ID NO: 78738 - DNA, 999 bp, Artificial Sequence
  Description of Artificial Sequence: Synthetic coding sequence
atgcagaagtgcgtgatcagcgagcacatgcaggtggaggagaagtgcggcggcatcgtgggcatccagaccaagaccgtgcaggtgagcgccaccgaggacggcaacgtgaccaaggacagcaacgtggtgctggagatccccgccgccaccaccatcgcctacggcgtgatcgagctgtacgtgaagctggacggccagttcgagttctgcctgctgagaggcaagcagggcggcttcgagaacaagaagagaatcgacagcgtgtacctggaccccctggtgttcagagagttcgccttcatcgacatgcccgacgccgcccacggcatcagcagccaggacggccccctgagcgtgctgaagcaggccaccctgctgctggagagaaacttccaccccttcgccgagctgcccgagccccagcagaccgccctgagcgacatcttccaggccgtgctgttcgacgacgagctgctgatggtgctggagcccgtgtgcgacgacctggtgagcggcctgagccccaccgtggccgtgctgggcgagctgaagcccagacagcagcaggacctggtggccttcctgcagctggtgggctgcagcctgcagggcggctgccccggccccgaggacgccggcagcaagcagctgttcatgaccgcctacttcctggtgagcgccctggccgagatgcccgacagcgccgccgccctgctgggcacctgctgcaagctgcagatcatccccaccctgtgccacctgctgagagccctgagcgacgacggcgtgagcgacctggaggaccccaccctgacccccctgaaggacaccgagagattcggcatcgtgcagagactgttcgccagcgccgacatcagcctggagagactgaagagcagcgtgaaggccgtgatcctgaaggacagcaaggtgttccccctgctgctgtgcatcaccctgaacggcctgtgcgccctgggcagagagcacagctag

SEQ ID NO: 78739 - DNA, 999 bp, Artificial Sequence; identical to SEQ ID NO: 78738
  Description of Artificial Sequence: Synthetic coding sequence

SEQ ID NO: 78740 - DNA, 1575 bp, Artificial Sequence
  Description of Artificial Sequence: Synthetic coding sequence
atggccaacagcgccggcttcctgggcgacctgaccaccgagggcatcaacaagcccggcttctacaagggccccgccggcagccaggtgaccctgagcagcctgggcaaccagaccagagtgctgctggaggagcaggccagacacctgctgaacgagcaggagcacgccaccatggcctactacctggacgagtacagaggcggcagcgtgagcgtggaggccctggtgatggccctgttcaagctgctgaacacccacgccaagttcagcctgctgagcgaggtgagaggcaccatcagcccccaggacctggagagattcgaccacctggtgctgagaagagagatcgagagcatgaaggccagacagccccccggccccggcgccggcgacacctacagcatggtgagctacagcgacaccggcagcagcaccggcagccacggcaccagcaccaccgtgagcagcgccagaaacaccctggacctggaggagaccggcgaggccgtgcagggcaacatcaacgccctgcccgacgtgagcgtggacgacgtgagaagcaccagccagggcctgagcagcttcaagcccctgcccagacccccccccctggcccagggcaacgacctgcccctgggccagcccagaaagctgggcagagaggacctgcagccccccagcagcatgcccagctgcagcggcaccgtgttcagcgccccccagaacagaagcccccccgccggcaccgcccccacccccggcaccagcagcgcccaggacctgcccagcagccccatctacgccagcgtgagccccgccaaccccagcagcaagagacccctggacgcccacctggccctggtgaaccagcaccccatcggccccttccccagagtgcagagccccccccacctgaagagccccagcgccgaggccaccgtggccggcggctgcctgctgccccccagccccagcggccaccccgaccagaccggcaccaaccagcacttcgtgatggtggaggtgcacagacccgacagcgagcccgacgtgaacgaggtgagagccctgccccagaccagaaccgccagcaccctgagccacctgagcgacagcggccagaccctgagcgaggacagcggcgtggacgccggcgaggccgaggccagcgcccccggcagaggcagacagagcgtgagcaccaagagcagaagcagcaaggagctgcccagaaacgagagacccaccgacggcgccaacaagccccccggcctgctggagcccaccagcaccctggtgagagtgaagaagagcgccgccaccctgggcatcgccatcgagggcggcgccaacaccagacagcccctgcccagaatcgtgaccatccagagaggcggcagcgcccacaactgcggccagctgaaggtgggccacgtgatcctggaggtgaacggcctgaccctgagaggcaaggagcacagagaggccgccagaatcatcgccgaggccttcaagaccaaggacagagactacatcgacttcctggtgaccgagttcaacgtgatgctgtag

SEQ ID NO: 78741 - DNA, 2724 bp, Artificial Sequence
  Description of Artificial Sequence: Synthetic coding sequence
atgaacgcccccctggacggcctgagcgtgagcagcagcagcaccggcagcctgggcagcgccgccggcgccggcggcggcggcggcgccggcctgagactgctgagcgccaacgtgagacagctgcaccaggccctgaccgccctgctgagcgaggccgagagagagcagttcacccactgcctgaacgcctaccacgccagaagaaacgtgttcgacctggtgagaaccctgagagtgctgctggacagccccgtgaagagaagactgctgcccatgctgagactggtgatccccagaagcgaccagctgctgttcgaccagtacaccgccgagggcctgtacctgcccgccaccaccccctacagacagcccgcctggggcggccccgacagcgccggccccggcgaggtgagactggtgagcctgagaagagccaaggcccacgagggcctgggcttcagcatcagaggcggcagcgagcacggcgtgggcatctacgtgagcctggtggagcccggcagcctggccgagaaggagggcctgagagtgggcgaccagatcctgagagtgaacgacaagagcctggccagagtgacccacgccgaggccgtgaaggccctgaagggcagcaagaagctggtgctgagcgtgtacagcgccggcagaatccccggcggctacgtgaccaaccacatctacacctgggtggacccccagggcagaagcatcagcccccccagcggcctgccccagccccacggcggcgccctgagacagcaggagggcgacagaagaagcaccctgcacctgctgcagggcggcgacgagaagaaggtgaacctggtgctgggcgacggcagaagcctgggcctgaccatcagaggcggcgccgagtacggcctgggcatctacatcaccggcgtggaccccggcagcgaggccgagggcagcggcctgaaggtgggcgaccagatcctggaggtgaacggcagaagcttcctgaacatcctgcacgacgaggccgtgagactgctgaagagcagcagacacctgatcctgaccgtgaaggacgtgggcagactgcccagagccagaaccaccgtggacgagaccaagtggatcgccagcagcagaatcagagagaccatggccaacagcgccggcttcctgggcgacctgaccaccgagggcatcaacaagcccggcttctacaagggccccgccggcagccaggtgaccctgagcagcctgggcaaccagaccagagtgctgctggaggagcaggccagacacctgctgaacgagcaggagcacgccaccatggcctactacctggacgagtacagaggcggcagcgtgagcgtggaggccctggtgatggccctgttcaagctgctgaacacccacgccaagttcagcctgctgagcgaggtgagaggcaccatcagcccccaggacctggagagattcgaccacctggtgctgagaagagagatcgagagcatgaaggccagacagccccccggccccggcgccggcgacacctacagcatggtgagctacagcgacaccggcagcagcaccggcagccacggcaccagcaccaccgtgagcagcgccagaaacaccctggacctggaggagaccggcgaggccgtgcagggcaacatcaacgccctgcccgacgtgagcgtggacgacgtgagaagcaccagccagggcctgagcagcttcaagcccctgcccagacccccccccctggcccagggcaacgacctgcccctgggccagcccagaaagctgggcagagaggacctgcagccccccagcagcatgcccagctgcagcggcaccgtgttcagcgccccccagaacagaagcccccccgccggcaccgcccccacccccggcaccagcagcgcccaggacctgcccagcagccccatctacgccagcgtgagccccgccaaccccagcagcaagagacccctggacgcccacctggccctggtgaaccagcaccccatcggccccttccccagagtgcagagccccccccacctgaagagccccagcgccgaggccaccgtggccggcggctgcctgctgccccccagccccagcggccaccccgaccagaccggcaccaaccagcacttcgtgatggtggaggtgcacagacccgacagcgagcccgacgtgaacgaggtgagagccctgccccagaccagaaccgccagcaccctgagccacctgagcgacagcggccagaccctgagcgaggacagcggcgtggacgccggcgaggccgaggccagcgcccccggcagaggcagacagagcgtgagcaccaagagcagaagcagcaaggagctgcccagaaacgagagacccaccgacggcgccaacaagccccccggcctgctggagcccaccagcaccctggtgagagtgaagaagagcgccgccaccctgggcatcgccatcgagggcggcgccaacaccagacagcccctgcccagaatcgtgaccatccagagaggcggcagcgcccacaactgcggccagctgaaggtgggccacgtgatcctggaggtgaacggcctgaccctgagaggcaaggagcacagagaggccgccagaatcatcgccgaggccttcaagaccaaggacagagactacatcgacttcctggtgaccgagttcaacgtgatgctgtag

SEQ ID NO: 78742 - DNA, 1038 bp, Artificial Sequence
  Description of Artificial Sequence: Synthetic coding sequence
atgaacgcccccctggacggcctgagcgtgagcagcagcagcaccggcagcctgggcagcgccgccggcgccggcggcggcggcggcgccggcctgagactgctgagcgccaacgtgagacagctgcaccaggccctgaccgccctgctgagcgaggccgagagagagcagttcacccactgcctgaacgcctaccacgccagaagaaacgtgttcgacctggtgagaaccctgagagtgctgctggacagccccgtgaagagaagactgctgcccatgctgagactggtgatccccagaagcgaccagctgctgttcgaccagtacaccgccgagggcctgtacctgcccgccaccaccccctacagacagcccgcctggggcggccccgacagcgccggccccggcgaggtgagactggtgagcctgagaagagccaaggcccacgagggcctgggcttcagcatcagaggcggcagcgagcacggcgtgggcatctacgtgagcctggtggagcccggcagcctggccgagaaggagggcctgagagtgggcgaccagatcctgagagtgaacgacaagagcctggccagagtgacccacgccgaggccgtgaaggccctgaagggcagcaagaagctggtgctgagcgtgtacagcgccggcagaatccccggcggctacgtgaccaaccacatctacacctgggtggacccccagggcagaagcatcagcccccccagcggcctgccccagccccacggcggcgccctgagacagcaggagggcgacagaagaagcaccctgcacctgctgcagggcggcgacgagaagaaggtgagcggcgtgggcaagggcggccagcccctgagacacagaatcctgccccccaaccccgagcagcagagctgcctggaggccgccagaagaggctggttctgccccggcagcgtgttcccccaggtgtgcaccgagggctggtgcttcttcttcgccttcctgttcgacctgtgcagcgtgtgctacaacaccggctag

SEQ ID NO: 78743 - DNA, 1671 bp, Artificial Sequence
  Description of Artificial Sequence: Synthetic coding sequence
atgcacggcagcctggaggccctgctgttcctgccccaggtgaccctgagcctggcccacgcccacctgatctgcagcaacgcccagctggagatgtgcgtgttcccccacagattcctgggcgacctgaccaccgagggcatcaacaagcccggcttctacaagggccccgccggcagccaggtgaccctgagcagcctgggcaaccagaccagagtgctgctggaggagcaggccagacacctgctgaacgagcaggagcacgccaccatggcctactacctggacgagtacagaggcggcagcgtgagcgtggaggccctggtgatggccctgttcaagctgctgaacacccacgccaagttcagcctgctgagcgaggtgagaggcaccatcagcccccaggacctggagagattcgaccacctggtgctgagaagagagatcgagagcatgaaggccagacagccccccggccccggcgccggcgacacctacagcatggtgagctacagcgacaccggcagcagcaccggcagccacggcaccagcaccaccgtgagcagcgccagaaacaccctggacctggaggagaccggcgaggccgtgcagggcaacatcaacgccctgcccgacgtgagcgtggacgacgtgagaagcaccagccagggcctgagcagcttcaagcccctgcccagacccccccccctggcccagggcaacgacctgcccctgggccagcccagaaagctgggcagagaggacctgcagccccccagcagcatgcccagctgcagcggcaccgtgttcagcgccccccagaacagaagcccccccgccggcaccgcccccacccccggcaccagcagcgcccaggacctgcccagcagccccatctacgccagcgtgagccccgccaaccccagcagcaagagacccctggacgcccacctggccctggtgaaccagcaccccatcggccccttccccagagtgcagagccccccccacctgaagagccccagcgccgaggccaccgtggccggcggctgcctgctgccccccagccccagcggccaccccgaccagaccggcaccaaccagcacttcgtgatggtggaggtgcacagacccgacagcgagcccgacgtgaacgaggtgagagccctgccccagaccagaaccgccagcaccctgagccacctgagcgacagcggccagaccctgagcgaggacagcggcgtggacgccggcgaggccgaggccagcgcccccggcagaggcagacagagcgtgagcaccaagagcagaagcagcaaggagctgcccagaaacgagagacccaccgacggcgccaacaagccccccggcctgctggagcccaccagcaccctggtgagagtgaagaagagcgccgccaccctgggcatcgccatcgagggcggcgccaacaccagacagcccctgcccagaatcgtgaccatccagagaggcggcagcgcccacaactgcggccagctgaaggtgggccacgtgatcctggaggtgaacggcctgaccctgagaggcaaggagcacagagaggccgccagaatcatcgccgaggccttcaagaccaaggacagagactacatcgacttcctggtgaccgagttcaacgtgatgctgtag

SEQ ID NO: 78744 - DNA, 1059 bp, Artificial Sequence
  Description of Artificial Sequence: Synthetic coding sequence
atgttcgccgccgccaccaagagcttcgtgaagcaggtgggcgacggcggcagactggtgcccgtgcccagcctgagcgaggccgacaagtaccagcccctgagcctggtggtgaagaagaagagatgcttcctgttccccagatacaagttcaccagcacccccttcaccctgaaggacatcctgctgggcgacagagagatcagcgccggcatcagcagctaccagctgctgaactacgaggacgagagcgacgtgagcctgtacggcagaagaggcaaccacatcgtgaacgacgtgggcatcaacgtggccggcagcgacagcatcgccgtgaaggccagcttcggcatcgtgaccaagcacgaggtggaggtgagcaccctgctgaaggagatcaccaccagaaagatcaacttcgaccacagcctgatcagacagagcagaagcagcagaaaggccgtgctgtgcgtggtgatggagagcatcagaaccaccagacagtgcagcctgagcgtgcacgccggcatcagaggcgaggccatgagattccacttcatggacgagcagaaccccaagggcagagacaaggccatcgtgttccccgcccacaccaccatcgccttcagcgtgttcgagctgttcatctacctggacggcgccttcgacctgtgcgtgaccagcgtgagcaagggcggcttcgagagagaggagaccgccaccttcgccctgctgtacagactgagaaacatcctgttcgagagaaacagaagagtgatggacgtgatcagcagaagccagctgtacctggacgacctgttcagcgactactacgacaagcccctgagcatgaccgacatcagcctgaaggagggcacccacatcagagtgaacctgctgaaccacaacatccccaagggcccctgcatcctgtgcggcatgggcaacttcaagagagagaccgtgtacggctgcttccagtgcagcgtggacggccagaagtacgtgagactgcacgccgtgccctgcttcgacatctggcacaagagaatgaagtag

SEQ ID NO: 78745 - DNA, 1059 bp, Artificial Sequence; identical to SEQ ID NO: 78744
  Description of Artificial Sequence: Synthetic coding sequence

SEQ ID NO: 78746 - DNA, 2388 bp, Artificial Sequence
  Description of Artificial Sequence: Synthetic coding sequence
atgagcaagagacacagactggacctgggcgaggactaccccagcggcaagaagagagccggcaccgacggcaaggacagagacagagacagagacagagaggacagaagcaaggacagagacagagagagagacagaggcgacagagagagagagagagagaaggagaaggagaaggagctgagagccagcaccaacgccatgctgatcagcgccggcctgccccccctgaaggccagccacagcgcccacagcacccacagcgcccacagcacccacagcacccacagcgcccacagcacccacgccggccacgccggccacaccagcctgccccagtgcatcaaccccttcaccaacctgccccacacccccagatactacgacatcctgaagaagagactgcagctgcccgtgtgggagtacaaggacagattcaccgacatcctggtgagacaccagagcttcgtgctggtgggcgagaccggcagcggcaagaccacccagatcccccagtggtgcgtggagtacatgagaagcctgcccggccccaagagaggcgtggcctgcacccagcccagaagagtggccgccatgagcgtggcccagagagtggccgacgagatggacgtgatgctgggccaggaggtgggctacagcatcagattcgaggactgcagcagcgccaagaccatcctgaagtacatgaccgacggcatgctgctgagagaggccatgaacgaccccctgctggagagatacggcgtgatcatcctggacgaggcccacgagagaaccctggccaccgacatcctgatgggcgtgctgaaggaggtggtgagacagagaagcgacctgaaggtgatcgtgatgagcgccaccctggacgccggcaagttccagatctacttcgacaactgccccctgctgaccatccccggcagaacccaccccgtggagatcttctacacccccgagcccgagagagactacctggaggccgccatcagaaccgtgatccagatccacatgtgcgaggaggaggagggcgacctgctgctgttcctgaccggccaggaggagatcgacgaggcctgcaagagaatcaagagagaggtggacgacctgggccccgaggtgggcgacatcaagatcatccccctgtacagcaccctgcccccccagcagcagcagagaatcttcgagccccccccccccaagaagcagaacggcgccatcggcagaaaggtggtggtgagcaccaacatcgccgagaccagcctgaccatcgacggcgtggtgttcgtgatcgaccccggcttcgccaagcagaaggtgtacaaccccagaatcagagtggagagcctgctggtgaccgccatcagcaaggccagcgcccagcagagagccggcagagccggcagaaccagacccggcaagtgcttcagactgtacaccgagaaggcctacaagaccgagatgcaggacaacacctaccccgagatcctgagaagcaacctgggcagcgtggtgctgcagctgaagaagctgggcatcgacgacctggtgcacttcgacttcatggacccccccgcccccgagaccctgatgagagccctggagctgctgaactacctggccgccctgaacgacgacggcgacctgaccgagctgggcagcatgatggccgagttccccctggacccccagctggccaagatggtgatcgccagctgcgactacaactgcagcaacgaggtgctgagcatcaccgccatgctgagcgtgccccagtgcttcgtgagacccaccgaggccaagaaggccgccgacgaggccaagatgagattcgcccacatcgacggcgaccacctgaccctgctgaacgtgtaccacgccttcaagcagaaccacgagagcgtgcagtggtgctacgacaacttcatcaactacagaagcctgatgagcgccgacaacgtgagacagcagctgagcagaatcatggacagattcaacctgcccagaagaagcaccgacttcaccagcagagactactacatcaacatcagaaaggccctggtgaccggctacttcatgcaggtggcccacctggagagaaccggccactacctgaccgtgaaggacaaccaggtggtgcagctgcaccccagcaccgtgctggaccacaagcccgagtgggtgctgtacaacgagttcgtgctgaccaccaagaactacatcagaacctgcaccgacatcaagcccgagtggctggtgaagatcgccccccagtactacgacatgagcaacttcccccagtgcgaggccaagagacagctggacagaatcatcgccaagctgcagagcaaggagtacagccagtactag

SEQ ID NO: 78747 - DNA, 2355 bp, Artificial Sequence
  Description of Artificial Sequence: Synthetic coding sequence
atgagcaagagacacagactggacctgggcgaggactaccccagcggcaagaagagagccggcaccgacggcaaggacagagacagagacagagagagagacagaggcgacagagagagagagagagagaaggagaaggagaaggagctgagagccagcaccaacgccatgctgatcagcgccggcctgccccccctgaaggccagccacagcgcccacagcacccacagcgcccacagcacccacagcacccacagcgcccacagcacccacgccggccacgccggccacaccagcctgccccagtgcatcaaccccttcaccaacctgccccacacccccagatactacgacatcctgaagaagagactgcagctgcccgtgtgggagtacaaggacagattcaccgacatcctggtgagacaccagagcttcgtgctggtgggcgagaccggcagcggcaagaccacccagatcccccagtggtgcgtggagtacatgagaagcctgcccggccccaagagaggcgtggcctgcacccagcccagaagagtggccgccatgagcgtggcccagagagtggccgacgagatggacgtgatgctgggccaggaggtgggctacagcatcagattcgaggactgcagcagcgccaagaccatcctgaagtacatgaccgacggcatgctgctgagagaggccatgaacgaccccctgctggagagatacggcgtgatcatcctggacgaggcccacgagagaaccctggccaccgacatcctgatgggcgtgctgaaggaggtggtgagacagagaagcgacctgaaggtgatcgtgatgagcgccaccctggacgccggcaagttccagatctacttcgacaactgccccctgctgaccatccccggcagaacccaccccgtggagatcttctacacccccgagcccgagagagactacctggaggccgccatcagaaccgtgatccagatccacatgtgcgaggaggaggagggcgacctgctgctgttcctgaccggccaggaggagatcgacgaggcctgcaagagaatcaagagagaggtggacgacctgggccccgaggtgggcgacatcaagatcatccccctgtacagcaccctgcccccccagcagcagcagagaatcttcgagccccccccccccaagaagcagaacggcgccatcggcagaaaggtggtggtgagcaccaacatcgccgagaccagcctgaccatcgacggcgtggtgttcgtgatcgaccccggcttcgccaagcagaaggtgtacaaccccagaatcagagtggagagcctgctggtgaccgccatcagcaaggccagcgcccagcagagagccggcagagccggcagaaccagacccggcaagtgcttcagactgtacaccgagaaggcctacaagaccgagatgcaggacaacacctaccccgagatcctgagaagcaacctgggcagcgtggtgctgcagctgaagaagctgggcatcgacgacctggtgcacttcgacttcatggacccccccgcccccgagaccctgatgagagccctggagctgctgaactacctggccgccctgaacgacgacggcgacctgaccgagctgggcagcatgatggccgagttccccctggacccccagctggccaagatggtgatcgccagctgcgactacaactgcagcaacgaggtgctgagcatcaccgccatgctgagcgtgccccagtgcttcgtgagacccaccgaggccaagaaggccgccgacgaggccaagatgagattcgcccacatcgacggcgaccacctgaccctgctgaacgtgtaccacgccttcaagcagaaccacgagagcgtgcagtggtgctacgacaacttcatcaactacagaagcctgatgagcgccgacaacgtgagacagcagctgagcagaatcatggacagattcaacctgcccagaagaagcaccgacttcaccagcagagactactacatcaacatcagaaaggccctggtgaccggctacttcatgcaggtggcccacctggagagaaccggccactacctgaccgtgaaggacaaccaggtggtgcagctgcaccccagcaccgtgctggaccacaagcccgagtgggtgctgtacaacgagttcgtgctgaccaccaagaactacatcagaacctgcaccgacatcaagcccgagtggctggtgaagatcgccccccagtactacgacatgagcaacttcccccagtgcgaggccaagagacagctggacagaatcatcgccaagctgcagagcaaggagtacagccagtactag

SEQ ID NO: 78748 - DNA, 1683 bp, Artificial Sequence
  Description of Artificial Sequence: Synthetic coding sequence
atggagagccagcccgcccaggagtgcctgatgcagatgttcctgcccatcgagcccgcctgcttcgtggagtggctgggcaccagccccagccagctgggcgtggtgatggtggacgaggcccacgagagaaccctgcacaccgacatcctgttcggcctgatcaaggacgtggccagattcagacccgagctgaaggtgctggtggccagcgccaccatggacaccgccagattcagcaccttcttcgacgacgcccccgtgttcagaatccccggcagaagattccccgtggacatcttctacaccaaggcccccgaggccgactacctggaggcctgcgtggtgagcgtgctgcagatccacgtgacccagccccccggcgacatcctggtgttcctgaccggccaggaggagatcgaggccgcctgcgagatgctgcaggacagatgcagaagactgggcagcaagatcagagagctgctggtgctgcccatctacgccaacctgcccagcgacatgcaggccagaatcttccagcccaccccccccggcgccagaaaggtggtggtggccaccaacatcgccgagaccagcctgaccatcgagggcatcatctacgtgctggaccccggcttctgcaagcagaagagctacaaccccagaaccggcatggagagcctgaccgtgaccccctgcagcaaggccagcgccaaccagagagccggcagagccggcagagtggccgccggcaagtgcttcagactgtacaccgcctgggcctaccagcacgagctggaggagaccaccgtgcccgagatccagagaaccagcctgggcaacgtggtgctgctgctgaagagcctgggcatccacgacctgatgcacttcgacttcctggacccccccccctacgagaccctgctgctggccctggagcagctgtacgccctgggcgccctgaaccacctgggcgagctgaccaccagcggcagaaagatggccgagctgcccgtggaccccatgctgagcaagatgatcctggccagcgagaagtacagctgcagcgaggagatcctgaccgtggccgccatgctgagcgtgaacaacagcatcttctacagacccaaggacaaggtggtgcacgccgacaacgccagagtgaacttcttcctgcccggcggcgaccacctggtgctgctgaacgtgtacacccagtgggccgagagcggctacagcagccagtggtgctacgagaacttcgtgcagttcagaagcatgagaagagccagagacgtgagagagcagctggagggcctgctggagagagtggaggtgggcctgagcagctgccagggcgactacatcagagtgagaaaggccatcaccgccggctacttctaccacaccgccagactgaccagaagcggctacagaaccgtgaagcagcagcagaccgtgttcatccaccccaacagcagcctgttcgagcagcagcccagatggctgctgtaccacgagctggtgctgaccaccaaggagttcatgagacaggtgctggagatcgagagcagctggctgctggaggtggccccccactactacaaggccaaggagctggaggacccccacgccaagaagatgcccaagaagatcggcaagaccagagaggagctgggctag

SEQ ID NO: 78749 - DNA, 3126 bp, Artificial Sequence
  Description of Artificial Sequence: Synthetic coding sequence
atggccacccccgccggcctggagagatgggtgcaggacgagctgcacagcgtgctgggcctgagcgagagacacgtggcccagttcctgatcggcaccgcccagagatgcaccagcgccgaggagttcgtgcagagactgagagacaccgacaccctggacctgagcggccccgccagagacttcgccctgagactgtggaacaaggtgcccagaaaggccgtggtggagaagcccgccagagccgccgagagagaggccagagccctgctggagaagaacagaagctacagactgctggaggacagcgaggagagcagcgaggagaccgtgagcagagccggcagcagcctgcagaagaagagaaagaagagaaagcacctgagaaagaagagagaggaggaggaggaggaggaggccagcgagaagggcaagaagaagaccggcggcagcaagcagcagaccgagaagcccgagagcgaggacgagtgggagagaaccgagagagagagactgcaggacctggaggagagagacgccttcgccgagagagtgagacagagagacaaggacagaaccagaaacgtgctggagagaagcgacaagaaggcctacgaggaggcccagaagagactgaagatggccgaggaggacagaaaggccatggtgcccgagctgagaaagaagagcagaagagagtacctggccaagagagagagagagaagctggaggacctggaggccgagctggccgacgaggagttcctgttcggcgacgtggagctgagcagacacgagagacaggagctgaagtacaagagaagagtgagagacctggccagagagtacagagccgccggcgagcaggagaagctggaggccaccaacagataccacatgcccaaggagaccagaggccagcccgccagagccgtggacctggtggaggaggagagcggcgcccccggcgaggagcagagaagatgggaggaggccagactgggcgccgccagcctgaagttcggcgccagagacgccgccagccaggagcccaagtaccagctggtgctggaggaggaggagaccatcgagttcgtgagagccacccagctgcagggcgacgaggagcccagcgccccccccaccagcacccaggcccagcagaaggagagcatccaggccgtgagaagaagcctgcccgtgttccccttcagagaggagctgctggccgccatcgccaaccaccaggtgctgatcatcgagggcgagaccggcagcggcaagaccacccagatcccccagtacctgttcgaggagggctacaccaacaagggcatgaagatcgcctgcacccagcccagaagagtggccgccatgagcgtggccgccagagtggccagagagatgggcgtgaagctgggcaacgaggtgggctacagcatcagattcgaggactgcaccagcgagagaaccgtgctgagatacatgaccgacggcatgctgctgagagagttcctgagcgagcccgacctggccagctacagcgtggtgatggtggacgaggcccacgagagaaccctgcacaccgacatcctgttcggcctgatcaaggacgtggccagattcagacccgagctgaaggtgctggtggccagcgccaccatggacaccgccagattcagcaccttcttcgacgacgcccccgtgttcagaatccccggcagaagattccccgtggacatcttctacaccaaggcccccgaggccgactacctggaggcctgcgtggtgagcgtgctgcagatccacgtgacccagccccccggcgacatcctggtgttcctgaccggccaggaggagatcgaggccgcctgcgagatgctgcaggacagatgcagaagactgggcagcaagatcagagagctgctggtgctgcccatctacgccaacctgcccagcgacatgcaggccagaatcttccagcccaccccccccggcgccagaaaggtggtggtggccaccaacatcgccgagaccagcctgaccatcgagggcatcatctacgtgctggaccccggcttctgcaagcagaagagctacaaccccagaaccggcatggagagcctgaccgtgaccccctgcagcaaggccagcgccaaccagagagccggcagagccggcagagtggccgccggcaagtgcttcagactgtacaccgcctgggcctaccagcacgagctggaggagaccaccgtgcccgagatccagagaaccagcctgggcaacgtggtgctgctgctgaagagcctgggcatccacgacctgatgcacttcgacttcctggacccccccccctacgagaccctgctgctggccctggagcagctgtacgccctgggcgccctgaaccacctgggcgagctgaccaccagcggcagaaagatggccgagctgcccgtggaccccatgctgagcaagatgatcctggccagcgagaagtacagctgcagcgaggagatcctgaccgtggccgccatgctgagcgtgaacaacagcatcttctacagacccaaggacaaggtggtgcacgccgacaacgccagagtgaacttcttcctgcccggcggcgaccacctggtgctgctgaacgtgtacacccagtgggccgagagcggctacagcagccagtggtgctacgagaacttcgtgcagttcagaagcatgagaagagccagagacgtgagagagcagctggagggcctgctggagagagtggaggtgggcctgagcagctgccagggcgactacatcagagtgagaaaggccatcaccgccggctacttctaccacaccgccagactgaccagaagcggctacagaaccgtgaagcagcagcagaccgtgttcatccaccccaacagcagcctgttcgagcagcagcccagatggctgctgtaccacgagctggtgctgaccaccaaggagttcatgagacaggtgctggagatcgagagcagctggctgctggaggtggccccccactactacaaggccaaggagctggaggacccccacgccaagaagatgcccaagaagatcggcaagaccagagaggagctgggctag

SEQ ID NO: 78750 - DNA, 1683 bp, Artificial Sequence
  Description of Artificial Sequence: Synthetic coding sequence
atggagagccagcccgcccaggagtgcctgatgcagatgttcctgcccatcgagcccgcctgcttcgtggagtggctgggcaccagccccagccagctgggcgtggtgatggtggacgaggcccacgagagaaccctgcacaccgacatcctgttcggcctgatcaaggacgtggccagattcagacccgagctgaaggtgctggtggccagcgccaccatggacaccgccagattcagcaccttcttcgacggcgcccccgtgttcagaatccccggcagaagattccccgtggacatcttctacaccaaggcccccgaggccgactacctggaggcctgcgtggtgagcgtgctgcagatccacgtgacccagccccccggcgacatcctggtgttcctgaccggccaggaggagatcgaggccgcctgcgagatgctgcaggacagatgcagaagactgggcagcaagatcagagagctgctggtgctgcccatctacgccaacctgcccagcgacatgcaggccagaatcttccagcccaccccccccggcgccagaaaggtggtggtggccaccaacatcgccgagaccagcctgaccatcgagggcatcatctacgtgctggaccccggcttctgcaagcagaagagctacaaccccagaaccggcatggagagcctgaccgtgaccccctgcagcaaggccagcgccaaccagagagccggcagagccggcagagtggccgccggcaagtgcttcagactgtacaccgcctgggcctaccagcacgagctggaggagaccaccgtgcccgagatccagagaaccagcctgggcaacgtggtgctgctgctgaagagcctgggcatccacgacctgatgcacttcgacttcctggacccccccccctacgagaccctgctgctggccctggagcagctgtacgccctgggcgccctgaaccacctgggcgagctgaccaccagcggcagaaagatggccgagctgcccgtggaccccatgctgagcaagatgatcctggccagcgagaagtacagctgcagcgaggagatcctgaccgtggccgccatgctgagcgtgaacaacagcatcttctacagacccaaggacaaggtggtgcacgccgacaacgccagagtgaacttcttcctgcccggcggcgaccacctggtgctgctgaacgtgtacacccagtgggccgagagcggctacagcagccagtggtgctacgagaacttcgtgcagttcagaagcatgagaagagccagagacgtgagagagcagctggagggcctgctggagagagtggaggtgggcctgagcagctgccagggcgactacatcagagtgagaaaggccatcaccgccggctacttctaccacaccgccagactgaccagaagcggctacagaaccgtgaagcagcagcagaccgtgttcatccaccccaacagcagcctgttcgagcagcagcccagatggctgctgtaccacgagctggtgctgaccaccaaggagttcatgagacaggtgctggagatcgagagcagctggctgctggaggtggccccccactactacaaggccaaggagctggaggacccccacgccaagaagatgcccaagaagatcggcaagaccagagaggagctgggctag

SEQ ID NO: 78751 - DNA, 3126 bp, Artificial Sequence
  Description of Artificial Sequence: Synthetic coding sequence
atggccacccccgccggcctggagagatgggtgcaggacgagctgcacagcgtgctgggcctgagcgagagacacgtggcccagttcctgatcggcaccgcccagagatgcaccagcgccgaggagttcgtgcagagactgagagacaccgacaccctggacctgagcggccccgccagagacttcgccctgagactgtggaacaaggtgcccagaaaggccgtggtggagaagcccgccagagccgccgagagagaggccagagccctgctggagaagaacagaagctacagactgctggaggacagcgaggagagcagcgaggagaccgtgagcagagccggcagcagcctgcagaagaagagaaagaagagaaagcacctgagaaagaagagagaggaggaggaggaggaggaggccagcgagaagggcaagaagaagaccggcggcagcaagcagcagaccgagaagcccgagagcgaggacgagtgggagagaaccgagagagagagactgcaggacctggaggagagagacgccttcgccgagagagtgagacagagagacaaggacagaaccagaaacgtgctggagagaagcgacaagaaggcctacgaggaggcccagaagagactgaagatggccgaggaggacagaaaggccatggtgcccgagctgagaaagaagagcagaagagagtacctggccaagagagagagagagaagctggaggacctggaggccgagctggccgacgaggagttcctgttcggcgacgtggagctgagcagacacgagagacaggagctgaagtacaagagaagagtgagagacctggccagagagtacagagccgccggcgagcaggagaagctggaggccaccaacagataccacatgcccaaggagaccagaggccagcccgccagagccgtggacctggtggaggaggagagcggcgcccccggcgaggagcagagaagatgggaggaggccagactgggcgccgccagcctgaagttcggcgccagagacgccgccagccaggagcccaagtaccagctggtgctggaggaggaggagaccatcgagttcgtgagagccacccagctgcagggcgacgaggagcccagcgccccccccaccagcacccaggcccagcagaaggagagcatccaggccgtgagaagaagcctgcccgtgttccccttcagagaggagctgctggccgccatcgccaaccaccaggtgctgatcatcgagggcgagaccggcagcggcaagaccacccagatcccccagtacctgttcgaggagggctacaccaacaagggcatgaagatcgcctgcacccagcccagaagagtggccgccatgagcgtggccgccagagtggccagagagatgggcgtgaagctgggcaacgaggtgggctacagcatcagattcgaggactgcaccagcgagagaaccgtgctgagatacatgaccgacggcatgctgctgagagagttcctgagcgagcccgacctggccagctacagcgtggtgatggtggacgaggcccacgagagaaccctgcacaccgacatcctgttcggcctgatcaaggacgtggccagattcagacccgagctgaaggtgctggtggccagcgccaccatggacaccgccagattcagcaccttcttcgacggcgcccccgtgttcagaatccccggcagaagattccccgtggacatcttctacaccaaggcccccgaggccgactacctggaggcctgcgtggtgagcgtgctgcagatccacgtgacccagccccccggcgacatcctggtgttcctgaccggccaggaggagatcgaggccgcctgcgagatgctgcaggacagatgcagaagactgggcagcaagatcagagagctgctggtgctgcccatctacgccaacctgcccagcgacatgcaggccagaatcttccagcccaccccccccggcgccagaaaggtggtggtggccaccaacatcgccgagaccagcctgaccatcgagggcatcatctacgtgctggaccccggcttctgcaagcagaagagctacaaccccagaaccggcatggagagcctgaccgtgaccccctgcagcaaggccagcgccaaccagagagccggcagagccggcagagtggccgccggcaagtgcttcagactgtacaccgcctgggcctaccagcacgagctggaggagaccaccgtgcccgagatccagagaaccagcctgggcaacgtggtgctgctgctgaagagcctgggcatccacgacctgatgcacttcgacttcctggacccccccccctacgagaccctgctgctggccctggagcagctgtacgccctgggcgccctgaaccacctgggcgagctgaccaccagcggcagaaagatggccgagctgcccgtggaccccatgctgagcaagatgatcctggccagcgagaagtacagctgcagcgaggagatcctgaccgtggccgccatgctgagcgtgaacaacagcatcttctacagacccaaggacaaggtggtgcacgccgacaacgccagagtgaacttcttcctgcccggcggcgaccacctggtgctgctgaacgtgtacacccagtgggccgagagcggctacagcagccagtggtgctacgagaacttcgtgcagttcagaagcatgagaagagccagagacgtgagagagcagctggagggcctgctggagagagtggaggtgggcctgagcagctgccagggcgactacatcagagtgagaaaggccatcaccgccggctacttctaccacaccgccagactgaccagaagcggctacagaaccgtgaagcagcagcagaccgtgttcatccaccccaacagcagcctgttcgagcagcagcccagatggctgctgtaccacgagctggtgctgaccaccaaggagttcatgagacaggtgctggagatcgagagcagctggctgctggaggtggccccccactactacaaggccaaggagctggaggacccccacgccaagaagatgcccaagaagatcggcaagaccagagaggagctgggctag

SEQ ID NO: 78752 - DNA, 1683 bp, Artificial Sequence; identical to SEQ ID NO: 78748
  Description of Artificial Sequence: Synthetic coding sequence

SEQ ID NO: 78753 - DNA, 888 bp, Artificial Sequence
  Description of Artificial Sequence: Synthetic coding sequence
atgagcgaggaccccagaggccccaaggtgcccagaaaggccgtggtggagaagcccgccagagccgccgagagagaggccagagccctgctggagaagaacagaagctacagactgctggaggacagcgaggagagcagcgaggagaccgtgagcagagccggcagcagcctgcagaagaagagaaagaagagaaagcacctgagaaagaagagagaggaggaggaggaggaggaggccagcgagaagggcaagaagaagaccggcggcagcaagcagcagaccgagaagcccgagagcgaggacgagtgggagagaaccgagagagagagactgcaggacctggaggagagagacgccttcgccgagagagtgagacagagagacaaggacagaaccagaaacgtgctggagagaagcgacaagaaggcctacgaggaggcccagaagagactgaagatggccgaggaggacagaaaggccatggtgcccgagctgagaaagaagagcagaagagagtacctggccaagagagagagagagaagctggaggacctggaggccgagctggccgacgaggagttcctgttcggcgacgtggagctgagcagacacgagagacaggagctgaagtacaagagaagagtgagagacctggccagagagtacagagccgccggcgagcaggagaagctggaggccaccaacagataccacatgcccaaggagaccagaggccagcccgccagagccgtggacctggtggaggaggagagcggcgcccccggcgaggagcagagaagatgggaggaggccagactgggcgccgccagcctgaagttcggcgccagagacgccgccagccaggagcccaagtaccagctgtag

SEQ ID NO: 78754 - DNA, 3126 bp, Artificial Sequence; identical to SEQ ID NO: 78749
  Description of Artificial Sequence: Synthetic coding sequence

SEQ ID NO: 78755 - DNA, 3126 bp, Artificial Sequence; identical to SEQ ID NO: 78749
  Description of Artificial Sequence: Synthetic coding sequence

SEQ ID NO: 78756 - DNA, 3126 bp, Artificial Sequence; identical to SEQ ID NO: 78749
  Description of Artificial Sequence: Synthetic coding sequence

SEQ ID NO: 78757 - DNA, 888 bp, Artificial Sequence; identical to SEQ ID NO: 78753
  Description of Artificial Sequence: Synthetic coding sequence

SEQ ID NO: 78758 - DNA, 888 bp, Artificial Sequence; identical to SEQ ID NO: 78753
  Description of Artificial Sequence: Synthetic coding sequence

SEQ ID NO: 78759 - DNA, 1683 bp, Artificial Sequence; identical to SEQ ID NO: 78748
  Description of Artificial Sequence: Synthetic coding sequence

SEQ ID NO: 78760 - DNA, 888 bp, Artificial Sequence; identical to SEQ ID NO: 78753
  Description of Artificial Sequence: Synthetic coding sequence

SEQ ID NO: 78761 - DNA, 888 bp, Artificial Sequence; identical to SEQ ID NO: 78753
  Description of Artificial Sequence: Synthetic coding sequence

SEQ ID NO: 78762 - DNA, 888 bp, Artificial Sequence; identical to SEQ ID NO: 78753
  Description of Artificial Sequence: Synthetic coding sequence

SEQ ID NO: 78763 - DNA, 888 bp, Artificial Sequence; identical to SEQ ID NO: 78753
  Description of Artificial Sequence: Synthetic coding sequence

SEQ ID NO: 78764 - DNA, 1683 bp, Artificial Sequence; identical to SEQ ID NO: 78748
  Description of Artificial Sequence: Synthetic coding sequence

SEQ ID NO: 78765 - DNA, 888 bp, Artificial Sequence; identical to SEQ ID NO: 78753
  Description of Artificial Sequence: Synthetic coding sequence

SEQ ID NO: 78766 - DNA, 2010 bp, Artificial Sequence
  Description of Artificial Sequence: Synthetic coding sequence
atggccacccccgccggcctggagagatgggtgcaggacgagctgcacagcgtgctgggcctgagcgagagacacgtggcccagttcctgatcggcaccgcccagagatgcaccagcgccgaggagttcgtgcagagactgagagacaccgacaccctggacctgagcggccccgccagagacttcgccctgagactgtggaacaaggtgcccagaaaggccgtggtggagaagcccgccagagccgccgagagagaggccagagccctgctggagaagaacagaagctacagactgctggaggacagcgaggagagcagcgaggagaccgtgagcagagccggcagcagcctgcagaagaagagaaagaagagaaagcacctgagaaagaagagagaggaggaggaggaggaggaggccagcgagaagggcaagaagaagaccggcggcagcaagcagcagaccgagaagcccgagagcgaggacgagtgggagagaaccgagagagagagactgcaggacctggaggagagagacgccttcgccgagagagtgagacagagagacaaggacagaaccagaaacgtgctggagagaagcgacaagaaggcctacgaggaggcccagaagagactgaagatggccgaggaggacagaaaggccatggtgcccgagctgagaaagaagagcagaagagagtacctggccaagagagagagagagaagctggaggacctggaggccgagctggccgacgaggagttcctgttcggcgacgtggagctgagcagacacgagagacaggagctgaagtacaagagaagagtgagagacctggccagagagtacagagccgccggcgagcaggagaagctggaggccaccaacagataccacatgcccaaggagaccagaggccagcccgccagagccgtggacctggtggaggaggagagcggcgcccccggcgaggagcagagaagatgggaggaggccagactgggcgccgccagcctgaagttcggcgccagagacgccgccagccaggagcccaagtaccagctggtgctggaggaggaggagaccatcgagttcgtgagagccacccagctgcagggcgacgaggagcccagcgccccccccaccagcacccaggcccagcagaaggagagcatccaggccgtgagaagaagcctgcccgtgttccccttcagagaggagctgctggccgccatcgccaaccaccaggtgctgatcatcgagggcgagaccggcagcggcaagaccacccagatcccccagtacctgttcgaggagggctacaccaacaagggcatgaagatcgcctgcacccagcccagaagagtggccgccatgagcgtggccgccagagtggccagagagatgggcgtgaagctgggcaacgaggtgggctacagcatcagattcgaggactgcaccagcgagagaaccgtgctgagatacatgaccgacggcatgctgctgagagagttcctgagcgagcccgacctggccagctacagcgtggtgatggtggacgaggcccacgagagaaccctgcacaccgacatcctgttcggcctgatcaaggacgtggccagattcagacccgagctgaaggtgctggtggccagcgccaccatggacaccgccagattcagcaccttcttcgacgacgcccccgtgttcagaatccccggcagaagattccccgtggacatcttctacaccaaggcccccgaggccgactacctggaggcctgcgtggtgagcgtgctgcagatccacgtgacccagccccccggcgacatcctggtgttcctgaccggccaggaggagatcgaggccgcctgcgagatgctgcaggacagatgcagaagactgggcagcaagatcagagagctgctggtgctgcccatctacgccaacctgcccagcgacatgcaggccagaatcttccagcccaccccccccggcgccagaaagtag

SEQ ID NO: 78767 - DNA, 3126 bp, Artificial Sequence; identical to SEQ ID NO: 78749
  Description of Artificial Sequence: Synthetic coding sequence

SEQ ID NO: 78768 - DNA, 1683 bp, Artificial Sequence; identical to SEQ ID NO: 78748
  Description of Artificial Sequence: Synthetic coding sequence

SEQ ID NO: 78769 - DNA, 1683 bp, Artificial Sequence; identical to SEQ ID NO: 78748
  Description of Artificial Sequence: Synthetic coding sequence

SEQ ID NO: 78770 - DNA, 567 bp, Artificial Sequence
  Description of Artificial Sequence: Synthetic coding sequence
atggagagccagcccgcccaggagtgcctgatgcagatgttcctgcccatcgagcccgcctgcttcgtggagtggctgggcaccagccccagccagctgggcgtggtgatggtggacgaggcccacgagagaaccctgcacaccgacatcctgttcggcctgatcaaggacgtggccagattcagacccgagctgaaggtgctggtggccagcgccaccatggacaccgccagattcagcaccttcttcgacgacgcccccgtgttcagaatccccggcagaagattccccgtggacatcttctacaccaaggcccccgaggccgactacctggaggcctgcgtggtgagcgtgctgcagatccacgtgacccagccccccggcgacatcctggtgttcctgaccggccaggaggagatcgaggccgcctgcgagatgctgcaggacagatgcagaagactgggcagcaagatcagagagctgctggtgctgcccatctacgccaacctgcccagcgacatgcaggccagaatcttccagcccaccccccccggcgccagaaagtag

SEQ ID NO: 78771 - DNA, 3126 bp, Artificial Sequence; identical to SEQ ID NO: 78749
  Description of Artificial Sequence: Synthetic coding sequence

SEQ ID NO: 78772 - DNA, 444 bp, Artificial Sequence
  Description of Artificial Sequence: Synthetic coding sequence
atggccacccccgccggcctggagagatgggtgcaggacgagctgcacagcgtgctgggcctgagcgagagacacgtggcccagttcctgatcggcaccgcccagagatgcaccagcgccgaggagttcgtgcagagactgagagacaccgacaccctggacctgagcggccccgccagagacttcgccctgagactgtggaacaaggtgcccagaaaggccgtggtggagaagcccgccagagccgccgagagagaggccagagccctgctggagaagaacagaagctacagactgctggaggacagcgaggagagcagcgaggagaccgtgagcagagccggcagcagcctgcagaagaagagaaagaagagaaagcacctgagaaagaagagagaggaggaggaggaggaggaggccagcgagaagggcaagaagaagtag

SEQ ID NO: 78773 - DNA, 4110 bp, Artificial Sequence
  Description of Artificial Sequence: Synthetic coding sequence
atgggcggcaagaacaagaagcacaaggcccccgccgccgccgtggtgagagccgccgtgagcgccagcagagccaagagcgccgaggccggcatcgccggcgaggcccagagcaagaagcccgtgagcagacccgccaccgccgccgccgccgccgccggcagcagagagcccagagtgaagcagggccccaagatctacagcttcaacagcaccaacgacagcagcggccccgccaacctggacaagagcatcctgaaggtggtgatcaacaacaagctggagcagagaatcatcggcgtgatcaacgagcacaagaagcagaacaacgacaagggcatgatcagcggcagactgaccgccaagaagctgcaggacctgtacatggccctgcaggccttcagcttcaagaccaaggacatcgaggacgccatgaccaacaccctgctgtacggcggcgacctgcacagcgccctggactggctgtgcctgaacctgagcgacgacgccctgcccgagggcttcagccaggagttcgaggagcagcagcccaagagcagacccaagttccagagcccccagatccaggccaccatcagcccccccctgcagcccaagaccaagacctacgaggaggaccccaagagcaagcccaagaaggaggagaagaacatggaggtgaacatgaaggagtggatcctgagatacgccgagcagcagaacgaggaggagaagaacgagaacagcaagagcctggaggaggaggagaagttcgaccccaacgagagatacctgcacctggccgccaagctgctggacgccaaggagcaggccgccaccttcaagctggagaagaacaagcagggccagaaggaggcccaggagaagatcagaaagttccagagagagatggagaccctggaggaccaccccgtgttcaaccccgccatgaagatcagccaccagcagaacgagagaaagaagccccccgtggccaccgagggcgagagcgccctgaacttcaacctgttcgagaagagcgccgccgccaccgaggaggagaaggacaagaagaaggagccccacgacgtgagaaacttcgactacaccgccagaagctggaccggcaagagccccaagcagttcctgatcgactgggtgagaaagaacctgcccaagagccccaaccccagcttcgagaaggtgcccgtgggcagatactggaagtgcagagtgagagtgatcaagagcgaggacgacgtgctggtggtgtgccccaccatcctgaccgaggacggcatgcaggcccagcacctgggcgccaccctggccctgtacagactggtgaagggccagagcgtgcaccagctgctgccccccacctacagagacgtgtggctggagtggagcgacgccgagaagaagagagaggagctgaacaagatggagaccaacaagcccagagacctgttcatcgccaagctgctgaacaagctgaagcagcagcagcagcagcagcagcagcacagcgagaacaagagagagaacagcgaggaccccgaggagagctgggagaacctggtgagcgacgaggacttcagcgccctgagcctggagagcgccaacgtggaggacctggagcccgtgagaaacctgttcagaaagctgcagagcacccccaagtaccagaagctgctgaaggagagacagcagctgcccgtgttcaagcacagagacagcatcgtggagaccctgaagagacacagagtggtggtggtggccggcgagaccggcagcggcaagagcacccaggtgccccacttcctgctggaggacctgctgctgaacgagtgggaggccagcaagtgcaacatcgtgtgcacccagcccagaagaatcagcgccgtgagcctggccaacagagtgtgcgacgagctgggctgcgagaacggccccggcggcagaaacagcctgtgcggctaccagatcagaatggagagcagagcctgcgagagcaccagactgctgtactgcaccaccggcgtgctgctgagaaagctgcaggaggacggcctgctgagcaacgtgagccacgtgatcgtggacgaggtgcacgagagaagcgtgcagagcgacttcctgctgatcatcctgaaggagatcctgcagaagagaagcgacctgcacctgatcctgatgagcgccaccgtggacagcgagaagttcagcacctacttcacccactgccccatcctgagaatcagcggcagaagctaccccgtggaggtgttccacctggaggacatcatcgaggagaccggcttcgtgctggagaaggacagcgagtactgccagaagttcctggaggaggaggaggaggtgaccatcaacgtgaccagcaaggccggcggcatcaagaagtaccaggagtacatccccgtgcagaccggcgcccacgccgacctgaaccccttctaccagaagtacagcagcagaacccagcacgccatcctgtacatgaacccccacaagatcaacctggacctgatcctggagctgctggcctacctggacaagagcccccagttcagaaacatcgagggcgccgtgctgatcttcctgcccggcctggcccacatccagcagctgtacgacctgctgagcaacgacagaagattctacagcgagagatacaaggtgatcgccctgcacagcatcctgagcacccaggaccaggccgccgccttcaccctgcccccccccggcgtgagaaagatcgtgctggccaccaacatcgccgagaccggcatcaccatccccgacgtggtgttcgtgatcgacaccggcagaaccaaggagaacaagtaccacgagagcagccagatgagcagcctggtggagaccttcgtgagcaaggccagcgccctgcagagacagggcagagccggcagagtgagagacggcttctgcttcagaatgtacaccagagagagattcgagggcttcatggactacagcgtgcccgagatcctgagagtgcccctggaggagctgtgcctgcacatcatgaagtgcaacctgggcagccccgaggacttcctgagcaaggccctggaccccccccagctgcaggtgatcagcaacgccatgaacctgctgagaaagatcggcgcctgcgagctgaacgagcccaagctgacccccctgggccagcacctggccgccctgcccgtgaacgtgaagatcggcaagatgctgatcttcggcgccatcttcggctgcctggaccccgtggccaccctggccgccgtgatgaccgagaagagccccttcaccacccccatcggcagaaaggacgaggccgacctggccaagagcgccctggccatggccgacagcgaccacctgaccatctacaacgcctacctgggctggaagaaggccagacaggagggcggctacagaagcgagatcacctactgcagaagaaacttcctgaacagaaccagcctgctgaccctggaggacgtgaagcaggagctgatcaagctggtgaaggccgccggcttcagcagcagcaccaccagcaccagctgggagggcaacagagccagccagaccctgagcttccaggagatcgccctgctgaaggccgtgctggtggccggcctgtacgacaacgtgggcaagatcatctacaccaagagcgtggacgtgaccgagaagctggcctgcatcgtggagaccgcccagggcaaggcccaggtgcaccccagcagcgtgaacagagacctgcagacccacggctggctgctgtaccaggagaagatcagatacgccagagtgtacctgagagagaccaccctgatcacccccttccccgtgctgctgttcggcggcgacatcgaggtgcagcacagagagagactgctgagcatcgacggctggatctacttccaggcccccgtgaagatcgccgtgatcttcaagcagctgagagtgctgatcgacagcgtgctgagaaagaagctggagaaccccaagatgagcctggagaacgacaagatcctgcagatcatcaccgagctgatcaagaccgagaacaactag

SEQ ID NO: 78774 - DNA, 1989 bp, Artificial Sequence
  Description of Artificial Sequence: Synthetic coding sequence
atggaggaggagggcctggagtgccccaacagcagcagcgagaagagatacttccccgagagcctggacagcagcgacggcgacgaggaggaggtgctggcctgcgaggacctggagctgaaccccttcgacggcctgccctacagcagcagatactacaagctgctgaaggagagagaggacctgcccatctggaaggagaagtacagcttcatggagaacctgctgcagaaccagatcgtgatcgtgagcggcgacgccaagtgcggcaagagcgcccaggtgccccagtggtgcgccgagtactgcctgagcatccactaccagcacggcggcgtgatctgcacccaggtgcacaagcagaccgtggtgcagctggccctgagagtggccgacgagatggacgtgaacatcggccacgaggtgggctacgtgatccccttcgagaactgctgcaccaacgagaccatcctgagatactgcaccgacgacatgctgcagagagagatgatgagcaaccccttcctgggcagctacggcgtgatcatcctggacgacatccacgagagaagcatcgccaccgacgtgctgctgggcctgctgaaggacgtgctgctggccagacccgagctgaagctgatcatcaacagcagcccccacctgatcagcaagctgaacagctactacggcaacgtgcccgtgatcgaggtgaagaacaagcaccccgtggaggtggtgtacctgagcgaggcccagaaggacagcttcgagagcatcctgagactgatcttcgagatccaccacagcggcgagaagggcgacatcgtggtgttcctggcctgcgagcaggtgtacaaccccagaatcagagccaacagcctggtgatgcagcccatcagccagagccaggccgagatcagaaagcagatcctgggcagcagcagcagcggcaagttcttctgcctgtacaccgaggagttcgccagcaaggacatgacccccctgaagcccgccgagatgcaggaggccaacctgaccagcatggtgctgttcatgaagagaatcgacatcgccggcctgggccactgcgacttcatgaacagacccgcccccgagagcctgatgcaggccctggaggacctggactacctggccgccctggacaacgacggcaacctgagcgagttcggcatcatcatgagcgagttccccctggacccccagctgagcaagagcatcctggccagctgcgagttcgactgcgtggacgaggtgctgaccatcgccgccatggtgaccgcccccaactgcttcagccacgtgccccacggcgccgaggaggccgccctgacctgctggaagaccttcctgcaccccgagggcgaccacttcaccctgatcagcatctacaaggcctaccaggacaccaccctgaacagcagcagcgagtactgcgtggagaagtggtgcagagactacttcctgaactgcagcgccctgagaatggccgacgtgatcagagccgagctgctggagatcatcaagagaatcgagctgccctacgccgagcccgccttcggcagcaaggagaacaccctgaacatcaagaaggccctgctgagcggctacttcatgcagatcgccagagacgtggacggcagcggcaactacctgatgctgacccacaagcaggtggcccagctgcaccccctgagcggctacagcatcaccaagaagatgcccgagtgggtgctgttccacaagttcagcatcagcgagaacaactacatcagaatcaccagcgagatcagccccgagctgttcatgcagctggtgccccagtactacttcagcaacctgccccccagcgagagcaaggacatcctgcagcaggtggtggaccacctgagccccgtgagcaccatgaacaaggagcagcagatgtgcgagacctgccccgagaccgagcagagatgcaccctgcagtag

SEQ ID NO: 78775 - DNA, 2232 bp, Artificial Sequence
  Description of Artificial Sequence: Synthetic coding sequence
atggaggaggagggcctggagtgccccaacagcagcagcgagaagagatacttccccgagagcctggacagcagcgacggcgacgaggaggaggtgctggcctgcgaggacctggagctgaaccccttcgacggcctgccctacagcagcagatactacaagctgctgaaggagagagaggacctgcccatctggaaggagaagtacagcttcatggagaacctgctgcagaaccagatcgtgatcgtgagcggcgacgccaagtgcggcaagagcgcccaggtgccccagtggtgcgccgagtactgcctgagcatccactaccagcacggcggcgtgatctgcacccaggtgcacaagcagaccgtggtgcagctggccctgagagtggccgacgagatggacgtgaacatcggccacgaggtgggctacgtgatccccttcgagaactgctgcaccaacgagaccatcctgagatactgcaccgacgacatgctgcagagagagatgatgagcaaccccttcctgggcagctacggcgtgatcatcctggacgacatccacgagagaagcatcgccaccgacgtgctgctgggcctgctgaaggacgtgctgctggccagacccgagctgaagctgatcatcaacagcagcccccacctgatcagcaagctgaacagctactacggcaacgtgcccgtgatcgaggtgaagaacaagcaccccgtggaggtggtgtacctgagcgaggcccagaaggacagcttcgagagcatcctgagactgatcttcgagatccaccacagcggcgagaagggcgacatcgtggtgttcctggcctgcgagcaggacatcgagaaggtgtgcgagaccgtgtaccagggcagcaacctgaaccccgacctgggcgagctggtggtggtgcccctgtaccccaaggagaagtgcagcctgttcaagcccctggacgagaccgagaagagatgccaggtgtaccagagaagagtggtgctgaccaccagcagcggcgagttcctgatctggagcaacagcgtgagattcgtgatcgacgtgggcgtggagagaagaaaggtgtacaaccccagaatcagagccaacagcctggtgatgcagcccatcagccagagccaggccgagatcagaaagcagatcctgggcagcagcagcagcggcaagttcttctgcctgtacaccgaggagttcgccagcaaggacatgacccccctgaagcccgccgagatgcaggaggccaacctgaccagcatggtgctgttcatgaagagaatcgacatcgccggcctgggccactgcgacttcatgaacagacccgcccccgagagcctgatgcaggccctggaggacctggactacctggccgccctggacaacgacggcaacctgagcgagttcggcatcatcatgagcgagttccccctggacccccagctgagcaagagcatcctggccagctgcgagttcgactgcgtggacgaggtgctgaccatcgccgccatggtgaccgcccccaactgcttcagccacgtgccccacggcgccgaggaggccgccctgacctgctggaagaccttcctgcaccccgagggcgaccacttcaccctgatcagcatctacaaggcctaccaggacaccaccctgaacagcagcagcgagtactgcgtggagaagtggtgcagagactacttcctgaactgcagcgccctgagaatggccgacgtgatcagagccgagctgctggagatcatcaagagaatcgagctgccctacgccgagcccgccttcggcagcaaggagaacaccctgaacatcaagaaggccctgctgagcggctacttcatgcagatcgccagagacgtggacggcagcggcaactacctgatgctgacccacaagcaggtggcccagctgcaccccctgagcggctacagcatcaccaagaagatgcccgagtgggtgctgttccacaagttcagcatcagcgagaacaactacatcagaatcaccagcgagatcagccccgagctgttcatgcagctggtgccccagtactacttcagcaacctgccccccagcgagagcaaggacatcctgcagcaggtggtggaccacctgagccccgtgagcaccatgaacaaggagcagcagatgtgcgagacctgccccgagaccgagcagagatgcaccctgcagtag

SEQ ID NO: 78776 - DNA, 1104 bp, Artificial Sequence
  Description of Artificial Sequence: Synthetic coding sequence
atgcagcccatcagccagagccaggccgagatcagaaagcagatcctgggcagcagcagcagcggcaagttcttctgcctgtacaccgaggagttcgccagcaaggacatgacccccctgaagcccgccgagatgcaggaggccaacctgaccagcatggtgctgttcatgaagagaatcgacatcgccggcctgggccactgcgacttcatgaacagacccgcccccgagagcctgatgcaggccctggaggacctggactacctggccgccctggacaacgacggcaacctgagcgagttcggcatcatcatgagcgagttccccctggacccccagctgagcaagagcatcctggccagctgcgagttcgactgcgtggacgaggtgctgaccatcgccgccatggtgaccgcccccaactgcttcagccacgtgccccacggcgccgaggaggccgccctgacctgctggaagaccttcctgcaccccgagggcgaccacttcaccctgatcagcatctacaaggcctaccaggacaccaccctgaacagcagcagcgagtactgcgtggagaagtggtgcagagactacttcctgaactgcagcgccctgagaatggccgacgtgatcagagccgagctgctggagatcatcaagagaatcgagctgccctacgccgagcccgccttcggcagcaaggagaacaccctgaacatcaagaaggccctgctgagcggctacttcatgcagatcgccagagacgtggacggcagcggcaactacctgatgctgacccacaagcaggtggcccagctgcaccccctgagcggctacagcatcaccaagaagatgcccgagtgggtgctgttccacaagttcagcatcagcgagaacaactacatcagaatcaccagcgagatcagccccgagctgttcatgcagctggtgccccagtactacttcagcaacctgccccccagcgagagcaaggacatcctgcagcaggtggtggaccacctgagccccgtgagcaccatgaacaaggagcagcagatgtgcgagacctgccccgagaccgagcagagatgcaccctgcagtag

SEQ ID NO: 78777 - DNA, 339 bp, Artificial Sequence
  Description of Artificial Sequence: Synthetic coding sequence
atggaggaggagggcctggagtgccccaacagcagcagcgagaagagatacttccccgagagcctggacagcagcgacggcgacgaggaggaggtgctggcctgcgaggacctggagctgaaccccttcgacggcctgccctacagcagcagatactacaagctgctgaaggagagagaggacctgcccatctggaaggagaagtacagcttcatggagaacctgctgcagaaccagatcgtgatcgtgagcggcgacgccaagtgcggcaagagcgcccaggtgccccagtggtgcgccgagtactgcctgagcatccactaccagcacggcggctag

SEQ ID NO: 78778 - DNA, 1935 bp, Artificial Sequence
  Description of Artificial Sequence: Synthetic coding sequence
atgaccatcgagatcgacttcctgcagaagaagagcatcgacagcaacccctacgacaccgacaagatggccgccgagttcatccagcagttcaacaaccaggccttcagcgtgggccagcagctggtgttcagcttcaacgagaagctgttcggcctgctggtgaaggacatcgaggccatggaccccagcatcctgaagggcgagcccgccaccggcaagagacagaagatcgaggtgggcctggtggtgggcaacagccaggtggccttcgagaaggccgagaacagcagcctgaacctgatcggcaaggccaagaccaaggagaacagacagagcatcatcaaccccgactggaacttcgagaagatgggcatcggcggcctggacaaggagttcagcgacatcttcagaagagccttcgccagcagagtgttcccccccgagatcgtggagcagatgggctgcaagcacgtgaagggcatcctgctgtacggcccccccggctgcggcaagaccctgctggccagacagatcggcaagatgctgaacgccagagagcccaaggtggtgaacggccccgagatcctgaacaagtacgtgggcgagagcgaggccaacatcagaaagctgttcgccgacgccgaggaggagcagagaagactgggcgccaacagcggcctgcacatcatcatcttcgacgagatcgacgccatctgcaagcagagaggcagcatggccggcagcaccggcgtgcacgacaccgtggtgaaccagctgctgagcaagatcgacggcgtggagcagctgaacaacatcctggtgatcggcatgaccaacagacccgacctgatcgacgaggccctgctgagacccggcagactggaggtgaagatggagatcggcctgcccgacgagaagggcagactgcagatcctgcacatccacaccgccagaatgagaggccaccagctgctgagcgccgacgtggacatcaaggagctggccgtggagaccaagaacttcagcggcgccgagctggagggcctggtgagagccgcccagagcaccgccatgaacagacacatcaaggccagcaccaaggtggaggtggacatggagaaggccgagagcctgcaggtgaccagaggcgacttcctggccagcctggagaacgacatcaagcccgccttcggcaccaaccaggaggactacgccagctacatcatgaacggcatcatcaagtggggcgaccccgtgaccagagtgctggacgacggcgagctgctggtgcagcagaccaagaacagcgacagaacccccctggtgagcgtgctgctggagggccccccccacagcggcaagaccgccctggccgccaagatcgccgaggagagcaacttccccttcatcaagatctgcagccccgacaagatgatcggcttcagcgagaccgccaagtgccaggccatgaagaagatcttcgacgacgcctacaagagccagctgagctgcgtggtggtggacgacatcgagagactgctggactacgtgcccatcggccccagattcagcaacctggtgctgcaggccctgctggtgctgctgaagaaggcccccccccagggcagaaagctgctgatcatcggcaccaccagcagaaaggacgtgctgcaggagatggagatgctgaacgccttcagcaccaccatccacgtgcccaacatcgccaccggcgagcagctgctggaggccctggagctgctgggcaacttcaaggacaaggagagaaccaccatcgcccagcaggtgaagggcaagaaggtgtggatcggcatcaagaagctgctgatgctgatcgagatgagcctgcagatggaccccgagtacagagtgagaaagttcctggccctgctgagagaggagggcgcctag

SEQ ID NO: 78779 - DNA, 1452 bp, Artificial Sequence
  Description of Artificial Sequence: Synthetic coding sequence
atgcccgaggaggccggcttcccccccgccaagagattcagacccggcagcggcccccccagcagagccggcagcttcccccccggcagacaggtggtgatgctgctgaccgccggcagcggcggcagaggcggcggcggcggcagaagacagcagccccccctggcccagcccagcgccagcccctaccccgaggccgtggagctgcagagaagaagcctgcccatcttccaggccagaggccagctgctggcccagctgagaaacctggacaacgccgtgctgatcggcagccccttcttcaccggccaccccggcgtgccccactgggccggcggcgacagaagccacgagcaggacgtgcccagacactgcaaggccccccccagaagactgccctgcgacgccggccccagcagcgtgagactgcccgccctgtgcaccgccgcccccagcctgcccagaggccccaaggacagcggcctggaggtgctggccgtgcagagagtgagcaagacccaggcctggcagagaaccggcagagccggcagagaggacagcggcatctgctacagactgtacaccgaggacgagttcgagaagttcgacaagatgaccgtgcccgagatccagagatgcaacctggccagcgtgatgctgcagctgctggccatgaaggtgcccaacgtgctgaccttcgacttcatgagcaagcccagccccgaccacatccaggccgccatcgcccagctggacctgctgggcgccctggagcacaaggacgaccagctgaccctgacccccatgggcagaaagatggccgccttccccctggagcccaagttcgccaagaccatcctgatgagccccaagttccactgcaccgaggagatcctgaccatcgtgagcctgctgagcgtggacagcgtgctgcacaacccccccagcagaagagaggaggtgcagggcgtgagaaagaagttcatcagcagcgagggcgaccacatgaccctgctgaacatctacagaaccttcaagaacctgggcggcaacaaggactggtgcaaggagaacttcgtgaacagcaagaacatgaccctggtggccgaggtgagagcccagctgagagacatctgcctgaagatgagcatgcccatcgccagcagcagaggcgacgtggagagcgtgagaagatgcctggcccacagcctgttcatgagcaccgccgagctgcagcccgacggcacctacgccaccaccgacacccaccagcccgtggccatccaccccagcagcgtgctgttccactgcaagcccgcctgcgtggtgtacaccgagctgctgtacaccaacaagtgctacatgagagacctgtgcgtgatcgacgcccagtggctgtacgaggccgcccccgagtacttcagaagaaagctgagaaccgccagaaactag

SEQ ID NO: 78780 - DNA, 2940 bp, Artificial Sequence
  Description of Artificial Sequence: Synthetic coding sequence
atgagctacgactaccaccagaactggggcagagacggcggccccagaagcagcggcggcggctacggcggcggccccgccggcggccacggcggcaacagaggcagcggcggcggcggcggcggcggcggcggcggcagaggcggcagaggcagacaccccggccacctgaagggcagagagatcggcatgtggtacgccaagaagcagggccagaagaacaaggaggccgagagacaggagagagccgtggtgcacatggacgagagaagagaggagcagatcgtgcagctgctgaacagcgtgcaggccaagaacgacaaggagagcgaggcccagatcagctggttcgcccccgaggaccacggctacggcaccgaggtgagcaccaagaacaccccctgcagcgagaacaagctggacatccaggagaagaagctgatcaaccaggagaagaagatgttcagaatcagaaacagaagctacatcgacagagacagcgagtacctgctgcaggagaacgagcccgacggcaccctggaccagaagctgctggaggacctgcagaagaagaagaacgacctgagatacatcgagatgcagcacttcagagagaagctgcccagctacggcatgcagaaggagctggtgaacctgatcgacaaccaccaggtgaccgtgatcagcggcgagaccggctgcggcaagaccacccaggtgacccagttcatcctggacaactacatcgagagaggcaagggcagcgcctgcagaatcgtgtgcacccagcccagaagaatcagcgccatcagcgtggccgagagagtggccgccgagagagccgagagctgcggcagcggcaacagcaccggctaccagatcagactgcagagcagactgcccagaaagcagggcagcatcctgtactgcaccaccggcatcatcctgcagtggctgcagagcgacccctacctgagcagcgtgagccacatcgtgctggacgagatccacgagagaaacctgcagagcgacgtgctgatgaccgtggtgaaggacctgctgaacttcagaagcgacctgaaggtgatcctgatgagcgccaccctgaacgccgagaagttcagcgagtacttcggcaactgccccatgatccacatccccggcttcaccttccccgtggtggagtacctgctggaggacgtgatcgagaagatcagatacgtgcccgagcagaaggagcacagaagccagttcaagagaggcttcatgcagggccacgtgaacagacaggagaaggaggagaaggaggccatctacaaggagagatggcccgactacgtgagagagctgagaagaagatacagcgccagcaccgtggacgtgatcgagatgatggaggacgacaaggtggacctgaacctgatcgtggccctgatcagatacatcgtgctggaggaggaggacggcgccatcctggtgttcctgcccggctgggacaacatcagcaccctgcacgacctgctgatgagccaggtgatgttcaagagcgacaagttcctgatcatccccctgcacagcctgatgcccaccgtgaaccagacccaggtgttcaagagaaccccccccggcgtgagaaagatcgtgatcgccaccaacatcgccgagaccagcatcaccatcgacgacgtggtgtacgtgatcgacggcggcaagatcaaggagacccacttcgacacccagaacaacatcagcaccatgagcgccgagtgggtgagcaaggccaacgccaagcagagaaagggcagagccggcagagtgcagcccggccactgctaccacctgtacaacggcctgagagccagcctgctggacgactaccagctgcccgagatcctgagaacccccctggaggagctgtgcctgcagatcaagatcctgagactgggcggcatcgcctacttcctgagcagactgatggacccccccagcaacgaggccgtgctgctgagcatcagacacctgatggagctgaacgccctggacaagcaggaggagctgacccccctgggcgtgcacctggccagactgcccgtggagccccacatcggcaagatgatcctgttcggcgccctgttctgctgcctggaccccgtgctgaccatcgccgccagcctgagcttcaaggaccccttcgtgatccccctgggctgggaggaggccagaagaagaggcttcagatacgagaaggactactgctgggagtacttcctgagcagcaacaccctgcagatgctgcacaacatgaagggccagttcgccgagcacctgctgggcgccggcttcgtgagcagcagaaaccccaaggaccccgagagcaacatcaacagcgacaacgagaagatcatcaaggccgtgatctgcgccggcctgtaccccaaggtggccaagatcagactgaacctgggcaagaagagaaagatggtgaaggtgtacaccaagaccgacggcctggtggccgtgcaccccaagagcgtgaacgtggagcagaccgacttccactacaactggctgatctaccacctgaagatgagaaccagcagcatctacctgtacgactgcaccgaggtgagcccctactgcctgctgttcttcggcggcgacatcagcatccagaaggacaacgaccaggagaccatcgccgtggacgagtggatcgtgttccagagccccgccagaatcgcccacctggtgaaggagctgagaaaggagctggacatcctgctgcaggagaagatcgagagcccccaccccgtggactggaacgacaccaagagcagagactgcgccgtgctgagcgccatcatcgacctgatcaagacccaggagaaggccacccccagaaacttcccccccagattccaggacggctactacagctag

SEQ ID NO: 78781 - DNA, 2985 bp, Artificial Sequence
  Description of Artificial Sequence: Synthetic coding sequence
atgagctacgactaccaccagaactggggcagagacggcggccccagaagcagcggcggcggctacggcggcggccccgccggcggccacggcggcaacagaggcagcggcggcggcggcggcggcggcggcggcggcagaggcggcagaggcagacaccccggccacctgaagggcagagagatcggcatgtggtacgccaagaagcagggccagaagaacaaggaggccgagagacaggagagagccgtggtgcacatggacgagagaagagaggagcagatcgtgcagctgctgaacagcgtgcaggccaagaacgacaaggagagcgaggcccagatcagctggttcgcccccgaggaccacggctacggcaccgaggtgagcaccaagaacaccccctgcagcgagaacaagctggacatccaggagaagaagctgatcaaccaggagaagaagatgttcagaatcagaaacagaagctacatcgacagagacagcgagtacctgctgcaggagaacgagcccgacggcaccctggaccagaagctgctggaggacctgcagaagaagaagaacgacctgagatacatcgagatgcagcacttcagagagaagctgcccagctacggcatgcagaaggagctggtgaacctgatcgacaaccaccaggtgaccgtgatcagcggcgagaccggctgcggcaagaccacccaggtgacccagttcatcctggacaactacatcgagagaggcaagggcagcgcctgcagaatcgtgtgcacccagcccagaagaatcagcgccatcagcgtggccgagagagtggccgccgagagagccgagagctgcggcagcggcaacagcaccggctaccagatcagactgcagagcagactgcccagaaagcagggcagcatcctgtactgcaccaccggcatcatcctgcagtggctgcagagcgacccctacctgagcagcgtgagccacatcgtgctggacgagatccacgagagaaacctgcagagcgacgtgctgatgaccgtggtgaaggacctgctgaacttcagaagcgacctgaaggtgatcctgatgagcgccaccctgaacgccgagaagttcagcgagtacttcggcaactgccccatgatccacatccccggcttcaccttccccgtggtggagtacctgctggaggacgtgatcgagaagatcagatacgtgcccgagcagaaggagcacagaagccagttcaagagaggcttcatgcagggccacgtgaacagacaggagaaggaggagaaggaggccatctacaaggagagatggcccgactacgtgagagagctgagaagaagatacagcgccagcaccgtggacgtgatcgagatgatggaggacgacaaggtggacctgaacctgatcgtggccctgatcagatacatcgtgctggaggaggaggacggcgccatcctggtgttcctgcccggctgggacaacatcagcaccctgcacgacctgctgatgagccaggtgatgttcaagagcgtgaaccagacccaggtgttcaagagaaccccccccggcgtgagaaagatcgtgatcgccaccaacatcgccgagaccagcatcaccatcgacgacgtggtgtacgtgatcgacggcggcaagatcaaggagacccacttcgacacccagaacaacatcagcaccatgagcgccgagtgggtgagcaaggccaacgccaagcagagaaagggcagagccggcagagtgcagcccggccactgctaccacctgtacaacggcctgagagccagcctgctggacgactaccagctgcccgagatcctgagaacccccctggaggagctgtgcctgcagatcaagatcctgagactgggcggcatcgcctacttcctgagcagactgatggacccccccagcaacgaggccgtgctgctgagcatcagacacctgatggagctgaacgccctggacaagcaggaggagctgacccccctgggcgtgcacctggccagactgcccgtggagccccacatcggcaagatgatcctgttcggcgccctgttctgctgcctggaccccgtgctgaccatcgccgccagcctgagcttcaaggaccccttcgtgatccccctgggcaaggagaagatcgccgacgccagaagaaaggagctggccaaggacaccagaagcgaccacctgaccgtggtgaacgccttcgagggctgggaggaggccagaagaagaggcttcagatacgagaaggactactgctgggagtacttcctgagcagcaacaccctgcagatgctgcacaacatgaagggccagttcgccgagcacctgctgggcgccggcttcgtgagcagcagaaaccccaaggaccccgagagcaacatcaacagcgacaacgagaagatcatcaaggccgtgatctgcgccggcctgtaccccaaggtggccaagatcagactgaacctgggcaagaagagaaagatggtgaaggtgtacaccaagaccgacggcctggtggccgtgcaccccaagagcgtgaacgtggagcagaccgacttccactacaactggctgatctaccacctgaagatgagaaccagcagcatctacctgtacgactgcaccgaggtgagcccctactgcctgctgttcttcggcggcgacatcagcatccagaaggacaacgaccaggagaccatcgccgtggacgagtggatcgtgttccagagccccgccagaatcgcccacctggtgaaggagctgagaaaggagctggacatcctgctgcaggagaagatcgagagcccccaccccgtggactggaacgacaccaagagcagagactgcgccgtgctgagcgccatcatcgacctgatcaagacccaggagaaggccacccccagaaacttcccccccagattccaggacggctactacagctag

SEQ ID NO: 78782 - DNA, 3027 bp, Artificial Sequence
  Description of Artificial Sequence: Synthetic coding sequence
atgagctacgactaccaccagaactggggcagagacggcggccccagaagcagcggcggcggctacggcggcggccccgccggcggccacggcggcaacagaggcagcggcggcggcggcggcggcggcggcggcggcagaggcggcagaggcagacaccccggccacctgaagggcagagagatcggcatgtggtacgccaagaagcagggccagaagaacaaggaggccgagagacaggagagagccgtggtgcacatggacgagagaagagaggagcagatcgtgcagctgctgaacagcgtgcaggccaagaacgacaaggagagcgaggcccagatcagctggttcgcccccgaggaccacggctacggcaccgaggtgagcaccaagaacaccccctgcagcgagaacaagctggacatccaggagaagaagctgatcaaccaggagaagaagatgttcagaatcagaaacagaagctacatcgacagagacagcgagtacctgctgcaggagaacgagcccgacggcaccctggaccagaagctgctggaggacctgcagaagaagaagaacgacctgagatacatcgagatgcagcacttcagagagaagctgcccagctacggcatgcagaaggagctggtgaacctgatcgacaaccaccaggtgaccgtgatcagcggcgagaccggctgcggcaagaccacccaggtgacccagttcatcctggacaactacatcgagagaggcaagggcagcgcctgcagaatcgtgtgcacccagcccagaagaatcagcgccatcagcgtggccgagagagtggccgccgagagagccgagagctgcggcagcggcaacagcaccggctaccagatcagactgcagagcagactgcccagaaagcagggcagcatcctgtactgcaccaccggcatcatcctgcagtggctgcagagcgacccctacctgagcagcgtgagccacatcgtgctggacgagatccacgagagaaacctgcagagcgacgtgctgatgaccgtggtgaaggacctgctgaacttcagaagcgacctgaaggtgatcctgatgagcgccaccctgaacgccgagaagttcagcgagtacttcggcaactgccccatgatccacatccccggcttcaccttccccgtggtggagtacctgctggaggacgtgatcgagaagatcagatacgtgcccgagcagaaggagcacagaagccagttcaagagaggcttcatgcagggccacgtgaacagacaggagaaggaggagaaggaggccatctacaaggagagatggcccgactacgtgagagagctgagaagaagatacagcgccagcaccgtggacgtgatcgagatgatggaggacgacaaggtggacctgaacctgatcgtggccctgatcagatacatcgtgctggaggaggaggacggcgccatcctggtgttcctgcccggctgggacaacatcagcaccctgcacgacctgctgatgagccaggtgatgttcaagagcgacaagttcctgatcatccccctgcacagcctgatgcccaccgtgaaccagacccaggtgttcaagagaaccccccccggcgtgagaaagatcgtgatcgccaccaacatcgccgagaccagcatcaccatcgacgacgtggtgtacgtgatcgacggcggcaagatcaaggagacccacttcgacacccagaacaacatcagcaccatgagcgccgagtgggtgagcaaggccaacgccaagcagagaaagggcagagccggcagagtgcagcccggccactgctaccacctgtacaacggcctgagagccagcctgctggacgactaccagctgcccgagatcctgagaacccccctggaggagctgtgcctgcagatcaagatcctgagactgggcggcatcgcctacttcctgagcagactgatggacccccccagcaacgaggccgtgctgctgagcatcagacacctgatggagctgaacgccctggacaagcaggaggagctgacccccctgggcgtgcacctggccagactgcccgtggagccccacatcggcaagatgatcctgttcggcgccctgttctgctgcctggaccccgtgctgaccatcgccgccagcctgagcttcaaggaccccttcgtgatccccctgggcaaggagaagatcgccgacgccagaagaaaggagctggccaaggacaccagaagcgaccacctgaccgtggtgaacgccttcgagggctgggaggaggccagaagaagaggcttcagatacgagaaggactactgctgggagtacttcctgagcagcaacaccctgcagatgctgcacaacatgaagggccagttcgccgagcacctgctgggcgccggcttcgtgagcagcagaaaccccaaggaccccgagagcaacatcaacagcgacaacgagaagatcatcaaggccgtgatctgcgccggcctgtaccccaaggtggccaagatcagactgaacctgggcaagaagagaaagatggtgaaggtgtacaccaagaccgacggcctggtggccgtgcaccccaagagcgtgaacgtggagcagaccgacttccactacaactggctgatctaccacctgaagatgagaaccagcagcatctacctgtacgactgcaccgaggtgagcccctactgcctgctgttcttcggcggcgacatcagcatccagaaggacaacgaccaggagaccatcgccgtggacgagtggatcgtgttccagagccccgccagaatcgcccacctggtgaaggagctgagaaaggagctggacatcctgctgcaggagaagatcgagagcccccaccccgtggactggaacgacaccaagagcagagactgcgccgtgctgagcgccatcatcgacctgatcaagacccaggagaaggccacccccagaaacttcccccccagattccaggacggctactacagctag

SEQ ID NO: 78783 - DNA, 2985 bp, Artificial Sequence
  Description of Artificial Sequence: Synthetic coding sequence
atgagctacgactaccaccagaactggggcagagacggcggccccagaagcagcggcggcggctacggcggcggccccgccggcggccacggcggcaacagaggcagcggcggcggcggcggcggcggcggcggcggcagaggcggcagaggcagacaccccggccacctgaagggcagagagatcggcatgtggtacgccaagaagcagggccagaagaacaaggaggccgagagacaggagagagccgtggtgcacatggacgagagaagagaggagcagatcgtgcagctgctgaacagcgtgcaggccaagaacgacaaggagagcgaggcccagatcagctggttcgcccccgaggaccacggctacggcaccgaggtgagcaccaagaacaccccctgcagcgagaacaagctggacatccaggagaagaagctgatcaaccaggagaagaagatgttcagaatcagaaacagaagctacatcgacagagacagcgagtacctgctgcaggagaacgagcccgacggcaccctggaccagaagctgctggaggacctgcagaagaagaagaacgacctgagatacatcgagatgcagcacttcagagagaagctgcccagctacggcatgcagaaggagctggtgaacctgatcgacaaccaccaggtgaccgtgatcagcggcgagaccggctgcggcaagaccacccaggtgacccagttcatcctggacaactacatcgagagaggcaagggcagcgcctgcagaatcgtgtgcacccagcccagaagaatcagcgccatcagcgtggccgagagagtggccgccgagagagccgagagctgcggcagcggcaacagcaccggctaccagatcagactgcagagcagactgcccagaaagcagggcagcatcctgtactgcaccaccggcatcatcctgcagtggctgcagagcgacccctacctgagcagcgtgagccacatcgtgctggacgagatccacgagagaaacctgcagagcgacgtgctgatgaccgtggtgaaggacctgctgaacttcagaagcgacctgaaggtgatcctgatgagcgccaccctgaacgccgagaagttcagcgagtacttcggcaactgccccatgatccacatccccggcttcaccttccccgtggtggagtacctgctggaggacgtgatcgagaagatcagatacgtgcccgagcagaaggagcacagaagccagttcaagagaggcttcatgcagggccacgtgaacagacaggagaaggaggagaaggaggccatctacaaggagagatggcccgactacgtgagagagctgagaagaagatacagcgccagcaccgtggacgtgatcgagatgatggaggacgacaaggtggacctgaacctgatcgtggccctgatcagatacatcgtgctggaggaggaggacggcgccatcctggtgttcctgcccggctgggacaacatcagcaccctgcacgacctgctgatgagccaggtgatgttcaagagcggcaccatgagccaggtgttcaagagaaccccccccggcgtgagaaagatcgtgatcgccaccaacatcgccgagaccagcatcaccatcgacgacgtggtgtacgtgatcgacggcggcaagatcaaggagacccacttcgacacccagaacaacatcagcaccatgagcgccgagtgggtgagcaaggccaacgccaagcagagaaagggcagagccggcagagtgcagcccggccactgctaccacctgtacaacggcctgagagccagcctgctggacgactaccagctgcccgagatcctgagaacccccctggaggagctgtgcctgcagatcaagatcctgagactgggcggcatcgcctacttcctgagcagactgatggacccccccagcaacgaggccgtgctgctgagcatcagacacctgatggagctgaacgccctggacaagcaggaggagctgacccccctgggcgtgcacctggccagactgcccgtggagccccacatcggcaagatgatcctgttcggcgccctgttctgctgcctggaccccgtgctgaccatcgccgccagcctgagcttcaaggaccccttcgtgatccccctgggcaaggagaagatcgccgacgccagaagaaaggagctggccaaggacaccagaagcgaccacctgaccgtggtgaacgccttcgagggctgggaggaggccagaagaagaggcttcagatacgagaaggactactgctgggagtacttcctgagcagcaacaccctgcagatgctgcacaacatgaagggccagttcgccgagcacctgctgggcgccggcttcgtgagcagcagaaaccccaaggaccccgagagcaacatcaacagcgacaacgagaagatcatcaaggccgtgatctgcgccggcctgtaccccaaggtggccaagatcagactgaacctgggcaagaagagaaagatggtgaaggtgtacaccaagaccgacggcctggtggccgtgcaccccaagagcgtgaacgtggagcagaccgacttccactacaactggctgatctaccacctgaagatgagaaccagcagcatctacctgtacgactgcaccgaggtgagcccctactgcctgctgttcttcggcggcgacatcagcatccagaaggacaacgaccaggagaccatcgccgtggacgagtggatcgtgttccagagccccgccagaatcgcccacctggtgaaggagctgagaaaggagctggacatcctgctgcaggagaagatcgagagcccccaccccgtggactggaacgacaccaagagcagagactgcgccgtgctgagcgccatcatcgacctgatcaagacccaggagaaggccacccccagaaacttcccccccagattccaggacggctactacagctag

SEQ ID NO: 78784 - DNA, 3684 bp, Artificial Sequence
  Description of Artificial Sequence: Synthetic coding sequence
atgggcgacaccagcgaggacgccagcatccacagactggagggcaccgacctggactgccaggtgggcggcctgatctgcaagagcaagagcgccgccagcgagcagcacgtgttcaaggcccccgcccccagacccagcctgctgggcctggacctgctggccagcctgaagagaagagagagagaggagaaggacgacggcgaggacaagaagaagagcaaggtgagcagctacaaggactgggaggagagcaaggacgaccagaaggacgccgaggaggagggcggcgaccaggccggccagaacatcagaaaggacagacactacagaagcgccagagtggagacccccagccaccccggcggcgtgagcgaggagttctgggagagaagcagacagagagagagagagagaagagagcacggcgtgtacgccagcagcaaggaggagaaggactggaagaaggagaagagcagagacagagactacgacagaaagagagacagagacgagagagacagaagcagacacagcagcagaagcgagagagacggcggcagcgagagaagcagcagaagaaacgagcccgagagccccagacacagacccaaggacgccgccacccccagcagaagcacctgggaggaggaggacagcggctacggcagcagcagaagaagccagtgggagagccccagccccacccccagctacagagacagcgagagaagccacagactgagcaccagagacagagacagaagcgtgagaggcaagtacagcgacgacacccccctgcccacccccagctacaagtacaacgagtgggccgacgacagaagacacctgggcagcacccccagactgagcagaggcagaggcagaagagaggagggcgaggagggcatcagcttcgacaccgaggaggagagacagcagtgggaggacgaccagagacaggccgacagagactggtacatgatggacgagggctacgacgagttccacaaccccctggcctacagcagcgaggactacgtgagaagaagagagcagcacctgcacaagcagaagcagaagagaatcagcgcccagagaagacagatcaacgaggacaacgagagatgggagaccaacagaatgctgaccagcggcgtggtgcacagactggaggtggacgaggacttcgaggaggacaacgccgccaaggtgcacctgatggtgcacaacctggtgccccccttcctggacggcagaatcgtgttcaccaagcagcccgagcccgtgatccccgtgaaggacgccaccagcgacctggccatcatcgccagaaagggcagccagaccgtgagaaagcacagagagcagaaggagagaaagaaggcccagcacaagcactgggagctggccggcaccaagctgggcgacatcatgggcgtgaagaaggaggaggagcccgacaaggccgtgaccgaggacggcaaggtggactacagaaccgagcagaagttcgccgaccacatgaagagaaagagcgaggccagcagcgagttcgccaagaagaagagcatcctggagcagagacagtacctgcccatcttcgccgtgcagcaggagctgctgaccatcatcagagacaacagcatcgtgatcgtggtgggcgagaccggcagcggcaagaccacccagctgacccagtacctgcacgaggacggctacaccgactacggcatgatcggctgcacccagcccagaagagtggccgccatgagcgtggccaagagagtgagcgaggagatgggcggcaacctgggcgaggaggtgggctacgccatcagattcgaggactgcaccagcgagaacaccctgatcaagtacatgaccgacggcatcctgctgagagagagcctgagagaggccgacctggaccactacagcgccatcatcatggacgaggcccacgagagaagcctgaacaccgacgtgctgttcggcctgctgagagaggtggtggccagaagaagcgacctgaagctgatcgtgaccagcgccaccatggacgccgagaagttcgccgccttcttcggcaacgtgcccatcttccacatccccggcagaaccttccccgtggacatcctgttcagcaagaccccccaggaggactacgtggaggccgccgtgaagcagagcctgcaggtgcacctgagcggcgcccccggcgacatcctgatcttcatgcccggccaggaggacatcgaggtgaccagcgaccagatcgtggagcacctggaggagctggagaacgcccccgccctggccgtgctgcccatctacagccagctgcccagcgacctgcaggccaagatcttccagaaggcccccgacggcgtgagaaagtgcatcgtggccaccaacatcgccgagaccagcctgaccgtggacggcatcatgttcgtgatcgacagcggctactgcaagctgaaggtgttcaaccccagaatcggcatggacgccctgcagatctaccccatcagccaggccaacgccaaccagagaagcggcagagccggcagaaccggccccggccagtgcttcagactgtacacccagagcgcctacaagaacgagctgctgaccaccaccgtgcccgagatccagagaaccaacctggccaacgtggtgctgctgctgaagagcctgggcgtgcaggacctgctgcagttccacttcatggaccccccccccgaggacaacatgctgaacagcatgtaccagctgtggatcctgggcgccctggacaacaccggcggcctgaccagcaccggcagactgatggtggagttccccctggaccccgccctgagcaagatgctgatcgtgagctgcgacatgggctgcagcagcgagatcctgctgatcgtgagcatgctgagcgtgcccgccatcttctacagacccaagggcagagaggaggagagcgaccagatcagagagaagttcgccgtgcccgagagcgaccacctgacctacctgaacgtgtacctgcagtggaagaacaacaactacagcaccatctggtgcaacgaccacttcatccacgccaaggccatgagaaaggtgagagaggtgagagcccagctgaaggacatcatggtgcagcagagaatgagcctggccagctgcggcaccgactgggacatcgtgagaaagtgcatctgcgccgcctacttccaccaggccgccaagctgaagggcatcggcgagtacgtgaacatcagaaccggcatgccctgccacctgcaccccaccagcagcctgttcggcatgggctacacccccgactacatcgtgtaccacgagctggtgatgaccaccaaggagtacatgcagtgcgtgaccgccgtggacggcgagtggctggccgagctgggccccatgttctacagcgtgaagcaggccggcaagagcagacaggagaacagaagaagagccaaggaggaggccagcgccatggaggaggagatggccctggccgaggagcagctgagagccagaagacaggagcaggagaagagaagccccctgggcagcgtgagaagcaccaagatctacacccccggcagaaaggagcagggcgagcccatgacccccagaagaacccccgccagattcggcctgtag

SEQ ID NO: 78785 - DNA, 1620 bp, Artificial Sequence
  Description of Artificial Sequence: Synthetic coding sequence
atgggcgacaccagcgaggacgccagcatccacagactggagggcaccgacctggactgccaggtgggcggcctgatctgcaagagcaagagcgccgccagcgagcagcacgtgttcaaggcccccgcccccagacccagcctgctgggcctggacctgctggccagcctgaagagaagagagagagaggagaaggacgacggcgaggacaagaagaagagcaaggtgagcagctacaaggactgggaggagagcaaggacgaccagaaggacgccgaggaggagggcggcgaccaggccaagatcttccagaaggcccccgacggcgtgagaaagtgcatcgtggccaccaacatcgccgagaccagcctgaccgtggacggcatcatgttcgtgatcgacagcggctactgcaagctgaaggtgttcaaccccagaatcggcatggacgccctgcagatctaccccatcagccaggccaacgccaaccagagaagcggcagagccggcagaaccggccccggccagtgcttcagactgtacacccagagcgcctacaagaacgagctgctgaccaccaccgtgcccgagatccagagaaccaacctggccaacgtggtgctgctgctgaagagcctgggcgtgcaggacctgctgcagttccacttcatggaccccccccccgaggacaacatgctgaacagcatgtaccagctgtggatcctgggcgccctggacaacaccggcggcctgaccagcaccggcagactgatggtggagttccccctggaccccgccctgagcaagatgctgatcgtgagctgcgacatgggctgcagcagcgagatcctgctgatcgtgagcatgctgagcgtgcccgccatcttctacagacccaagggcagagaggaggagagcgaccagatcagagagaagttcgccgtgcccgagagcgaccacctgacctacctgaacgtgtacctgcagtggaagaacaacaactacagcaccatctggtgcaacgaccacttcatccacgccaaggccatgagaaaggtgagagaggtgagagcccagctgaaggacatcatggtgcagcagagaatgagcctggccagctgcggcaccgactgggacatcgtgagaaagtgcatctgcgccgcctacttccaccaggccgccaagctgaagggcatcggcgagtacgtgaacatcagaaccggcatgccctgccacctgcaccccaccagcagcctgttcggcatgggctacacccccgactacatcgtgtaccacgagctggtgatgaccaccaaggagtacatgcagtgcgtgaccgccgtggacggcgagtggctggccgagctgggccccatgttctacagcgtgaagcaggccggcaagagcagacaggagaacagaagaagagccaaggaggaggccagcgccatggaggaggagatggccctggccgaggagcagctgagagccagaagacaggagcaggagaagagaagccccctgggcagcgtgagaagcaccaagatctacacccccggcagaaaggagcagggcgagcccatgacccccagaagaacccccgccagattcggcctgtag

SEQ ID NO: 78786 - DNA, 2340 bp, Artificial Sequence
  Description of Artificial Sequence: Synthetic coding sequence
atgagcagattccccgccgtggccggcagagcccccagaagacaggaggagggcgagagaagcagagacctgcaggaggagagactgagcgccgtgtgcatcgccgacagagaggagaagggctgcaccagccaggagggcggcaccacccccaccttccccatccagaagcagagaaagaagatcatccaggccgtgagagacaacagcttcctgatcgtgaccggcaacaccggcagcggcaagaccacccagctgcccaagtacctgtacgaggccggcttcagccagcacggcatgatcggcgtgacccagcccagaaaggtggccgccatcagcgtggcccagagagtggccgaggagatgaagtgcaccctgggcagcaaggtgggctaccaggtgagattcgacgactgcagcagcaaggagaccgccatcaagtacatgaccgacggctgcctgctgaagcacatcctgggcgaccccaacctgaccaagttcagcgtgatcatcctggacgaggcccacgagagaaccctgaccaccgacatcctgttcggcctgctgaagaagctgttccaggagaagagccccaacagaaaggagcacctgaaggtggtggtgatgagcgccaccatggagctggccaagctgagcgccttcttcggcaactgccccatcttcgacatccccggcagactgtaccccgtgagagagaagttctgcaacctgatcggccccagagacagagagaacaccgcctacatccaggccatcgtgaaggtgaccatggacatccacctgaacgagatggccggcgacatcctggtgttcctgaccggccagttcgagatcgagaagagctgcgagctgctgttccagatggccgagagcgtggactacgactacgacgtgcaggacaccaccctggacggcctgctgatcctgccctgctacggcagcatgaccaccgaccagcagagaagaatcttcctgccccccccccccggcatcagaaagtgcgtgatcagcaccaacatcagcgccaccagcctgaccatcgacggcatcagatacgtggtggacggcggcttcgtgaagcagctgaaccacaaccccagactgggcctggacatcctggaggtggtgcccatcagcaagagcgaggccctgcagagaagcggcagagccggcagaaccagcagcggcaagtgcttcagaatctacagcaaggacttctggaaccagtgcatgcccgaccacgtgatccccgagatcaagagaaccagcctgaccagcgtggtgctgaccctgaagtgcctggccatccacgacgtgatcagattcccctacctggacccccccaacgagagactgatcctggaggccctgaagcagctgtaccagtgcgacgccatcgacagaagcggccacgtgaccagactgggcctgagcatggtggagttccccctgcccccccacctgacctgcgccgtgatcaaggccgccagcctggactgcgaggacctgctgctgcccatcgccgccatgctgagcgtggagaacgtgttcatcagacccgtggaccccgagtaccagaaggaggccgagcagagacacagagagctggccgccaaggccggcggcttcaacgacttcgccaccctggccgtgatcttcgagcagtgcaagagcagcggcgcccccgccagctggtgccagaagcactggatccactggagatgcctgttcagcgccttcagagtggaggcccagctgagagagctgatcagaaagctgaagcagcagagcgacttccccaaggagaccttcgagggccccaagcacgaggtgctgagaagatgcctgtgcgccggctacttcaagaacgtggccagaagaagcgtgggcagaaccttctgcaccatggacggcagaggcagccccgtgcacatccaccccagcagcgccctgcacgagcaggagaccaagctggagtggatcatcttccacgaggtgctggtgaccaccaaggtgtacgccagaatcgtgtgccccatcagatacgagtgggtgagagacctgctgcccaagctgcacgagttcaacgcccacgacctgagcagcgtggccagaagagaggtgagagaggacgccagaagaagatggaccaacaaggagaacgtgaagcagctgaaggacggcatcagcaaggacgtgctgaagaagatgcagagaagaaacgacgacaagagcatcagcgacgccagagccagattcctggagagaaagcagcagagaacccaggaccacagcgacaccagaaaggagaccggctag

SEQ ID NO: 78787 - DNA, 2169 bp, Artificial Sequence
  Description of Artificial Sequence: Synthetic coding sequence
atgagcagattccccgccgtggccggcagagcccccagaagacaggaggagggcgagagaagcagagacctgcaggaggagagactgagcgccgtgtgcatcgccgacagagaggagaagggctgcaccagccaggagggcggcaccacccccaccttccccatccagaagcagagaaagaagatcatccaggccgtgagagacaacagcttcctgatcgtgaccggcaacaccggcagcggcaagaccacccagctgcccaagtacctgtacgaggccggcttcagccagcacggcatgatcggcgtgacccagcccagaaaggtggccgccatcagcgtggcccagagagtggccgaggagatgaagtgcaccctgggcagcaaggtgggctaccaggtgagattcgacgactgcagcagcaaggagaccgccatcaagtacatgaccgacggctgcctgctgaagcacatcctgggcgaccccaacctgaccaagttcagcgtgatcatcctggacgaggcccacgagagaaccctgaccaccgacatcctgttcggcctgctgaagaagctgttccaggagaagagccccaacagaaaggagcacctgaaggtggtggtgatgagcgccaccatggagctggccaagctgagcgccttcttcggcaactgccccatcttcgacatccccggcagactgtaccccgtgagagagaagttctgcaacctgatcggccccagagacagagagaacaccgcctacatccaggccatcgtgaaggtgaccatggacatccacctgaacgagatggccggcgacatcctggtgttcctgaccggccagttcgagatcgagaagagctgcgagctgctgttccagatggccgagagcgtggactacgactacgacgtgcaggacaccaccctggacggcctgctgatcctgccctgctacggcagcatgaccaccgaccagcagagaagaatcttcctgccccccccccccggcatcagaaagtgcgtgatcagcaccaacatcagcgccaccagcctgaccatcgacggcatcagatacgtggtggacggcggcttcgtgaagcagctgaaccacaaccccagactgggcctggacatcctggaggtggtgcccatcagcaagagcgaggccctgcagagaagcggcagagccggcagaaccagcagcggcaagtgcttcagaatctacagcaaggacttctggaaccagtgcatgcccgaccacgtgatccccgagatcaagagaaccagcctgaccagcgtggtgctgaccctgaagtgcctggccatccacgacgtgatcagattcccctacctggacccccccaacgagagactgatcctggaggccctgaagcagctgtaccagtgcgacgccatcgacagaagcggccacgtgaccagactgggcctgagcatggtggagttccccctgcccccccacctgacctgcgccgtgatcaaggccgccagcctggactgcgaggacctgctgctgcccatcgccgccatgctgagcgtggagaacgtgttcatcagacccgtggaccccgagtaccagaaggaggccgagcagagacacagagagctggccgccaaggccggcggcttcaacgacttcgccaccctggccgtgatcttcgagcagtgcaagagcagcggcgcccccgccagctggtgccagaagcactggatccactggagatgcctgttcagcgccttcagagtggaggcccagctgagagagctgatcagaaagctgaagcagcagagcgacttccccaaggagaccttcgagggccccaagcacgaggtgctgagaagatgcctgtgcgccggctacttcaagaacgtggccagaagaagcgtgggcagaaccttctgcaccatggacggcagaggcagccccgtgcacatccaccccagcagcgccctgcacgagcaggagaccaagctggagtggatcatcttccacgaggtgctggtgaccaccaaggtgtacgccagaatcgtgtgccccatcagatacgagtgggtgagagacctgctgcccaagctgcacgagttcaacgcccacgacctgagcagcgtggccagaagagaggtgagcaagatcaagctgttccagtag

SEQ ID NO: 78788 - DNA, 2196 bp, Artificial Sequence
  Description of Artificial Sequence: Synthetic coding sequence
atgatcggcgtgacccagcccagaaaggtggccgccatcagcgtggcccagagagtggccgaggagatgaagtgcaccctgggcagcaaggtgggctaccaggtgagattcgacgactgcagcagcaaggagaccgccatcaagtacatgaccgacggctgcctgctgaagcacatcctgggcgaccccaacctgaccaagttcagcgtgatcatcctggacgaggcccacgagagaaccctgaccaccgacatcctgttcggcctgctgaagaagctgttccaggagaagagccccaacagaaaggagcacctgaaggtggtggtgatgagcgccaccatggagctggccaagctgagcgccttcttcggcaactgccccatcttcgacatccccggcagactgtaccccgtgagagagaagttctgcaacctgatcggccccagagacagagagaacaccgcctacatccaggccatcgtgaaggtgaccatggacatccacctgaacgagatggccggcgacatcctggtgttcctgaccggccagttcgagatcgagaagagctgcgagctgctgttccagatggccgagagcgtggactacgactacgacgtgcaggacaccaccctggacggcctgctgatcctgccctgctacggcagcatgaccaccgtgagccagaccagcctgaccttcgtgacccacatccagatcatgaagcagatcagcgagaaccagcacagcctgaccggcctgaccatcgccggcatcaccggcgtgagccaccacgccagacccagaaacatgacctgcaacgagaagctgaaccagcagagaagaatcttcctgccccccccccccggcatcagaaagtgcgtgatcagcaccaacatcagcgccaccagcctgaccatcgacggcatcagatacgtggtggacggcggcttcgtgaagcagctgaaccacaaccccagactgggcctggacatcctggaggtggtgcccatcagcaagagcgaggccctgcagagaagcggcagagccggcagaaccagcagcggcaagtgcttcagaatctacagcaaggacttctggaaccagtgcatgcccgaccacgtgatccccgagatcaagagaaccagcctgaccagcgtggtgctgaccctgaagtgcctggccatccacgacgtgatcagattcccctacctggacccccccaacgagagactgatcctggaggccctgaagcagctgtaccagtgcgacgccatcgacagaagcggccacgtgaccagactgggcctgagcatggtggagttccccctgcccccccacctgacctgcgccgtgatcaaggccgccagcctggactgcgaggacctgctgctgcccatcgccgccatgctgagcgtggagaacgtgttcatcagacccgtggaccccgagtaccagaaggaggccgagcagagacacagagagctggccgccaaggccggcggcttcaacgacttcgccaccctggccgtgatcttcgagcagtgcaagagcagcggcgcccccgccagctggtgccagaagcactggatccactggagatgcctgttcagcgccttcagagtggaggcccagctgagagagctgatcagaaagctgaagcagcagagcgacttccccaaggagaccttcgagggccccaagcacgaggtgctgagaagatgcctgtgcgccggctacttcaagaacgtggccagaagaagcgtgggcagaaccttctgcaccatggacggcagaggcagccccgtgcacatccaccccagcagcgccctgcacgagcaggagaccaagctggagtggatcatcttccacgaggtgctggtgaccaccaaggtgtacgccagaatcgtgtgccccatcagatacgagtgggtgagagacctgctgcccaagctgcacgagttcaacgcccacgacctgagcagcgtggccagaagagaggtgagagaggacgccagaagaagatggaccaacaaggagaacgtgaagcagctgaaggacggcatcagcaaggacgtgctgaagaagatgcagagaagaaacgacgacaagagcatcagcgacgccagagccagattcctggagagaaagcagcagagaacccaggaccacagcgacaccagaaaggagaccggctag

SEQ ID NO: 78789 - DNA, 2109 bp, Artificial Sequence
  Description of Artificial Sequence: Synthetic coding sequence
atgagcagattccccgccgtggccggcagagcccccagaagacaggaggagggcgagagaagcagagacctgcaggaggagagactgagcgccgtgtgcatcgccgacagagaggagaagggctgcaccagccaggagggcggcaccacccccaccttccccatccagaagcagagaaagaagatcatccaggccgagaccgccatcaagtacatgaccgacggctgcctgctgaagcacatcctgggcgaccccaacctgaccaagttcagcgtgatcatcctggacgaggcccacgagagaaccctgaccaccgacatcctgttcggcctgctgaagaagctgttccaggagaagagccccaacagaaaggagcacctgaaggtggtggtgatgagcgccaccatggagctggccaagctgagcgccttcttcggcaactgccccatcttcgacatccccggcagactgtaccccgtgagagagaagttctgcaacctgatcggccccagagacagagagaacaccgcctacatccaggccatcgtgaaggtgaccatggacatccacctgaacgagatggccggcgacatcctggtgttcctgaccggccagttcgagatcgagaagagctgcgagctgctgttccagatggccgagagcgtggactacgactacgacgtgcaggacaccaccctggacggcctgctgatcctgccctgctacggcagcatgaccaccgaccagcagagaagaatcttcctgccccccccccccggcatcagaaagtgcgtgatcagcaccaacatcagcgccaccagcctgaccatcgacggcatcagatacgtggtggacggcggcttcgtgaagcagctgaaccacaaccccagactgggcctggacatcctggaggtggtgcccatcagcaagagcgaggccctgcagagaagcggcagagccggcagaaccagcagcggcaagtgcttcagaatctacagcaaggacttctggaaccagtgcatgcccgaccacgtgatccccgagatcaagagaaccagcctgaccagcgtggtgctgaccctgaagtgcctggccatccacgacgtgatcagattcccctacctggacccccccaacgagagactgatcctggaggccctgaagcagctgtaccagtgcgacgccatcgacagaagcggccacgtgaccagactgggcctgagcatggtggagttccccctgcccccccacctgacctgcgccgtgatcaaggccgccagcctggactgcgaggacctgctgctgcccatcgccgccatgctgagcgtggagaacgtgttcatcagacccgtggaccccgagtaccagaaggaggccgagcagagacacagagagctggccgccaaggccggcggcttcaacgacttcgccaccctggccgtgatcttcgagcagtgcaagagcagcggcgcccccgccagctggtgccagaagcactggatccactggagatgcctgttcagcgccttcagagtggaggcccagctgagagagctgatcagaaagctgaagcagcagagcgacttccccaaggagaccttcgagggccccaagcacgaggtgctgagaagatgcctgtgcgccggctacttcaagaacgtggccagaagaagcgtgggcagaaccttctgcaccatggacggcagaggcagccccgtgcacatccaccccagcagcgccctgcacgagcaggagaccaagctggagtggatcatcttccacgaggtgctggtgaccaccaaggtgtacgccagaatcgtgtgccccatcagatacgagtgggtgagagacctgctgcccaagctgcacgagttcaacgcccacgacctgagcagcgtggccagaagagaggtgagagaggacgccagaagaagatggaccaacaaggagaacgtgaagcagctgaaggacggcatcagcaaggacgtgctgaagaagatgcagagaagaaacgacgacaagagcatcagcgacgccagagccagattcctggagagaaagcagcagagaacccaggaccacagcgacaccagaaaggagaccggctag

SEQ ID NO: 78790 - DNA, 3663 bp, Artificial Sequence
  Description of Artificial Sequence: Synthetic coding sequence
atggccgtggccgtggccatggccggcgccctgatcggcagcgagcccggccccgccgaggagctggccaagctggagtacctgagcctggtgagcaaggtgtgcaccgagctggacaaccacctgggcatcaacgacaaggacctggccgagttcgtgatcagcctggccgagaagaacaccaccttcgacaccttcaaggccagcctggtgaagaacggcgccgagttcaccgacagcctgatcagcaacctgctgagactgatccagaccatgagaccccccgccaagcccagcaccagcaaggaccccgtggtgaagcccaagaccgagaaggagaagctgaaggagctgttccccgtgctgtgccagcccgacaaccccagcgtgagaaccatgctggacgaggacgacgtgaaggtggccgtggacgtgctgaaggagctggaggccctgatgcccagcgccgccggccaggagaagcagagagacgccgagcacagagacagaaccaagaagaagaagagaagcagaagcagagacagaaacagagacagagacagagacagagagagaaacagagacagagaccacaagagaagacacagaagcagaagcagaagcagaagcagaaccagagagagaaacaaggtgaagagcagatacagaagcagaagcagaagccagagcccccccaaggacagaaaggacagagacaagtacggcgagagaaacctggacagatggagagacaagcacgtggacagacccccccccgaggagcccaccatcggcgacatctacaacggcaaggtgaccagcatcatgcagttcggctgcttcgtgcagctggagggcctgagaaagagatgggagggcctggtgcacatcagcgagctgagaagagagggcagagtggccaacgtggccgacgtggtgagcaagggccagagagtgaaggtgaaggtgctgagcttcaccggcaccaagaccagcctgagcatgaaggacgtggaccaggagaccggcgaggacctgaaccccaacagaagaagaaacctggtgggcgagaccaacgaggagaccagcatgagaaaccccgacagacccacccacctgagcctggtgagcgcccccgaggtggaggacgacagcctggagagaaagagactgaccagaatcagcgaccccgagaagtgggagatcaagcagatgatcgccgccaacgtgctgagcaaggaggagttccccgacttcgacgaggagaccggcatcctgcccaaggtggacgacgaggaggacgaggacctggagatcgagctggtggaggaggagccccccttcctgagaggccacaccaagcagagcatggacatgagccccatcaagatcgtgaagaaccccgacggcagcctgagccaggccgccatgatgcagagcgccctggccaaggagagaagagagctgaagcaggcccagagagaggccgagatggacagcatccccatgggcctgaacaagcactgggtggaccccctgcccgacgccgagggcagacagatcgccgccaacatgagaggcatcggcatgatgcccaacgacatccccgagtggaagaagcacgccttcggcggcaacaaggccagctacggcaagaagacccagatgagcatcctggagcagagagagagcctgcccatctacaagctgaaggagcagctggtgcaggccgtgcacgacaaccagatcctgatcgtgatcggcgagaccggcagcggcaagaccacccagatcacccagtacctggccgaggccggctacaccagcagaggcaagatcggctgcacccagcccagaagagtggccgccatgagcgtggccaagagagtgagcgaggagttcggctgctgcctgggccaggaggtgggctacaccatcagattcgaggactgcaccagccccgagaccgtgatcaagtacatgaccgacggcatgctgctgagagagtgcctgatcgaccccgacctgacccagtacgccatcatcatgctggacgaggcccacgagagaaccatccacaccgacgtgctgttcggcctgctgaagaagaccgtgcagaagagacaggacatgaagctgatcgtgaccagcgccaccctggacgccgtgaagttcagccagtacttctacgaggcccccatcttcaccatccccggcagaacctaccccgtggagatcctgtacaccaaggagcccgagaccgactacctggacgccagcctgatcaccgtgatgcagatccacctgaccgagccccccggcgacatcctggtgttcctgaccggccaggaggagatcgacaccgcctgcgagatcctgtacgagagaatgaagagcctgggccccgacgtgcccgagctgatcatcctgcccgtgtacagcgccctgcccagcgagatgcagaccagaatcttcgaccccgccccccccggcagcagaaaggtggtgatcgccaccaacatcgccgagaccagcctgaccatcgacggcatctactacgtggtggaccccggcttcgtgaagcagaaggtgtacaacagcaagaccggcatcgaccagctggtggtgacccccatcagccaggcccaggccaagcagagagccggcagagccggcagaaccggccccggcaagtgctacagactgtacaccgagagagcctacagagacgagatgctgaccaccaacgtgcccgagatccagagaaccaacctggccagcaccgtgctgagcctgaaggccatgggcatcaacgacctgctgagcttcgacttcatggacgccccccccatggagaccctgatcaccgccatggagcagctgtacaccctgggcgccctggacgacgagggcctgctgaccagactgggcagaagaatggccgagttccccctggagcccatgctgtgcaagatgctgatcatgagcgtgcacctgggctgcagcgaggagatgctgaccatcgtgagcatgctgagcgtgcagaacgtgttctacagacccaaggacaagcaggccctggccgaccagaagaaggccaagttccaccagaccgagggcgaccacctgaccctgctggccgtgtacaacagctggaagaacaacaagttcagcaacccctggtgctacgagaacttcatccaggccagaagcctgagaagagcccaggacatcagaaagcagatgctgggcatcatggacagacacaagctggacgtggtgagctgcggcaagagcaccgtgagagtgcagaaggccatctgcagcggcttcttcagaaacgccgccaagaaggacccccaggagggctacagaaccctgatcgaccagcaggtggtgtacatccaccccagcagcgccctgttcaacagacagcccgagtgggtggtgtaccacgagctggtgctgaccaccaaggagtacatgagagaggtgaccaccatcgaccccagatggctggtggagttcgcccccgccttcttcaaggtgagcgaccccaccaagctgagcaagcagaagaagcagcagagactggagcccctgtacaacagatacgaggagcccaacgcctggagaatcagcagagccttcagaagaagatag

SEQ ID NO: 78791 - DNA, 3546 bp, Artificial Sequence
  Description of Artificial Sequence: Synthetic coding sequence
atggccgtggccgtggccatggccggcgccctgatcggcagcgagcccggccccgccgaggagctggccaagctggagtacctgagcctggtgagcaaggtgtgcaccgagctggacaaccacctgggcatcaacgacaaggacctggccgagttcgtgatcagcctggccgagaagaacaccaccttcgacaccttcaaggccagcctggtgaagaacggcgccgagttcaccgacagcctgatcagcaacctgctgagactgatccagaccatgagaccccccgccaagcccagcaccagcaaggaccccgtggtgaagcccaagaccgagaaggagaagctgaaggagctgttccccgtgctgtgccagcccgacaaccccagcgtgagaaccatgctggacgaggacgacgtgaaggtggccgtggacgtgctgaaggagctggaggccctgatgcccagcgccgccggccaggagaagcagagagacgccgagcacagagacagaaccaagaagaagaagagaagcagaagcagagacagaaacagagacagagacagagacagagagagaaacagagacagagaccacaagagaagacacagaagcagaagcagaagcagaagcagaaccagagagagaaacaaggtgaagagcagatacagaagcagaagcagaagccagagcccccccaaggacagaaaggacagagacaagtacggcgagagaaacctggacagatggagagacaagcacgtggacagacccccccccgaggagcccaccatcggcgacatctacaacggcaaggtgaccagcatcatgcagttcggctgcttcgtgcagctggagggcctgagaaagagatgggagggcctggtgcacatcagcgagctgagaagagagggcagagtggccaacgtggccgacgtggtgagcaagggccagagagtgaaggtgaaggtgctgagcttcaccggcaccaagaccagcctgagcatgaaggacgtggaccaggagaccggcgaggacctgaaccccaacagaagaagaaacctggtgggcgagaccaacgaggagaccagcatgagaaaccccgacagacccacccacctgagcctggtgagcgcccccgaggtggaggacgacagcctggagagaaagagactgaccagaatcagcgaccccgagaagtgggagatcaagcagatgatcgccgccaacgtgctgagcaaggaggagttccccgacttcgacgaggagaccggcatcctgcccaaggtggacgacgaggaggacgaggacctggagatcgagctggtggaggaggagccccccttcctgagaggccacaccaagcagagcatggacatgagccccatcaagatcgtgaagaaccccgacggcagcctgagccaggccgccatgatgcagagcgccctggccaaggagagaagagagctgaagcaggcccagagagaggccgagatggacagcatccccatgggcctgaacaagcactgggtggaccccctgcccgacgccgagggcagacagatcgccgccaacatgagaggcatcggcatgatgcccaacgacatccccgagtggaagaagcacgccttcggcggcaacaaggccagctacggcaagaagacccagatgagcatcctggagcagagagagagcctgcccatctacaagctgaaggagcagctggtgcaggccgtgcacgacaaccagatcctgatcgtgatcggcgagaccggcagcggcaagaccacccagatcacccagtacctggccgaggccggctacaccagcagaggcaagatcggctgcacccagcccagaagagtggccgccatgagcgtggccaagagagtgagcgaggagttcggctgctgcctgggccaggaggtgggctacaccatcagattcgaggactgcaccagccccgagaccgtgatcaagtacatgaccgacggcatgctgctgagagagtgcctgatcgaccccgacctgacccagtacgccatcatcatgctggacgaggcccacgagagaaccatccacaccgacgtgctgttcggcctgctgaagaagaccgtgcagaagagacaggacatgaagctgatcgtgaccagcgccaccctggacgccgtgaagttcagccagtacttctacgaggcccccatcttcaccatccccggcagaacctaccccgtggagatcctgtacaccaaggagcccgagaccgactacctggacgccagcctgatcaccgtgatgcagatccacctgaccgagccccccggcgacatcctggtgttcctgaccggccaggaggagatcgacaccgcctgcgagatcctgtacgagagaatgaagagcctgggccccgacgtgcccgagctgatcatcctgcccgtgtacagcgccctgcccagcgagatgcagaccagaatcttcgaccccgccccccccggcagcagaaaggtggtgatcgccaccaacatcgccgagaccagcctgaccatcgacggcatctactacgtggtggaccccggcttcgtgaagcagaaggtgtacaacagcaagaccggcatcgaccagctggtggtgacccccatcagccaggcccaggccaagcagagagccggcagagccggcagaaccggccccggcaagtgctacagactgtacaccgagagagcctacagagacgagatgctgaccaccaacgtgcccgagatccagagaaccaacctggccagcaccgtgctgagcctgaaggccatgggcatcaacgacctgctgagcttcgacttcatggacgccccccccatggagaccctgatcaccgccatggagcagctgtacaccctgggcgccctggacgacgagggcctgctgaccagactgggcagaagaatggccgagttccccctggagcccatgctgtgcaagatgctgatcatgagcgtgcacctgggctgcagcgaggagatgctgaccatcgtgagcatgctgagcgtgcagaacgtgttctacagacccaaggacaagcaggccctggccgaccagaagaaggccaagttccaccagaccgagggcgaccacctgaccctgctggccgtgtacaacagctggaagaacaacaagttcagcaacccctggtgctacgagaacttcatccaggccagaagcctgagaagagcccaggacatcagaaagcagatgctgggcatcatggacagacacaagctggacgtggtgagctgcggcaagagcaccgtgagagtgcagaaggccatctgcagcggcttcttcagaaacgccgccaagaaggacccccaggagggctacagaaccctgatcgaccagcaggtggtgtacatccaccccagcagcgccctgttcaacagacagcccgagtgccccaagcacttcctgcccgtggtggccgtggccgtgagcctggagcagtgcctgagcaagttcgaggacctgaacaaggagctgggcctggtgacctgctag

SEQ ID NO: 78792 - DNA, 3813 bp, Artificial Sequence
  Description of Artificial Sequence: Synthetic coding sequence
atgggcgacgtgaagaacttcctgtacgcctggtgcggcaagagaaagatgacccccagctacgagatcagagccgtgggcaacaagaacagacagaagttcatgtgcgaggtgcaggtggagggctacaactacaccggcatgggcaacagcaccaacaagaaggacgcccagagcaacgccgccagagacttcgtgaactacctggtgagaatcaacgagatcaagagcgaggaggtgcccgccttcggcgtggccagccccccccccctgaccgacacccccgacaccaccgccaacgccgagggcgacctgcccaccaccatgggcggccccctgcccccccacctggccctgaaggccgagaacaacagcgaggtgggcgccagcggctacggcgtgcccggccccacctgggacagaggcgccaacctgaaggactactacagcagaaaggaggagcaggaggtgcaggccaccctggagagcgaggaggtggacctgaacgccggcctgcacggcaactggaccctggagaacgccaaggccagactgaaccagtacttccagaaggagaagatccagggcgagtacaagtacacccaggtgggccccgaccacaacagaagcttcatcgccgagatgaccatctacatcaagcagctgggcagaagaatcttcgccagagagcacggcagcaacaagaagctggccgcccagagctgcgccctgagcctggtgagacagctgtaccacctgggcgtggtggaggcctacagcggcctgaccaagaagaaggagggcgagaccgtggagccctacaaggtgaacctgagccaggacctggagcaccagctgcagaacatcatccaggagctgaacctggagatcctgcccccccccgaggaccccagcgtgcccgtggccctgaacatcggcaagctggcccagttcgagcccagccagagacagaaccaggtgggcgtggtgccctggagccccccccagagcaactggaacccctggaccagcagcaacatcgacgagggccccctggccttcgccacccccgagcagatcagcatggacctgaagaacgagctgatgtaccagctggagcaggaccacgacctgcaggccatcctgcaggagagagagctgctgcccgtgaagaagttcgagagcgagatcctggaggccatcagccagaacagcgtggtgatcatcagaggcgccaccggctgcggcaagaccacccaggtgccccagttcatcctggacgacttcatccagaacgacagagccgccgagtgcaacatcgtggtgacccagcccagaagaatcagcgccgtgagcgtggccgagagagtggccttcgagagaggcgaggagcccggcaagagctgcggctacagcgtgagattcgagagcatcctgcccagaccccacgccagcatcatgttctgcaccgtgggcgtgctgctgagaaagctggaggccggcatcagaggcatcagccacgtgatcgtggacgagatccacgagagagacatcaacaccgacttcctgctggtggtgctgagagacgtggtgcaggcctaccccgaggtgagaatcgtgctgatgagcgccaccatcgacaccagcatgttctgcgagtacttcttcaactgccccatcatcgaggtgtacggcagaacctaccccgtgcaggagtacttcctggaggactgcatccagatgacccacttcgtgcccccccccaaggacaagaagaagaaggacaaggacgacgacggcggcgaggacgacgacgccaactgcaacctgatctgcggcgacgagtacggccccgagaccagactgagcatgagccagctgaacgagaaggagacccccttcgagctgatcgaggccctgctgaagtacatcgagaccctgaacgtgcccggcgccgtgctggtgttcctgcccggctggaacctgatctacaccatgcagaagcacctggagatgaacccccacttcggcagccacagataccagatcctgcccctgcacagccagatccccagagaggagcagagaaaggtgttcgaccccgtgcccgtgggcgtgaccaaggtgatcctgagcaccaacatcgccgagaccagcatcaccatcaacgacgtggtgtacgtgatcgacagctgcaagcagaaggtgaagctgttcaccgcccacaacaacatgaccaactacgccaccgtgtgggccagcaagaccaacctggagcagagaaagggcagagccggcagagtgagacccggcttctgcttccacctgtgcagcagagccagattcgagagactggagacccacatgacccccgagatgttcagaacccccctgcacgagatcgccctgagcatcaagctgctgagactgggcggcatcggccagttcctggccaaggccatcgagcccccccccctggacgccgtgatcgaggccgagcacaccctgagagagctggacgccctggacgccaacgacgagctgacccccctgggcagaatcctggccaagctgcccatcgagcccagattcggcaagatgatgatcatgggctgcatcttctacgtgggcgacgccatctgcaccatcgccgccgccacctgcttccccgagcccttcatcaacgagggcaagagactgggctacatccacagaaacttcgccggcaacagattcagcgaccacgtggccctgctgagcgtgttccaggcctgggacgacgccagaatgggcggcgaggaggccgagatcagattctgcgagcacaagagactgaacatggccaccctgagaatgacctgggaggccaaggtgcagctgaaggagatcctgatcaacagcggcttccccgaggactgcctgctgacccaggtgttcaccaacaccggccccgacaacaacctggacgtggtgatcagcctgctggccttcggcgtgtaccccaacgtgtgctaccacaaggagaagagaaagatcctgaccaccgagggcagaaacgccctgatccacaagagcagcgtgaactgccccttcagcagccaggacatgaagtaccccagccccttcttcgtgttcggcgagaagatcagaaccagagccatcagcgccaagggcatgaccctggtgacccccctgcagctgctgctgttcgccagcaagaaggtgcagagcgacggccagatcgtgctggtggacgactggatcaagctgcagatcagccacgaggccgccgcctgcatcaccggcctgagagccgccatggaggccctggtggtggaggtgaccaagcagcccgccatcatcagccagctggaccccgtgaacgagagaatgctgaacatgatcagacagatcagcagacccagcgccgccggcatcaacctgatgatcggcagcaccagatacggcgacggccccagaccccccaagatggccagatacgacaacggcagcggctacagaagaggcggcagcagctacagcggcggcggctacggcggcggctacagcagcggcggctacggcagcggcggctacggcggcagcgccaacagcttcagagccggctacggcgccggcgtgggcggcggctacagaggcgtgagcagaggcggcttcagaggcaacagcggcggcgactacagaggccccagcggcggctacagaggcagcggcggcttccagagaggcggcggcagaggcgcctacggcaccggctacttcggccagggcagaggcggcggcggctactag

SEQ ID NO: 78793 - DNA, 1800 bp, Artificial Sequence
  Description of Artificial Sequence: Synthetic coding sequence
atgggcgacgtgaagaacttcctgtacgcctggtgcggcaagagaaagatgacccccagctacgagatcagagccgtgggcaacaagaacagacagaagttcatgtgcgaggtgcaggtggagggctacaactacaccggcatgggcaacagcaccaacaagaaggacgcccagagcaacgccgccagagacttcgtgaactacctggtgagaatcaacgagatcaagagcgaggaggtgcccgccttcggcgtggccagccccccccccctgaccgacacccccgacaccaccgccaacgccgagggcgacctgcccaccaccatgggcggccccctgcccccccacctggccctgaaggccgagaacaacagcgaggtgggcgccagcggctacggcgtgcccggccccacctgggacagaggcgccaacctgaaggactactacagcagaaaggaggagcaggaggtgcaggccaccctggagagcgaggaggtggacctgaacgccggcctgcacggcaactggaccctggagaacgccaaggccagactgaaccagtacttccagaaggagaagatccagggcgagtacaagtacacccaggtgggccccgaccacaacagaagcttcatcgccgagatgaccatctacatcaagcagctgggcagaagaatcttcgccagagagcacggcagcaacaagaagctggccgcccagagctgcgccctgagcctggtgagacagctgtaccacctgggcgtggtggaggcctacagcggcctgaccaagaagaaggagggcgagaccgtggagccctacaaggtgaacctgagccaggacctggagcaccagctgcagaacatcatccaggagctgaacctggagatcctgcccccccccgaggaccccagcgtgcccgtggccctgaacatcggcaagctggcccagttcgagcccagccagagacagaaccaggtgggcgtggtgccctggagccccccccagagcaactggaacccctggaccagcagcaacatcgacgagggccccctggccttcgccacccccgagcagatcagcatggacctgaagaacgagctgatgtaccagctggagcaggaccacgacctgcaggccatcctgcaggagagagagctgctgcccgtgaagaagttcgagagcgagatcctggaggccatcagccagaacagcgtggtgatcatcagaggcgccaccggctgcggcaagaccacccaggtgccccagttcatcctggacgacttcatccagaacgacagagccgccgagtgcaacatcgtggtgacccagcccagaagaatcagcgccgtgagcgtggccgagagagtggccttcgagagaggcgaggagcccggcaagagctgcggctacagcgtgagattcgagagcatcctgcccagaccccacgccagcatcatgttctgcaccgtgggcgtgctgctgagaaagctggaggccggcatcagaggcatcagccacgtgatcgtggacgagatccacgagagagacatcaacaccgacttcctgctggtggtgctgagagacgtggtgcaggcctaccccgaggtgagaatcgtgctgatgagcgccaccatcgacaccagcatgttctgcgagtacttcttcaactgccccatcatcgaggtgtacggcagaacctaccccgtgcaggagtacttcctggaggactgcatccagatgacccacttcgtgcccccccccaaggacaagaagaagaaggacaagaagaagaagtag

SEQ ID NO: 78794 - DNA, 1197 bp, Artificial Sequence
  Description of Artificial Sequence: Synthetic coding sequence
atgatgctgaagggcatcaccagactgatcagcagaatccacaagctggaccccggcagattcctgcacatgggcacccaggccagacagagcatcgccgcccacctggacaaccaggtgcccgtggagagccccagagccatcagcagaaccaacgagaacgaccccgccaagcacggcgaccagcacgagggccagcactacaacatcagcccccaggacctggagaccgtgttcccccacggcctgccccccagattcgtgatgcaggtgaagaccttcagcgaggcctgcctgatggtgagaaagcccgccctggagctgctgcactacctgaagaacaccagcttcgcctaccccgccatcagatacctgctgtacggcgagaagggcaccggcaagaccctgagcctgtgccacgtgatccacttctgcgccaagcaggactggctgatcctgcacatccccgacgcccacctgtgggtgaagaactgcagagacctgctgcagagcagctacaacaagcagagattcgaccagcccctggaggccagcacctggctgaagaacttcaagaccaccaacgagagattcctgaaccagatcaaggtgcaggagaagtacgtgtggaacaagagagagagcaccgagaagggcagccccctgggcgaggtggtggagcagggcatcaccagagtgagaaacgccaccgacgccgtgggcatcgtgctgaaggagctgaagagacagagcagcctgggcatgttccacctgctggtggccgtggacggcatcaacgccctgtggggcagaaccaccctgaagagagaggacaagagccccatcgcccccgaggagctggccctggtgcacaacctgagaaagatgatgaagaacgactggcacggcggcgccatcgtgagcgccctgagccagaccggcagcctgttcaagcccagaaaggcctacctgccccaggagctgctgggcaaggagggcttcgacgccctggaccccttcatccccatcctggtgagcaactacaaccccaaggagttcgagagctgcatccagtactacctggagaacaactggctgcagcacgagaaggcccccaccgaggagggcaagaaggagctgctgttcctgagcaacgccaaccccagcctgctggagagacactgcgcctacctgtag

SEQ ID NO: 78795 - DNA, 1197 bp, Artificial Sequence; identical to SEQ ID NO: 78794
  Description of Artificial Sequence: Synthetic coding sequence

SEQ ID NO: 78796 - DNA, 1095 bp, Artificial Sequence
  Description of Artificial Sequence: Synthetic coding sequence
atgatgctgaagggcatcaccagactgatcagcagaatccacaagctggaccccggcagattcctgcacatgggcacccaggccagacagagcatcgccgcccacctggacaaccaggtgcccgtggagagccccagagccatcagcagaaccaacgagaacgaccccgtgaagaccttcagcgaggcctgcctgatggtgagaaagcccgccctggagctgctgcactacctgaagaacaccagcttcgcctaccccgccatcagatacctgctgtacggcgagaagggcaccggcaagaccctgagcctgtgccacgtgatccacttctgcgccaagcaggactggctgatcctgcacatccccgacgcccacctgtgggtgaagaactgcagagacctgctgcagagcagctacaacaagcagagattcgaccagcccctggaggccagcacctggctgaagaacttcaagaccaccaacgagagattcctgaaccagatcaaggtgcaggagaagtacgtgtggaacaagagagagagcaccgagaagggcagccccctgggcgaggtggtggagcagggcatcaccagagtgagaaacgccaccgacgccgtgggcatcgtgctgaaggagctgaagagacagagcagcctgggcatgttccacctgctggtggccgtggacggcatcaacgccctgtggggcagaaccaccctgaagagagaggacaagagccccatcgcccccgaggagctggccctggtgcacaacctgagaaagatgatgaagaacgactggcacggcggcgccatcgtgagcgccctgagccagaccggcagcctgttcaagcccagaaaggcctacctgccccaggagctgctgggcaaggagggcttcgacgccctggaccccttcatccccatcctggtgagcaactacaaccccaaggagttcgagagctgcatccagtactacctggagaacaactggctgcagcacgagaaggcccccaccgaggagggcaagaaggagctgctgttcctgagcaacgccaaccccagcctgctggagagacactgcgcctacctgtag

SEQ ID NO: 78797 - DNA, 1074 bp, Artificial Sequence
  Description of Artificial Sequence: Synthetic coding sequence
atgatgctgaagggcatcaccagactgatcagcagaatccacaaggccaagcacggcgaccagcacgagggccagcactacaacatcagcccccaggacctggagaccgtgttcccccacggcctgccccccagattcgtgatgcaggtgaagaccttcagcgaggcctgcctgatggtgagaaagcccgccctggagctgctgcactacctgaagaacaccagcttcgcctaccccgccatcagatacctgctgtacggcgagaagggcaccggcaagaccctgagcctgtgccacgtgatccacttctgcgccaagcaggactggctgatcctgcacatccccgacgcccacctgtgggtgaagaactgcagagacctgctgcagagcagctacaacaagcagagattcgaccagcccctggaggccagcacctggctgaagaacttcaagaccaccaacgagagattcctgaaccagatcaaggtgcaggagaagtacgtgtggaacaagagagagagcaccgagaagggcagccccctgggcgaggtggtggagcagggcatcaccagagtgagaaacgccaccgacgccgtgggcatcgtgctgaaggagctgaagagacagagcagcctgggcatgttccacctgctggtggccgtggacggcatcaacgccctgtggggcagaaccaccctgaagagagaggacaagagccccatcgcccccgaggagctggccctggtgcacaacctgagaaagatgatgaagaacgactggcacggcggcgccatcgtgagcgccctgagccagaccggcagcctgttcaagcccagaaaggcctacctgccccaggagctgctgggcaaggagggcttcgacgccctggaccccttcatccccatcctggtgagcaactacaaccccaaggagttcgagagctgcatccagtactacctggagaacaactggctgcagcacgagaaggcccccaccgaggagggcaagaaggagctgctgttcctgagcaacgccaaccccagcctgctggagagacactgcgcctacctgtag

SEQ ID NO: 78798 - DNA, 1047 bp, Artificial Sequence
  Description of Artificial Sequence: Synthetic coding sequence
atggccggcctgaagagaagagccagccaggtgtggcccgaggagcacggcgagcaggagcacggcctgtacagcctgcacagaatgttcgacatcgtgggcacccacctgacccacagagacgtgagagtgctgagcttcctgttcgtggacgtgatcgacgaccacgagagaggcctgatcagaaacggcagagacttcctgctggccctggagagacagggcagatgcgacgagagcaacttcagacaggtgctgcagctgctgagaatcatcaccagacacgacctgctgccctacgtgaccctgaagagaagaagagccgtgtgccccgacctggtggacaagtacctggaggagaccagcatcagatacgtgacccccagagccctgagcgaccccgagcccagacccccccagcccagcaagaccgtgcccccccactaccccgtggtgtgctgccccaccagcggcccccagatgtgcagcaagagacccgccagaggcagagccaccctgggcagccagagaaagagaagaaagagcgtgacccccgaccccaaggagaagcagacctgcggcgaggaggtgcagggcttccagagatggagcagactggagggcgagtacaaggagctgctgggccactgggccgtgtacgccatccagtacatcagactgagagtgagagccgagtactgccagcacgagaccgccctgcagggcaacgtgttcagcaacaagcaggaccccctggagagacagttcgagagattcaaccaggccaacaccatcctgaagagcagagacctgggcagcatcatctgcgacatcaagttcagcgagctgacctacctggacgccttctggagagactacatcaacggcagcctgctggaggccctgaagggcgtgttcatcaccgacagcctgaagcaggccgtgggccacgaggccatcaagctgctggtgaacgtggacgaggaggactacgagctgggcagacagaagctgctgagaaacctgatgctgcaggccctgccctag

SEQ ID NO: 78799 - DNA, 957 bp, Artificial Sequence
  Description of Artificial Sequence: Synthetic coding sequence
atggccggcctgaagagaagagccagccaggtgtggcccgaggagcacggcgagcaggagcacggcctgtacagcctgcacagaatgttcgacatcgtgggcacccacctgacccacagagacgtgagagtgctgagcttcctgttcgtggacgtgatcgacgaccacgagagaggcctgatcagaaacggcagagacttcctgctggccctggagagacagggcagatgcgacgagagcaacttcagacaggtgctgcagctgctgagaatcatcaccagacacgacctgctgccctacgtgaccctgaagagaagaagagccgtgtgccccgacctggtggacaagtacctggaggagaccagcatcagatacgtgacccccagagccctgagcgaccccgagcccagacccccccagcccagcaagaccgtgcccccccactaccccgtggtgtgctgccccaccagcggcccccagatgtgcagcaagagacccgccagaggcagagccaccctgggcagccagagaaagagaagaaagagcgtgacccccgaccccaaggagaagcagacctgcgacatcagactgagagtgagagccgagtactgccagcacgagaccgccctgcagggcaacgtgttcagcaacaagcaggaccccctggagagacagttcgagagattcaaccaggccaacaccatcctgaagagcagagacctgggcagcatcatctgcgacatcaagttcagcgagctgacctacctggacgccttctggagagactacatcaacggcagcctgctggaggccctgaagggcgtgttcatcaccgacagcctgaagcaggccgtgggccacgaggccatcaagctgctggtgaacgtggacgaggaggactacgagctgggcagacagaagctgctgagaaacctgatgctgcaggccctgccctag

SEQ ID NO: 78800 - DNA, 1047 bp, Artificial Sequence; identical to SEQ ID NO: 78798
  Description of Artificial Sequence: Synthetic coding sequence

SEQ ID NO: 78801 - DNA, 957 bp, Artificial Sequence; identical to SEQ ID NO: 78799
  Description of Artificial Sequence: Synthetic coding sequence

SEQ ID NO: 78802 - DNA, 828 bp, Artificial Sequence
  Description of Artificial Sequence: Synthetic coding sequence
atggccggcctgaagagaagagccagccaggtgtggcccgaggagcacggcgagcaggagcacggcctgtacagcctgcacagaatgttcgacatcgtgggcacccacctgacccacagagacgtgctgcagctgctgagaatcatcaccagacacgacctgctgccctacgtgaccctgaagagaagaagagccgtgtgccccgacctggtggacaagtacctggaggagaccagcatcagatacgtgacccccagagccctgagcgaccccgagcccagacccccccagcccagcaagaccgtgcccccccactaccccgtggtgtgctgccccaccagcggcccccagatgtgcagcaagagacccgccagaggcagagccaccctgggcagccagagaaagagaagaaagagcgtgacccccgaccccaaggagaagcagacctgcgacatcagactgagagtgagagccgagtactgccagcacgagaccgccctgcagggcaacgtgttcagcaacaagcaggaccccctggagagacagttcgagagattcaaccaggccaacaccatcctgaagagcagagacctgggcagcatcatctgcgacatcaagttcagcgagctgacctacctggacgccttctggagagactacatcaacggcagcctgctggaggccctgaagggcgtgttcatcaccgacagcctgaagcaggccgtgggccacgaggccatcaagctgctggtgaacgtggacgaggaggactacgagctgggcagacagaagctgctgagaaacctgatgctgcaggccctgccctag

SEQ ID NO: 78803 - DNA, 957 bp, Artificial Sequence; identical to SEQ ID NO: 78799
  Description of Artificial Sequence: Synthetic coding sequence

SEQ ID NO: 78804 - DNA, 957 bp, Artificial Sequence; identical to SEQ ID NO: 78799
  Description of Artificial Sequence: Synthetic coding sequence

SEQ ID NO: 78805 - DNA, 1917 bp, Artificial Sequence
  Description of Artificial Sequence: Synthetic coding sequence
atggacctgtggcagctgctgctgaccctggccctggccggcagcagcgacgccttcagcggcagcgaggccaccgccgccatcctgagcagagccccctggagcctgcagagcgtgaaccccggcctgaagaccaacagcagcaaggagcccaagttcaccaagtgcagaagccccgagagagagaccttcagctgccactggaccgacgaggtgcaccacggcaccaagaacctgggccccatccagctgttctacaccagaagaaacacccaggagtggacccaggagtggaaggagtgccccgactacgtgagcgccggcgagaacagctgctacttcaacagcagcttcaccagcatctggatcccctactgcatcaagctgaccagcaacggcggcaccgtggacgagaagtgcttcagcgtggacgagatcgtgcagcccgacccccccatcgccctgaactggaccctgctgaacgtgagcctgaccggcatccacgccgacatccaggtgagatgggaggcccccagaaacgccgacatccagaagggctggatggtgctggagtacgagctgcagtacaaggaggtgaacgagaccaagtggaagatgatggaccccatcctgaccaccagcgtgcccgtgtacagcctgaaggtggacaaggagtacgaggtgagagtgagaagcaagcagagaaacagcggcaactacggcgagttcagcgaggtgctgtacgtgaccctgccccagatgagccagttcacctgcgaggaggacttctacttcccctggctgctgatcatcatcttcggcatcttcggcctgaccgtgatgctgttcgtgttcctgttcagcaagcagcagagaatcaagatgctgatcctgccccccgtgcccgtgcccaagatcaagggcatcgaccccgacctgctgaaggagggcaagctggaggaggtgaacaccatcctggccatccacgacagctacaagcccgagttccacagcgacgacagctgggtggagttcatcgagctggacatcgacgagcccgacgagaagaccgaggagagcgacaccgacagactgctgagcagcgaccacgagaagagccacagcaacctgggcgtgaaggacggcgacagcggcagaaccagctgctgcgagcccgacatcctggagaccgacttcaacgccaacgacatccacgagggcaccagcgaggtggcccagccccagagactgaagggcgaggccgacctgctgtgcctggaccagaagaaccagaacaacagcccctaccacgacgcctgccccgccacccagcagcccagcgtgatccaggccgagaagaacaagccccagcccctgcccaccgagggcgccgagagcacccaccaggccgcccacatccagctgagcaaccccagcagcctgagcaacatcgacttctacgcccaggtgagcgacatcacccccgccggcagcgtggtgctgagccccggccagaagaacaaggccggcatgagccagtgcgacatgcaccccgagatggtgagcctgtgccaggagaacttcctgatggacaacgcctacttctgcgaggccgacgccaagaagtgcatccccgtggccccccacatcaaggtggagagccacatccagcccagcctgaaccaggaggacatctacatcaccaccgagagcctgaccaccgccgccggcagacccggcaccggcgagcacgtgcccggcagcgagatgcccgtgcccgactacaccagcatccacatcgtgcagagcccccagggcctgatcctgaacgccaccgccctgcccctgcccgacaaggagttcctgagcagctgcggctacgtgagcaccgaccagctgaacaagatcatgccctag

SEQ ID NO: 78806 - DNA, 1113 bp, Artificial Sequence
  Description of Artificial Sequence: Synthetic coding sequence
atgttccaggccagcatgagaagccccaacatggagcccttcaagcagcagaaggtggaggacttctacgacatcggcgaggagctgggcagcggccagttcgccatcgtgaagaagtgcagagagaagagcaccggcctggagtacgccgccaagttcatcaagaagagacagagcagagccagcagaagaggcgtgagcagagaggagatcgagagagaggtgagcatcctgagacaggtgctgcaccacaacgtgatcaccctgcacgacgtgtacgagaacagaaccgacgtggtgctgatcctggagctggtgagcggcggcgagctgttcgacttcctggcccagaaggagagcctgagcgaggaggaggccaccagcttcatcaagcagatcctggacggcgtgaactacctgcacaccaagaagatcgcccacttcgacctgaagcccgagaacatcatgctgctggacaagaacatccccatcccccacatcaagctgatcgacttcggcctggcccacgagatcgaggacggcgtggagttcaagaacatcttcggcacccccgagttcgtggcccccgagatcgtgaactacgagcccctgggcctggaggccgacatgtggagcatcggcgtgatcacctacatcctgctgagcggcgccagccccttcctgggcgacaccaagcaggagaccctggccaacatcaccgccgtgagctacgacttcgacgaggagttcttcagccagaccagcgagctggccaaggacttcatcagaaagctgctggtgaaggagaccagaaagagactgaccatccaggaggccctgagacacccctggatcacccccgtggacaaccagcaggccatggtgagaagagagagcgtggtgaacctggagaacttcagaaagcagtacgtgagaagaagatggaagctgagcttcagcatcgtgagcctgtgcaaccacctgaccagaagcctgatgaagaaggtgcacctgagacccgacgaggacctgagaaactgcgagagcgacaccgaggaggacatcgccagaagaaaggccctgcaccccagaagaagaagcagcaccagctag

SEQ ID NO: 78807 - DNA, 1113 bp, Artificial Sequence; identical to SEQ ID NO: 78806
  Description of Artificial Sequence: Synthetic coding sequence

SEQ ID NO: 78808 - DNA, 246 bp, Artificial Sequence
  Description of Artificial Sequence: Synthetic coding sequence
atgttccaggccagcatgagaagccccaacatggagcccttcaagcagcagaaggtggaggacttctacgacatcggcgaggagctgggcagcggccagttcgccatcgtgaagaagtgcagagagaagagcaccggcctggagtacgccgccaagttcatcaagaagagacagagcagagccagcagaagaggcgtgagcagagaggagatcgagagagaggtgagcatcctgagacaggtgtag

SEQ ID NO: 78809 - DNA, 2223 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagaggcagcagcagcagcggcggcaagaagtgctacaagctggagaacgagaagctgttcgaggagttcctggagctgtgcaagatgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtgcaccgtgctgaaggcccacagcgccaagaagaagctgaacctggcccccgccgccaccaccagcaacgagcccagcggcaacaacccccccacccacctgagcctggaccccaccaacgccgagaacaccgccagccagagccccagaaccagaggcagcagaagacagatccagagactggagcagctgctggccctgtacgtggccgagatcagaagactgcaggagaaggagctggacctgagcgagctggacgaccccgacagcgcctacctgcaggaggccagactgaagagaaagctgatcagactgttcggcagactgtgcgagctgaaggactgcagcagcctgaccggcagagtgatcgagcagagaatcccctacagaggcaccagataccccgaggtgaacagaagaatcgagagactgatcaacaagcccggccccgacaccttccccgactacggcgacgtgctgagagccgtggagaaggccgccgccagacacagcctgggcctgcccagacagcagctgcagctgatggcccaggacgccttcagagacgtgggcatcagactgcaggagagaagacacctggacctgatctacaacttcggctgccacctgaccgacgactacagacccggcgtggaccccgccctgagcgaccccgtgctggccagaagactgagagagaacagaagcctggccatgagcagactggacgaggtgatcagcaagtacgccatgctgcaggacaagagcgaggagggcgagagaaagaagagaagagccagactgcagggcaccagcagccacagcgccgacacccccgaggccagcctggacagcggcgagggccccagcggcatggccagccagggctgccccagcgccagcagagccgagaccgacgacgaggacgacgaggagagcgacgaggaggaggaggaggaggaggaggaggaggaggaggaggccaccgacagcgaggaggaggaggacctggagcagatgcaggagggccaggaggacgacgaggaggaggacgaggaggaggaggccgccgccggcaaggacggcgacaagagccccatgagcagcctgcagatcagcaacgagaagaacctggagcccggcaagcagatcagcagaagcagcggcgagcagcagaacaagggcagaatcgtgagccccagcctgctgagcgaggagcccctggcccccagcagcatcgacgccgagagcaacggcgagcagcccgaggagctgaccctggaggaggagagccccgtgagccagctgttcgagctggagatcgaggccctgcccctggacacccccagcagcgtggagaccgacatcagcagcagcagaaagcagagcgaggagcccttcaccaccgtgctggagaacggcgccggcatggtgagcagcaccagcttcaacggcggcgtgagcccccacaactggggcgacagcggccccccctgcaagaagagcagaaaggagaagaagcagaccggcagcggccccctgggcaacagctacgtggagagacagagaagcgtgcacgagaagaacggcaagaagatctgcaccctgcccagcccccccagccccctggccagcctggcccccgtggccgacagcagcaccagagtggacagccccagccacggcctggtgaccagcagcctgtgcatccccagccccgccagactgagccagaccccccacagccagccccccagacccggcacctgcaagaccagcgtggccacccagtgcgaccccgaggagatcatcgtgctgagcgacagcgactag

SEQ ID NO: 78810 - DNA, 2223 bp, Artificial Sequence; identical to SEQ ID NO: 78809
  Description of Artificial Sequence: Synthetic coding sequence

SEQ ID NO: 78811 - DNA, 2223 bp, Artificial Sequence; identical to SEQ ID NO: 78809
  Description of Artificial Sequence: Synthetic coding sequence

SEQ ID NO: 78812 - DNA, 2223 bp, Artificial Sequence; identical to SEQ ID NO: 78809
  Description of Artificial Sequence: Synthetic coding sequence

SEQ ID NO: 78813 - DNA, 393 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagaggcagcagcagcagcggcggcaagaagtgctacaagctggagaacgagaagctgttcgaggagttcctggagctgtgcaagatgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtag

SEQ ID NO: 78814 - DNA, 147 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagatag

SEQ ID NO: 78815 - DNA, 393 bp, Artificial Sequence; identical to SEQ ID NO: 78813
  Description of Artificial Sequence: Synthetic coding sequence

SEQ ID NO: 78816 - DNA, 147 bp, Artificial Sequence; identical to SEQ ID NO: 78814
  Description of Artificial Sequence: Synthetic coding sequence

SEQ ID NO: 78817 - DNA, 537 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagaggcagcagcagcagcggcggcaagaagtgctacaagctggagaacgagaagctgttcgaggagttcctggagctgtgcaagatgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtgcaccgtgctgaaggcccacagcgccaagaagaagctgaacctggcccccgccgccaccaccagcaacgagcccagcggcaacaacccccccacccacctgagcctggaccccaccaacgccgagaacaccgccagccagagctag

SEQ ID NO: 78818 - DNA, 537 bp, Artificial Sequence; identical to SEQ ID NO: 78817
  Description of Artificial Sequence: Synthetic coding sequence

SEQ ID NO: 78819 - DNA, 2223 bp, Artificial Sequence; identical to SEQ ID NO: 78809
  Description of Artificial Sequence: Synthetic coding sequence

SEQ ID NO: 78820 - DNA, 2223 bp, Artificial Sequence; identical to SEQ ID NO: 78809
  Description of Artificial Sequence: Synthetic coding sequence

SEQ ID NO: 78821 - DNA, 393 bp, Artificial Sequence; identical to SEQ ID NO: 78813
  Description of Artificial Sequence: Synthetic coding sequence

SEQ ID NO: 78822 - DNA, 537 bp, Artificial Sequence; identical to SEQ ID NO: 78817
  Description of Artificial Sequence: Synthetic coding sequence

SEQ ID NO: 78823 - DNA, 2223 bp, Artificial Sequence; identical to SEQ ID NO: 78809
  Description of Artificial Sequence: Synthetic coding sequence

SEQ ID NO: 78824 - DNA, 147 bp, Artificial Sequence; identical to SEQ ID NO: 78814
  Description of Artificial Sequence: Synthetic coding sequence

SEQ ID NO: 78825 - DNA, 393 bp, Artificial Sequence; identical to SEQ ID NO: 78813
  Description of Artificial Sequence: Synthetic coding sequence

SEQ ID NO: 78826 - DNA, 537 bp, Artificial Sequence; identical to SEQ ID NO: 78817
  Description of Artificial Sequence: Synthetic coding sequence

SEQ ID NO: 78827 - DNA, 2223 bp, Artificial Sequence; identical to SEQ ID NO: 78809
  Description of Artificial Sequence: Synthetic coding sequence

SEQ ID NO: 78828 - DNA, 147 bp, Artificial Sequence; identical to SEQ ID NO: 78814
  Description of Artificial Sequence: Synthetic coding sequence

SEQ ID NO: 78829 - DNA, 1998 bp, Artificial Sequence
  Description of Artificial Sequence: Synthetic coding sequence
atgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtgcaccgtgctgaaggcccacagcgccaagaagaagctgaacctggcccccgccgccaccaccagcaacgagcccagcggcaacaacccccccacccacctgagcctggaccccaccaacgccgagaacaccgccagccagagccccagaaccagaggcagcagaagacagatccagagactggagcagctgctggccctgtacgtggccgagatcagaagactgcaggagaaggagctggacctgagcgagctggacgaccccgacagcgcctacctgcaggaggccagactgaagagaaagctgatcagactgttcggcagactgtgcgagctgaaggactgcagcagcctgaccggcagagtgatcgagcagagaatcccctacagaggcaccagataccccgaggtgaacagaagaatcgagagactgatcaacaagcccggccccgacaccttccccgactacggcgacgtgctgagagccgtggagaaggccgccgccagacacagcctgggcctgcccagacagcagctgcagctgatggcccaggacgccttcagagacgtgggcatcagactgcaggagagaagacacctggacctgatctacaacttcggctgccacctgaccgacgactacagacccggcgtggaccccgccctgagcgaccccgtgctggccagaagactgagagagaacagaagcctggccatgagcagactggacgaggtgatcagcaagtacgccatgctgcaggacaagagcgaggagggcgagagaaagaagagaagagccagactgcagggcaccagcagccacagcgccgacacccccgaggccagcctggacagcggcgagggccccagcggcatggccagccagggctgccccagcgccagcagagccgagaccgacgacgaggacgacgaggagagcgacgaggaggaggaggaggaggaggaggaggaggaggaggaggccaccgacagcgaggaggaggaggacctggagcagatgcaggagggccaggaggacgacgaggaggaggacgaggaggaggaggccgccgccggcaaggacggcgacaagagccccatgagcagcctgcagatcagcaacgagaagaacctggagcccggcaagcagatcagcagaagcagcggcgagcagcagaacaagggcagaatcgtgagccccagcctgctgagcgaggagcccctggcccccagcagcatcgacgccgagagcaacggcgagcagcccgaggagctgaccctggaggaggagagccccgtgagccagctgttcgagctggagatcgaggccctgcccctggacacccccagcagcgtggagaccgacatcagcagcagcagaaagcagagcgaggagcccttcaccaccgtgctggagaacggcgccggcatggtgagcagcaccagcttcaacggcggcgtgagcccccacaactggggcgacagcggccccccctgcaagaagagcagaaaggagaagaagcagaccggcagcggccccctgggcaacagctacgtggagagacagagaagcgtgcacgagaagaacggcaagaagatctgcaccctgcccagcccccccagccccctggccagcctggcccccgtggccgacagcagcaccagagtggacagccccagccacggcctggtgaccagcagcctgtgcatccccagccccgccagactgagccagaccccccacagccagccccccagacccggcacctgcaagaccagcgtggccacccagtgcgaccccgaggagatcatcgtgctgagcgacagcgactag

SEQ ID NO: 78830 - DNA, 1998 bp, Artificial Sequence; identical to SEQ ID NO: 78829
  Description of Artificial Sequence: Synthetic coding sequence

SEQ ID NO: 78831 - DNA, 1998 bp, Artificial Sequence; identical to SEQ ID NO: 78829
  Description of Artificial Sequence: Synthetic coding sequence

SEQ ID NO: 78832 - DNA, 1998 bp, Artificial Sequence; identical to SEQ ID NO: 78829
  Description of Artificial Sequence: Synthetic coding sequence

SEQ ID NO: 78833 - DNA, 1080 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggcctggacaaggtgcccaaggacctgccccccgacaccaccctgctggacctgcagaacaacaagatcaccgagatcaaggacggcgacttcaagaacctgaagaacctgcacgccctgatcctggtgaacaacaagatcagcaaggtgagccccggcgccttcacccccctggtgaagctggagagactgtacctgagcaagaaccagctgaaggagctgcccgagaagatgcccaagaccctgcaggagctgagagcccacgagaacgagatcaccaaggtgagaaaggtgaccttcaacggcctgaaccagatgatcgtgatcgagctgggcaccaaccccctgaagagcagcggcatcgagaacggcgccttccagggcatgaagaagctgagctacatcagaatcgccgacaccaacatcaccagcatcccccagggcctgccccccagcctgaccgagctgcacctggacggcaacaagatcagcagagtggacgccgccagcctgaagggcctgaacaacctggccaagctgggcctgagcttcaacagcatcagcgccgtggacaacggcagcctggccaacaccccccacctgagagagctgcacctggacaacaacaagctgaccagagtgcccggcggcctggccgagcacaagtacatccaggtggtgtacctgcacaacaacaacatcagcgtggtgggcagcagcgacttctgcccccccggccacaacaccaagaaggccagctacagcggcgtgagcctgttcagcaaccccgtgcagtactgggagatccagcccagcaccttcagatgcgtgtacgtgagaagcgccatccagctgggcaactacaagtag

SEQ ID NO: 78834 - DNA, 7092 bp, Artificial Sequence
  Description of Artificial Sequence: Synthetic coding sequence
atgcccgtgctgggcgtggccagcaagctgagacagcccgccgtgggcagcaagcccgtgcacaccgccctgcccatccccaacctgggcaccaccggcagccagcactgcagcagcagacccctggagctgaccgagaccgagagcagcatgctgagctgccagctggccctgaagagcacctgcgagttcggcgagaagaagcccctgcagggcaaggccaaggagaaggaggacagcaagatctacaccgactgggccaaccactacctggccaagagcggccacaagagactgatcaaggacctgcagcaggacatcgccgacggcgtgctgctggccgagatcatccagatcatcgccaacgagaaggtggaggacatcaacggctgccccagaagccagagccagatgatcgagaacgtggacgtgtgcctgagcttcctggccgccagaggcgtgaacgtgcagggcctgagcgccgaggagatcagaaacggcaacctgaaggccatcctgggcctgttcttcagcctgagcagatacaagcagcagcagcaccaccagcagcagtactaccagagcctggtggagctgcagcagagagtgacccacgccagcccccccagcgaggccagccaggccaagacccagcaggacatgcagagcagcctggccgccagatacgccacccagagcaaccacagcggcatcgccaccagccagaagaagcccaccagactgcccggccccagcagagtgcccgccgccggcagcagcagcaaggtgcagggcgccagcaacctgaacagaagaagccagagcttcaacagcatcgacaagaacaagccccccaactacgccaacggcaacgagaaggacagcagcaagggcccccagagcagcagcggcgtgaacggcaacgtgcagccccccagcaccgccggccagccccccgccagcgccatccccagccccagcgccagcaagccctggagaagcaagagcatgaacgtgaagcacagcgccaccagcaccatgctgaccgtgaagcagagcagcaccgccaccagccccacccccagcagcgacagactgaagccccccgtgagcgagggcgtgaagaccgcccccagcggccagaagagcatgctggagaagttcaagctggtgaacgccagaaccgccctgagacccccccagccccccagcagcggccccagcgacggcggcaaggacgacgacgccttcagcgagagcggcgagatggagggcttcaacagcggcctgaacagcggcggcagcaccaacagcagccccaaggtgagccccaagctggccccccccaaggccggcagcaagaacctgagcaacaagaagagcctgctgcagcccaaggagaaggaggagaagaacagagacaagaacaaggtgtgcaccgagaagcccgtgaaggaggagaaggaccaggtgaccgagatggcccccaagaagaccagcaagatcgccagcctgatccccaagggcagcaagaccaccgccgccaagaaggagagcctgatccccagcagcagcggcatccccaagcccggcagcaaggtgcccaccgtgaagcagaccatcagccccggcagcaccgccagcaaggagagcgagaagttcagaaccaccaagggcagccccagccagagcctgagcaagcccatcaccatggagaaggccagcgccagcagctgccccgcccccctggagggcagagaggccggccaggccagccccagcggcagctgcaccatgaccgtggcccagagcagcggccagagcaccggcaacggcgccgtgcagctgccccagcagcagcagcacagccaccccaacaccgccaccgtggcccccttcatctacagagcccacagcgagaacgagggcaccgccctgcccagcgccgacagctgcaccagccccaccaagatggacctgagctacagcaagaccgccaagcagtgcctggaggagatcagcggcgaggaccccgagaccagaagaatgagaaccgtgaagaacatcgccgacctgagacagaacctggaggagaccatgagcagcctgagaggcacccagatcagccacagcaccctggagaccaccttcgacagcaccgtgaccaccgaggtgaacggcagaaccatccccaacctgaccagcagacccacccccatgacctggagactgggccaggcctgccccagactgcaggccggcgacgcccccagcctgggcgccggctaccccagaagcggcaccagcagattcatccacaccgaccccagcagattcatgtacaccacccccctgagaagagccgccgtgagcagactgggcaacatgagccagatcgacatgagcgagaaggccagcagcgacctggacatgagcagcgaggtggacgtgggcggctacatgagcgacggcgacatcctgggcaagagcctgagaaccgacgacatcaacagcggctacatgaccgacggcggcctgaacctgtacaccagaagcctgaacagaatccccgacaccgccaccagcagagacatcatccagagaggcgtgcacgacgtgaccgtggacgccgacagctgggacgacagcagcagcgtgagcagcggcctgagcgacaccctggacaacatcagcaccgacgacctgaacaccaccagcagcgtgagcagctacagcaacatcaccgtgcccagcagaaagaacacccagctgagaaccgacagcgagaagagaagcaccaccgacgagacctgggacagccccgaggagctgaagaagcccgaggaggacttcgacagccacggcgacgccggcggcaagtggaagaccgtgagcagcggcctgcccgaggaccccgagaaggccggccagaaggccagcctgagcgtgagccagaccggcagctggagaagaggcatgagcgcccagggcggcgcccccagcagacagaaggccggcaccagcgccctgaagacccccggcaagaccgacgacgccaaggccagcgagaagggcaaggcccccctgaagggcagcagcctgcagagaagccccagcgacgccggcaagagcagcggcgacgagggcaagaagccccccagcggcatcggcagaagcaccgccaccagcagcttcggcttcaagaagcccagcggcgtgggcagcagcgccatgatcaccagcagcggcgccaccatcaccagcggcagcgccaccctgggcaagatccccaagagcgccgccatcggcggcaagagcaacgccggcagaaagaccagcctggacggcagccagaaccaggacgacgtggtgctgcacgtgagcagcaagaccaccctgcagtacagaagcctgcccagacccagcaagagcagcaccagcggcatccccggcagaggcggccacagaagcagcaccagcagcatcgacagcaacgtgagcagcaagagcgccggcgccaccaccagcaagctgagagagcccaccaagatcggcagcggcagaagcagccccgtgaccgtgaaccagaccgacaaggagaaggagaaggtggccgtgagcgacagcgagagcgtgagcctgagcggcagccccaagagcagccccaccagcgccagcgcctgcggcgcccagggcctgagacagcccggcagcaagtaccccgacatcgccagccccaccttcagaagactgttcggcgccaaggccggcggcaagagcgccagcgcccccaacaccgagggcgtgaagagcagcagcgtgatgcccagccccagcaccaccctggccagacagggcagcctggagagccccagcagcggcaccggcagcatgggcagcgccggcggcctgagcggcagcagcagccccctgttcaacaagcccagcgacctgaccaccgacgtgatcagcctgagccacagcctggccagcagccccgccagcgtgcacagcttcaccagcggcggcctggtgtgggccgccaacatgagcagcagcagcgccggcagcaaggacacccccagctaccagagcatgaccagcctgcacaccagcagcgagagcatcgacctgcccctgagccaccacggcagcctgagcggcctgaccaccggcacccacgaggtgcagagcctgctgatgagaaccggcagcgtgagaagcaccctgagcgagagcatgcagctggacagaaacaccctgcccaagaagggcctgagatacacccccagcagcagacaggccaaccaggaggagggcaaggagtggctgagaagccacagcaccggcggcctgcaggacaccggcaaccagagccccctggtgagccccagcgccatgagcagcagcgccgccggcaagtaccacttcagcaacctggtgagccccaccaacctgagccagttcaacctgcccggccccagcatgatgagaagcaacagcatccccgcccaggacagcagcttcgacctgtacgacgacagccagctgtgcggcagcgccaccagcctggaggagagacccagagccatcagccacagcggcagcttcagagacagcatggaggaggtgcacggcagcagcctgagcctggtgagcagcaccagcagcctgtacagcaccgccgaggccggcggcagcctggagcagatccacaagctgagaagagagctggtggccagccaggagaaggtggccaccctgaccagccagctgagcgccaacgcccacctggtggccgccttcgagaagagcctgggcaacatgaccggcagactgcagagcctgaccatgaccgccgagcagaaggagagcgagctgatcgagctgagagagaccatcgagatgctgaaggcccagaacagcgccgcccaggccgccatccagggcgccctgaacggccccgaccacccccccaaggacctgagaatcagaagacagcacagcagcgagagcgtgagcagcatcaacagcgccaccagccacagcagcatcggcagcggcaacgacgccgacagcaagaagaagaagaagaagaactgggtgaacagcagaggcagcgagctgagaagcagcttcaagcaggccttcggcaagaagaagagcaccaagccccccagcagccacagcgacatcgaggagctgaccgacagcagcctgcccgccagccccaagctgccccacaacgccggcgactgcggcagcgccagcatgaagcccagccagagcgccagcgccatctgcgagtgcaccgaggccgaggccgagatcatcctgcagctgaagagcgagctgagagagaaggagctgaagctgaccgacatcagactggaggccctgagcagcgcccaccacctggaccagatcagagaggccatgaacagaatgcagaacgagatcgagatcctgaaggccgagaacgacagactgaaggccgagaccggcaacaccgccaagcccaccagaccccccagcgagagcagcagcagcaccagcagcagcagcagcagacagagcctgggcctgagcctgaacaacctgaacatcaccgaggccgtgagcagcgacatcctgctggacgacgccggcgacgccaccggccacaaggacggcagaagcgtgaagatcatcgtgagcatcagcaagggctacggcagagccaaggaccagaagagccaggcctacctgatcggcagcatcggcgtgagcggcaagaccaagtgggacgtgctggacggcgtgatcagaagactgttcaaggagtacgtgttcagaatcgacaccagcaccagcctgggcctgagcagcgactgcatcgccagctactgcatcggcgacctgatcagaagccacaacctggaggtgcccgagctgctgccctgcggctacctggtgggcgacaacaacatcatcaccgtgaacctgaagggcgtggaggagaacagcctggacagcttcgtgttcgacaccctgatccccaagcccatcacccagagatacttcaacctgctgatggagcaccacagaatcatcctgagcggccccagcggcaccggcaagacctacctggccaacaagctggccgagtacgtgatcaccaagagcggcagaaagaagaccgaggacgccatcgccaccttcaacgtggaccacaagagcagcaaggagctgcagcagtacctggccaacctggccgagcagtgcagcgccgacaacaacggcgtggagctgcccgtggtgatcatcctggacaacctgcaccacgtgggcagcctgagcgacatcttcaacggcttcctgaactgcaagtacaacaagtgcccctacatcatcggcaccatgaaccagggcgtgagcagcagccccaacctggagctgcaccacaacttcagatgggtgctgtgcgccaaccacaccgagcccgtgaagggcttcctgggcagatacctgagaagaaagctgatcgagatcgagatcgagagaaacatcagaaacaacgacctggtgaagatcatcgactggatccccaagacctggcaccacctgaacagcttcctggagacccacagcagcagcgacgtgaccatcggccccagactgttcctgccctgccccatggacgtggagggcagcagagtgtggttcatggacctgtggaactacagcctggtgccctacatcctggaggccgtgagagagggcctgcagatgtacggcaagagaaccccctgggaggaccccagcaagtgggtgctggacacctacccctggagcagcgccaccctgccccaggagagccccgccctgctgcagctgagacccgaggacgtgggctacgagagctgcaccagcaccaaggaggccaccaccagcaagcacatcccccagaccgacaccgagggcgaccccctgatgaacatgctgatgaagctgcaggaggccgccaactacagcagcacccagagctgcgacagcgagagcaccagccaccacgaggacatcctggacagcagcctggagagcaccctgtag

SEQ ID NO: 78835 - DNA, 519 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggcctggacaaggtgcccaaggacctgccccccgacaccaccctgctggacctgcagaacaacaagatcaccgagatcaaggacggcgacttcaagaacctgaagaacctgcacgtggtgtacctgcacaacaacaacatcagcgtggtgggcagcagcgacttctgcccccccggccacaacaccaagaaggccagctacagcggcgtgagcctgttcagcaaccccgtgcagtactgggagatccagcccagcaccttcagatgcgtgtacgtgagaagcgccatccagctgggcaactacaagtag

SEQ ID NO: 78836 - DNA, 1080 bp, Artificial Sequence; identical to SEQ ID NO: 78833
  Description of Artificial Sequence: Synthetic coding sequence

SEQ ID NO: 78837 - DNA, 753 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctggagctgggcaccaaccccctgaagagcagcggcatcgagaacggcgccttccagggcatgaagaagctgagctacatcagaatcgccgacaccaacatcaccagcatcccccagggcctgccccccagcctgaccgagctgcacctggacggcaacaagatcagcagagtggacgccgccagcctgaagggcctgaacaacctggccaagctgggcctgagcttcaacagcatcagcgccgtggacaacggcagcctggccaacaccccccacctgagagagctgcacctggacaacaacaagctgaccagagtgcccggcggcctggccgagcacaagtacatccaggtggtgtacctgcacaacaacaacatcagcgtggtgggcagcagcgacttctgcccccccggccacaacaccaagaaggccagctacagcggcgtgagcctgttcagcaaccccgtgcagtactgggagatccagcccagcaccttcagatgcgtgtacgtgagaagcgccatccagctgggcaactacaagtag

SEQ ID NO: 78838 - DNA, 639 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggcctgccccccagcctgaccgagctgcacctggacggcaacaagatcagcagagtggacgccgccagcctgaagggcctgaacaacctggccaagctgggcctgagcttcaacagcatcagcgccgtggacaacggcagcctggccaacaccccccacctgagagagctgcacctggacaacaacaagctgaccagagtgcccggcggcctggccgagcacaagtacatccaggtggtgtacctgcacaacaacaacatcagcgtggtgggcagcagcgacttctgcccccccggccacaacaccaagaaggccagctacagcggcgtgagcctgttcagcaaccccgtgcagtactgggagatccagcccagcaccttcagatgcgtgtacgtgagaagcgccatccagctgggcaactacaagtag

SEQ ID NO: 78839 - DNA, 519 bp, Artificial Sequence; identical to SEQ ID NO: 78835
  Description of Artificial Sequence: Synthetic coding sequence

SEQ ID NO: 78840 - DNA, 228 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggctgcctgcccagctag

SEQ ID NO: 78841 - DNA, 639 bp, Artificial Sequence; identical to SEQ ID NO: 78838
  Description of Artificial Sequence: Synthetic coding sequence

SEQ ID NO: 78842 - DNA, 540 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggcctggacaaggtgcccaaggacctgccccccgacaccaccctgctggacctgcagaacaacaagatcaccgagatcaaggacggcgacttcaagaacctgaagaacctgcacgccctgatcctggtgaacaacaagatcagcaaggtgagccccggcgccttcacccccctggtgaagctggagagactgtacctgagcaagaaccagctgaaggagctgcccgagaagatgcccaagaccctgcaggagctgagagcccacgagaacgagatcaccaaggtgagaaaggtgaccttcaacggcctgaaccagatgatcgtgatctag

SEQ ID NO: 78843 - DNA, 360 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggcctggacaaggtgcccaaggacctgccccccgacaccaccctgctggacctgcagaacaacaagatcaccgagatcaaggacggcgacttcaagaacctgaagaacctgcacgccctgatcctggtgaacaacaagatcagcaagtag

SEQ ID NO: 78844 - DNA, 525 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggcctggacaaggtgcccaaggacctgccccccgacaccaccctgctggacctgcagaacaacaagatcaccgagatcaaggacggcgacttcaagaacctgaagaacctgcacgccctgatcctggtgaacaacaagatcagcaaggtgagccccggcgccttcacccccctggtgaagctggagagactgtacctgagcaagaaccagctgaaggagctgcccgagaagatgcccaagaccctgcaggagctgagagcccacgagaacgagatcaccaaggtgagaaaggtgaccttcaacggcctgaactag

SEQ ID NO: 78845 - DNA, 537 bp, Artificial Sequence
  Description of Artificial Sequence: Synthetic coding sequence
atgaaggccaccatcatcctgctgctgctggcccaggtgagctgggccggccccttccagcagagaggcctgttcgacttcatgctggaggacgaggccagcggcatcggccccgaggtgcccgacgacagagacttcgagcccagcctgggccccgtgtgccccttcagatgccagtgccacctgagagtggtgcagtgcagcgacctgggcctggacaaggtgcccaaggacctgccccccgacaccaccctgctggacctgcagaacaacaagatcaccgagatcaaggacggcgacttcaagaacctgaagaacctgcacgccctgatcctggtgaacaacaagatcagcaaggtgagccccggcgccttcacccccctggtgaagctggagagactgtacctgagcaagaaccagctgaaggagctgcccgagaagatgcccaagaccctgcaggagctgagagcccacgagaacgagatcaccaaggtgagaaaggtgaccttcaacggcctgaaccagatgatcgtgtag

SEQ ID NO: 78846 - DNA, 1080 bp, Artificial Sequence; identical to SEQ ID NO: 78833
  Description of Artificial Sequence: Synthetic coding sequence

SEQ ID NO: 78847 - DNA, 5598 bp, Artificial Sequence
  Description of Artificial Sequence: Synthetic coding sequence
atgaccagatgggtgcccaccaagagagaggagaagtacggcgtggccttctacaactacgacgccagaggcgccgacgagctgagcctgcagatcggcgacaccgtgcacatcctggagacctacgagggctggtacagaggctacaccctgagaaagaagagcaagaagggcatcttccccgccagctacatccacctgaaggaggccatcgtggagggcaagggccagcacgagaccgtgatccccggcgacctgcccctgatccaggaggtgaccaccaccctgagagagtggagcaccatctggagacagctgtacgtgcaggacaacagagagatgttcagaagcgtgagacacatgatctacgacctgatcgagtggagaagccagatcctgagcggcaccctgccccaggacgagctgaaggagctgaagaagaaggtgaccgccaagatcgactacggcaacagaatcctggacctggacctggtggtgagagacgaggacggcaacatcctggaccccgagctgaccagcaccatcagcctgttcagagcccacgagatcgccagcaagcaggtggaggagagactgcaggaggagaagagccagaagcagaacatcgacatcaacagacaggccaagttcgccgccacccccagcctggccctgttcgtgaacctgaagaacgtggtgtgcaagatcggcgaggacgccgaggtgctgatgagcctgtacgaccccgtggagagcaagttcatcagcgagaactacctggtgagatggagcagcagcggcctgcccaaggacatcgacagactgcacaacctgagagccgtgttcaccgacctgggcagcaaggacctgaagagagagaagatcagcttcgtgtgccagatcgtgagagtgggcagaatggagctgagagacaacaacaccagaaagctgaccagcggcctgagaagacccttcggcgtggccgtgatggacgtgaccgacatcatcaacggcaaggtggacgacgaggacaagcagcacttcatccccttccagcccgtggccggcgagaacgacttcctgcagaccgtgatcaacaaggtgatcgccgccaaggaggtgaaccacaagggccagggcctgtgggtgaccctgaagctgctgcccggcgacatccaccagatcagaaaggagttcccccacctggtggacagaaccaccgccgtggccagaaagaccggcttccccgagatcatcatgcccggcgacgtgagaaacgacatctacgtgaccctggtgcagggcgacttcgacaagggcagcaagaccaccgccaagaacgtggaggtgaccgtgagcgtgtacgacgaggacggcaagagactggagcacgtgatcttccccggcgccggcgacgaggccatcagcgagtacaagagcgtgatctactaccaggtgaagcagcccagatggttcgagaccgtgaaggtggccatccccatcgaggacgtgaacagaagccacctgagattcaccttcagacacagaagcagccaggacagcaaggacaagagcgagaagatcttcgccctggccttcgtgaagctgatgagatacgacggcaccaccctgagagacggcgagcacgacctgatcgtgtacaaggccgaggccaagaagctggaggacgccgccacctacctgagcctgcccagcaccaaggccgagctggaggagaagggccacagcgccaccggcaagagcatgcagagcctgggcagctgcaccatcagcaaggacagcttccagatcagcaccctggtgtgcagcaccaagctgacccagaacgtggacctgctgggcctgctgaagtggagaagcaacaccagcctgctgcagcagaacctgagacagctgatgaaggtggacggcggcgaggtggtgaagttcctgcaggacaccctggacgccctgttcaacatcatgatggagaacagcgagagcgagaccttcgacaccctggtgttcgacgccctggtgttcatcatcggcctgatcgccgacagaaagttccagcacttcaaccccgtgctggagacctacatcaagaagcacttcagcgccaccctggcctacaccaagctgaccaaggtgctgaagaactacgtggacggcgccgagaagcccggcgtgaacgagcagctgtacaaggccatgaaggccctggagagcatcttcaagttcatcgtgagaagcagaatcctgttcaaccagctgtacgagaacaagggcgaggccgacttcgtggagagcctgctgcagctgttcagaagcatcaacgacatgatgagcagcatgagcgaccagaccgtgagagtgaagggcgccgccctgaagtacctgcccaccatcgtgaacgacgtgaagctggtgttcgaccccaaggagctgagcaagatgttcaccgagttcatcctgaacgtgcccatgggcctgctgaccatccagaagctgtactgcctgatcgagatcgtgcacagcgacctgttcacccagcacgactgcagagagatcctgctgcccatgatgaccgaccagctgaagtaccacctggagagacaggaggacctggaggcctgctgccagctgctgagccacatcctggaggtgctgtacagaaaggacgtgggccccacccagagacacgtgcagatcatcatggagaagctgctgagaaccgtgaacagaaccgtgatcagcatgggcagagacagcgagctgatcggcaacttcgtggcctgcatgaccgccatcctgagacagatggaggactaccactacgcccacctgatcaagaccttcggcaagatgagaaccgacgtggtggacttcctgatggagaccttcatcatgttcaagaacctgatcggcaagaacgtgtaccccttcgactgggtgatcatgaacatggtgcagaacaaggtgttcctgagagccatcaaccagtacgccgacatgctgaacaagaagttcctggaccaggccaacttcgagctgcagctgtggaacaactacttccacctggccgtggccttcctgacccaggagagcctgcagctggagaacttcagcagcgccaagagagccaagatcctgaacaagtacggcgacatgagaagacagatcggcttcgagatcagagacatgtggtacaacctgggccagcacaagatcaagttcatccccgagatggtgggccccatcctggagatgaccctgatccccgagaccgagctgagaaaggccaccatccccatcttcttcgacatgatgcagtgcgagttccacagcaccagaagcttccagatgttcgagaacgagatcatcaccaagctggaccacgaggtggagggcggcagaggcgacgagcagtacaaggtgctgttcgacaagatcctgctggagcactgcagaaagcacaagtacctggccaagaccggcgagaccttcgtgaagctggtggtgagactgatggagagactgctggactacagaaccatcatgcacgacgagaacaaggagaacagaatgagctgcaccgtgaacgtgctgaacttctacaaggagatcgagagagaggagatgtacatcagatacctgtacaagctgtgcgacctgcacaaggagtgcgacaactacaccgaggccgcctacaccctgctgctgcacgccaagctgctgaagtggagcgaggacgtgtgcgtggcccacctgacccagagagacggctaccaggccaccacccagggccagctgaaggagcagctgtaccaggagatcatccactacttcgacaagggcaagatgtgggaggaggccatcgccctgggcaaggagctggccgagcagtacgagaacgagatgttcgactacgagcagctgagcgagctgctgaagaagcaggcccagttctacgagaacatcgtgaaggtgatcagacccaagcccgactacttcgccgtgggctactacggccagggcttccccaccttcctgagaggcaaggtgttcatctacagaggcaaggagtacgagagaagagaggacttcgaggccagactgctgacccagttccccaacgccgagaagatgaagaccaccagcccccccggcgacgacatcaagaacagccccggccagtacatccagtgcttcaccgtgaagcccaagctggacctgccccccaagttccacagacccgtgagcgagcagatcgtgagcttctacagagtgaacgaggtgcagagattcgagtacagcagacccatcagaaagggcgagaagaaccccgacaacgagttcgccaacatgtggatcgagagaaccatctacaccaccgcctacaagctgcccggcatcctgagatggttcgaggtgaagagcgtgttcatggtggagatcagccccctggagaacgccatcgagaccatgcagctgaccaacgacaagatcaacagcatggtgcagcagcacctggacgaccccagcctgcccatcaaccccctgagcatgctgctgaacggcatcgtggaccccgccgtgatgggcggcttcgccaactacgagaaggccttcttcaccgacagatacctgcaggagcaccccgaggcccacgagaagatcgagaagctgaaggacctgatcgcctggcagatccccttcctggccgagggcatcagaatccacggcgacaaggtgaccgaggccctgagacccttccacgagagaatggaggcctgcttcaagcagctgaaggagaaggtggagaaggagtacggcgtgagaatcatgcccagcagcctggacgacagaagaggcagcagacccagaagcatggtgagaagcttcaccatgcccagcagcagcagacccctgagcgtggccagcgtgagcagcctgagcagcgacagcacccccagcagacccggcagcgacggcttcgccctggagcccctgctgcccaagaagatgcacagcagaagccaggacaagctggacaaggacgacctggagaaggagaagaaggacaagaagaaggagaagagaaacagcaagcaccaggagatcttcgagaaggagttcaagcccaccgacatcagcctgcagcagagcgaggccgtgatcctgagcgagaccatcagccccctgagaccccagagacccaagagccaggtgatgaacgtgatcggcagcgagagaagattcagcgtgagccccagcagccccagcagccagcagacccccccccccgtgacccccagagccaagctgagcttcagcatgcagagcagcctggagctgaacggcatgaccggcgccgacgtggccgacgtgcccccccccctgcccctgaagggcagcgtggccgactacggcaacctgatggagaaccaggacctgctgggcagccccacccccccccccccccccccccaccagagacacctgcccccccccctgcccagcaagaccccccccccccccccccccaagaccaccagaaagcaggccagcgtggacagcggcatcgtgcagtag

SEQ ID NO: 78848 - DNA, 6561 bp, Artificial Sequence
  Description of Artificial Sequence: Synthetic coding sequence
atggccggcgagagaaccagaagattcaccagaagcctgctgagacccggccaggccgccgagctgagacacagcgccgccagcgccgccgccgtggccgtgagcagcagacagcagcagagacaggagaagcccagactgctggagcccctggactacgagaccgtgatcgaggagctggagaagacctacagaaacgaccccctgcaggacctgctgttcttccccagcgacgacttcagcgccgccaccgtgagctgggacatcagaaccctgtacagcaccgtgcccgaggacgccgagcacaaggccgagaacctgctggtgaaggaggcctgcaagttctacagcagccagtggcacgtggtgaactacaagtacgagcagtacagcggcgacatcagacagctgcccagagccgagtacaagcccgagaagctgcccagccacagcttcgagatcgaccacgaggacgccgacaaggacgaggacaccaccagccacagcagcagcaagggcggcggcggcgccggcggcaccggcgtgttcaagagcggctggctgtacaagggcaacttcaacagcaccgtgaacaacaccgtgaccgtgagaagcttcaagaagagatacttccagctgacccagctgcccgacaacagctacatcatgaacttctacaaggacgagaagatcagcaaggagcccaagggctgcatcttcctggacagctgcaccggcgtggtgcagaacaacagactgagaaagtacgccttcgagctgaagatgaacgacctgacctacttcgtgctggccgccgagaccgagagcgacatggacgagtggatccacaccctgaacagaatcctgcagatcagccccgagggccccctgcagggcagaagaagcaccgagctgaccgacctgggcctggacagcctggacaacagcgtgacctgcgagtgcacccccgaggagaccgacagcagcgagaacaacctgcacgccgacttcgccaagtacctgaccgagaccgaggacaccgtgaagaccaccagaaacatggagagactgaacctgttcagcctggaccccgacatcgacaccctgaagctgcagaagaaggacctgctggagcccgagagcgtgatcaagcccttcgaggagaaggccgccaagagaatcatgatcatctgcaaggccctgaacagcaacctgcagggctgcgtgaccgagaacgagaacgaccccatcaccaacatcgagcccttcttcgtgagcgtggccctgtacgacctgagagacagcagaaagatcagcgccgacttccacgtggacctgaaccacgccgccgtgagacagatgctgctgggcgccagcgtggccctggagaacggcaacatcgacaccatcacccccagacagagcgaggagccccacatcaagggcctgcccgaggagtggctgaagttccccaagcaggccgtgttcagcgtgagcaacccccacagcgagatcgtgctggtggccaagatcgagaaggtgctgatgggcaacatcgccagcggcgccgagccctacatcaagaaccccgacagcaacaagtacgcccagaagatcctgaagagcaacagacagttctgcagcaagctgggcaagtacagaatgcccttcgcctgggccgtgagaagcgtgttcaaggacaaccagggcaacgtggacagagacagcagattcagccccctgttcagacaggagagcagcaagatcagcaccgaggacctggtgaagctggtgagcgactacagaagagccgacagaatcagcaagatgcagaccatccccggcagcctggacatcgccgtggacaacgtgcccctggagcaccccaactgcgtgaccagcagcttcatccccgtgaagcccttcaacatgatggcccagaccgagcccaccgtggaggtggaggagttcgtgtacgacagcaccaagtactgcagaccctacagagtgtacaagaaccagatctacatctaccccaagcacctgaagtacgacagccagaagtgcttcaacaaggccagaaacatcaccgtgtgcatcgagttcaagaacagcgacgaggagagcgccaagcccctgaagtgcatctacggcaagcccggcggccccctgttcaccagcgccgcctacaccgccgtgctgcaccacagccagaaccccgacttcagcgacgaggtgaagatcgagctgcccacccagctgcacgagaagcaccacatcctgttcagcttctaccacgtgacctgcgacatcaacgccaaggccaacgccaagaagaaggaggccctggagaccagcgtgggctacgcctggctgcccctgatgaagcacgaccagatcgccagccaggagtacaacatccccatcgccaccagcctgccccccaactacctgagcttccaggacagcgccagcggcaagcacggcggcagcgacatcaagtgggtggacggcggcaagcccctgttcaaggtgagcaccttcgtggtgagcaccgtgaacacccaggacccccacgtgaacgccttcttccaggagtgccagaagagagagaaggacatgagccagagccccaccagcaacttcatcagaagctgcaagaacctgctgaacgtggagaagatccacgccatcatgagcttcctgcccatcatcctgaaccagctgttcaaggtgctggtgcagaacgaggaggacgagatcaccaccaccgtgaccagagtgctgaccgacatcgtggccaagtgccacgaggagcagctggaccacagcgtgcagagctacatcaagttcgtgttcaagaccagagcctgcaaggagagaaccgtgcacgaggagctggccaagaacgtgaccggcctgctgaagagcaacgacagcaccaccgtgaagcacgtgctgaagcacagctggttcttcttcgccatcatcctgaagagcatggcccagcacctgatcgacaccaacaagatccagctgcccagaccccagagattccccgagagctaccagaacgagctggacaacctggtgatggtgctgagcgaccacgtgatctggaagtacaaggacgccctggaggagaccagaagagccaaccacagcgtggccagattcctgaagagatgcttcaccttcatggacagaggctacgtgttcaagatggtgaacaactacatcagcatgttcagcagcggcgacctgaagaccctgtgccagtacaagttcgacttcctgcaggaggtgtgccagcacgagcacttcatccccctgtgcctgcccatcagaagcgccaacatccccgaccccctgacccccagcgagagcacccaggagctgcacgccagcgacatgcccgagtacagcgtgaccaacgagttctgcagaaagcacttcctgatcggcatcctgctgagagaggtgggcttcgccctgcaggaggaccaggacgtgagacacctggccctggccgtgctgaagaacctgatggccaagcacagcttcgacgacagatacagagagcccagaaagcaggcccagatcgccagcctgtacatgcccctgtacggcatgctgctggacaacatgcccagaatctacctgaaggacctgtaccccttcaccgtgaacaccagcaaccagggcagcagagacgacctgagcaccaacggcggcttccagagccagaccgccatcaagcacgccaacagcgtggacaccagcttcagcaaggacgtgctgaacagcatcgccgccttcagcagcatcgccatcagcaccgtgaaccacgccgacagcagagccagcctggccagcctggacagcaaccccagcaccaacgagaagagcagcgagaagaccgacaactgcgagaagatccccagacccctgagcctgatcggcagcaccctgagattcgacaagctggaccaggccgagaccagaagcctgctgatgtgcttcctgcacatcatgaagaccatcagctacgagaccctgatcgcctactggcagagagcccccagccccgaggtgagcgacttcttcagcatcctggacgtgtgcctgcagaacttcagatacctgggcaagagaaacatcatcagaaagatcgccgccgccttcaagttcgtgcagagcacccagaacaacggcaccctgaagggcagcaaccccagctgccagaccagcggcctgctgagccagtggatgcacagcaccagcagccacgagggccacaagcagcacagaagccagaccctgcccatcatcagaggcaagaacgccctgagcaaccccaagctgctgcagatgctggacaacaccatgaccagcaacagcaacgagatcgacatcgtgcaccacgtggacaccgaggccaacatcgccaccgaggtgtgcctgaccatcctggacctgctgagcctgttcacccagacccaccagagacagctgcagcagtgcgactgccagaacagcctgatgaagagagtgttcgacacctacatgctgttcttccaggtgaaccagagcgccaccgccctgaagcacgtgttcgccagcctgagactgttcgtgtgcaagttccccagcgccttcttccagggccccgccgacctgtgcggcagcttctgctacgaggtgctgaagtgctgcaaccacagaagcagaagcacccagaccgaggccagcgccctgctgtacttcttcatgagaaagaacttcgagttcaacaagcagaagagcatcgtgagaagccacctgcagctgatcaaggccgtgagccagctgatcgccgacgccggcatcggcggcagcagattccagcacagcctggccatcaccaacaacttcgccaacggcgacaagcagatgaagaacagcaacttccccgccgaggtgaaggacctgaccaagagaatcagaaccgtgctgatggccaccgcccagatgaaggagcacgagaaggaccccgagatgctggtggacctgcagtacagcctggccaacagctacgccagcacccccgagctgagaagaacctggctggagagcatggccaagatccacgccagaaacggcgacctgagcgaggccgccatgtgctacatccacatcgccgccctgatcgccgagtacctgaagagaaagggctactggaaggtggagaagatctgcaccgccagcctgctgagcgaggacacccacccctgcgacagcaacagcctgctgaccacccccagcggcggcagcatgttcagcatgggctggcccgccttcctgagcatcacccccaacatcaaggaggagggcgccatgaaggaggacagcggcatgcaggacaccccctacaacgagaacatcctggtggagcagctgtacatgtgcgtggagttcctgtggaagagcgagagatacgagctgatcgccgacgtgaacaagcccatcatcgccgtgttcgagaagcagagagacttcaagaagctgagcgacctgtactacgacatccacagaagctacctgaaggtggccgaggtggtgaacagcgagaagagactgttcggcagatactacagagtggccttctacggccagggcttcttcgaggaggaggagggcaaggagtacatctacaaggagcccaagctgaccggcctgagcgagatcagccagagactgctgaagctgtacgccgacaagttcggcgccgacaacgtgaagatcatccaggacagcaacaaggtgaaccccaaggacctggaccccaagtacgcctacatccaggtgacctacgtgacccccttcttcgaggagaaggagatcgaggacagaaagaccgacttcgagatgcaccacaacatcaacagattcgtgttcgagacccccttcaccctgagcggcaagaagcacggcggcgtggccgagcagtgcaagagaagaaccatcctgaccaccagccacctgttcccctacgtgaagaagagaatccaggtgatcagccagagcagcaccgagctgaaccccatcgaggtggccatcgacgagatgagcaagaaggtgagcgagctgaaccagctgtgcaccatggaggaggtggacatgatcagactgcagctgaagctgcagggcagcgtgagcgtgaaggtgaacgccggccccatggcctacgccagagccttcctggaggagaccaacgccaagaagtaccccgacaaccaggtgaagctgctgaaggagatcttcagacagttcgccgacgcctgcggccaggccctggacgtgaacgagagactgatcaaggaggaccagctggagtaccaggaggagctgagaagccactacaaggacatgctgagcgagctgagcaccgtgatgaacgagcagatcaccggcagagacgacctgagcaagagaggcgtggaccagacctgcaccagagtgatcagcaaggccacccccgccctgcccaccgtgagcatcagcagcagcgccgaggtgtag

SEQ ID NO: 78849 - DNA, 2103 bp, Artificial Sequence
  Description of Artificial Sequence: Synthetic coding sequence
atgaccagcaacagcaacgagatcgacatcgtgcaccacgtggacaccgaggccaacatcgccaccgaggtgtgcctgaccatcctggacctgctgagcctgttcacccagacccaccagagacagctgcagcagtgcgactgccagaacagcctgatgaagagagtgttcgacacctacatgctgttcttccaggtgaaccagagcgccaccgccctgaagcacgtgttcgccagcctgagactgttcgtgtgcaagttccccagcgccttcttccagggccccgccgacctgtgcggcagcttctgctacgaggtgctgaagtgctgcaaccacagaagcagaagcacccagaccgaggccagcgccctgctgtacttcttcatgagaaagaacttcgagttcaacaagcagaagagcatcgtgagaagccacctgcagctgatcaaggccgtgagccagctgatcgccgacgccggcatcggcggcagcagattccagcacagcctggccatcaccaacaacttcgccaacggcgacaagcagatgaagaacagcaacttccccgccgaggtgaaggacctgaccaagagaatcagaaccgtgctgatggccaccgcccagatgaaggagcacgagaaggaccccgagatgctggtggacctgcagtacagcctggccaacagctacgccagcacccccgagctgagaagaacctggctggagagcatggccaagatccacgccagaaacggcgacctgagcgaggccgccatgtgctacatccacatcgccgccctgatcgccgagtacctgaagagaaagggcatgttcagcatgggctggcccgccttcctgagcatcacccccaacatcaaggaggagggcgccatgaaggaggacagcggcatgcaggacaccccctacaacgagaacatcctggtggagcagctgtacatgtgcgtggagttcctgtggaagagcgagagatacgagctgatcgccgacgtgaacaagcccatcatcgccgtgttcgagaagcagagagacttcaagaagctgagcgacctgtactacgacatccacagaagctacctgaaggtggccgaggtggtgaacagcgagaagagactgttcggcagatactacagagtggccttctacggccagggcgtgggcttcttcgaggaggaggagggcaaggagtacatctacaaggagcccaagctgaccggcctgagcgagatcagccagagactgctgaagctgtacgccgacaagttcggcgccgacaacgtgaagatcatccaggacagcaacaaggtgaaccccaaggacctggaccccaagtacgcctacatccaggtgacctacgtgacccccttcttcgaggagaaggagatcgaggacagaaagaccgacttcgagatgcaccacaacatcaacagattcgtgttcgagacccccttcaccctgagcggcaagaagcacggcggcgtggccgagcagtgcaagagaagaaccatcctgaccaccagccacctgttcccctacgtgaagaagagaatccaggtgatcagccagagcagcaccgagctgaaccccatcgaggtggccatcgacgagatgagcaagaaggtgagcgagctgaaccagctgtgcaccatggaggaggtggacatgatcagactgcagctgaagctgcagggcagcgtgagcgtgaaggtgaacgccggccccatggcctacgccagagccttcctggaggagaccaacgccaagaagtaccccgacaaccaggtgaagctgctgaaggagatcttcagacagttcgccgacgcctgcggccaggccctggacgtgaacgagagactgatcaaggaggaccagctggagtaccaggaggagctgagaagccactacaaggacatgctgagcgagctgagcaccgtgatgaacgagcagctgtgcagaggcccctgcctgtacagcttctgcagcagcgtgagcagcatcagcctgagcaccgtgagcaagagcgactacggccagggcagacccgtgaaggccagaagcggccccaacctgcacagcagcaactag

SEQ ID NO: 78850 - DNA, 6543 bp, Artificial Sequence
  Description of Artificial Sequence: Synthetic coding sequence
atgagcttcagaggcaaggtgttcaagagagagcccagcgagttctggaagaagagaagaaccgtgagaagagtgaaccaggaggagatccacagattcagcagccaggagaagcccagactgctggagcccctggactacgagaccgtgatcgaggagctggagaagacctacagaaacgaccccctgcaggacctgctgttcttccccagcgacgacttcagcgccgccaccgtgagctgggacatcagaaccctgtacagcaccgtgcccgaggacgccgagcacaaggccgagaacctgctggtgaaggaggcctgcaagttctacagcagccagtggcacgtggtgaactacaagtacgagcagtacagcggcgacatcagacagctgcccagagccgagtacaagcccgagaagctgcccagccacagcttcgagatcgaccacgaggacgccgacaaggacgaggacaccaccagccacagcagcagcaagggcggcggcggcgccggcggcaccggcgtgttcaagagcggctggctgtacaagggcaacttcaacagcaccgtgaacaacaccgtgaccgtgagaagcttcaagaagagatacttccagctgacccagctgcccgacaacagctacatcatgaacttctacaaggacgagaagatcagcaaggagcccaagggctgcatcttcctggacagctgcaccggcgtggtgcagaacaacagactgagaaagtacgccttcgagctgaagatgaacgacctgacctacttcgtgctggccgccgagaccgagagcgacatggacgagtggatccacaccctgaacagaatcctgcagatcagccccgagggccccctgcagggcagaagaagcaccgagctgaccgacctgggcctggacagcctggacaacagcgtgacctgcgagtgcacccccgaggagaccgacagcagcgagaacaacctgcacgccgacttcgccaagtacctgaccgagaccgaggacaccgtgaagaccaccagaaacatggagagactgaacctgttcagcctggaccccgacatcgacaccctgaagctgcagaagaaggacctgctggagcccgagagcgtgatcaagcccttcgaggagaaggccgccaagagaatcatgatcatctgcaaggccctgaacagcaacctgcagggctgcgtgaccgagaacgagaacgaccccatcaccaacatcgagcccttcttcgtgagcgtggccctgtacgacctgagagacagcagaaagatcagcgccgacttccacgtggacctgaaccacgccgccgtgagacagatgctgctgggcgccagcgtggccctggagaacggcaacatcgacaccatcacccccagacagagcgaggagccccacatcaagggcctgcccgaggagtggctgaagttccccaagcaggccgtgttcagcgtgagcaacccccacagcgagatcgtgctggtggccaagatcgagaaggtgctgatgggcaacatcgccagcggcgccgagccctacatcaagaaccccgacagcaacaagtacgcccagaagatcctgaagagcaacagacagttctgcagcaagctgggcaagtacagaatgcccttcgcctgggccgtgagaagcgtgttcaaggacaaccagggcaacgtggacagagacagcagattcagccccctgttcagacaggagagcagcaagatcagcaccgaggacctggtgaagctggtgagcgactacagaagagccgacagaatcagcaagatgcagaccatccccggcagcctggacatcgccgtggacaacgtgcccctggagcaccccaactgcgtgaccagcagcttcatccccgtgaagcccttcaacatgatggcccagaccgagcccaccgtggaggtggaggagttcgtgtacgacagcaccaagtactgcagaccctacagagtgtacaagaaccagatctacatctaccccaagcacctgaagtacgacagccagaagtgcttcaacaaggccagaaacatcaccgtgtgcatcgagttcaagaacagcgacgaggagagcgccaagcccctgaagtgcatctacggcaagcccggcggccccctgttcaccagcgccgcctacaccgccgtgctgcaccacagccagaaccccgacttcagcgacgaggtgaagatcgagctgcccacccagctgcacgagaagcaccacatcctgttcagcttctaccacgtgacctgcgacatcaacgccaaggccaacgccaagaagaaggaggccctggagaccagcgtgggctacgcctggctgcccctgatgaagcacgaccagatcgccagccaggagtacaacatccccatcgccaccagcctgccccccaactacctgagcttccaggacagcgccagcggcaagcacggcggcagcgacatcaagtgggtggacggcggcaagcccctgttcaaggtgagcaccttcgtggtgagcaccgtgaacacccaggacccccacgtgaacgccttcttccaggagtgccagaagagagagaaggacatgagccagagccccaccagcaacttcatcagaagctgcaagaacctgctgaacgtggagaagatccacgccatcatgagcttcctgcccatcatcctgaaccagctgttcaaggtgctggtgcagaacgaggaggacgagatcaccaccaccgtgaccagagtgctgaccgacatcgtggccaagtgccacgaggagcagctggaccacagcgtgcagagctacatcaagttcgtgttcaagaccagagcctgcaaggagagaaccgtgcacgaggagctggccaagaacgtgaccggcctgctgaagagcaacgacagcaccaccgtgaagcacgtgctgaagcacagctggttcttcttcgccatcatcctgaagagcatggcccagcacctgatcgacaccaacaagatccagctgcccagaccccagagattccccgagagctaccagaacgagctggacaacctggtgatggtgctgagcgaccacgtgatctggaagtacaaggacgccctggaggagaccagaagagccaaccacagcgtggccagattcctgaagagatgcttcaccttcatggacagaggctacgtgttcaagatggtgaacaactacatcagcatgttcagcagcggcgacctgaagaccctgtgccagtacaagttcgacttcctgcaggaggtgtgccagcacgagcacttcatccccctgtgcctgcccatcagaagcgccaacatccccgaccccctgacccccagcgagagcacccaggagctgcacgccagcgacatgcccgagtacagcgtgaccaacgagttctgcagaaagcacttcctgatcggcatcctgctgagagaggtgggcttcgccctgcaggaggaccaggacgtgagacacctggccctggccgtgctgaagaacctgatggccaagcacagcttcgacgacagatacagagagcccagaaagcaggcccagatcgccagcctgtacatgcccctgtacggcatgctgctggacaacatgcccagaatctacctgaaggacctgtaccccttcaccgtgaacaccagcaaccagggcagcagagacgacctgagcaccaacggcggcttccagagccagaccgccatcaagcacgccaacagcgtggacaccagcttcagcaaggacgtgctgaacagcatcgccgccttcagcagcatcgccatcagcaccgtgaaccacgccgacagcagagccagcctggccagcctggacagcaaccccagcaccaacgagaagagcagcgagaagaccgacaactgcgagaagatccccagacccctgagcctgatcggcagcaccctgagattcgacaagctggaccaggccgagaccagaagcctgctgatgtgcttcctgcacatcatgaagaccatcagctacgagaccctgatcgcctactggcagagagcccccagccccgaggtgagcgacttcttcagcatcctggacgtgtgcctgcagaacttcagatacctgggcaagagaaacatcatcagaaagatcgccgccgccttcaagttcgtgcagagcacccagaacaacggcaccctgaagggcagcaaccccagctgccagaccagcggcctgctgagccagtggatgcacagcaccagcagccacgagggccacaagcagcacagaagccagaccctgcccatcatcagaggcaagaacgccctgagcaaccccaagctgctgcagatgctggacaacaccatgaccagcaacagcaacgagatcgacatcgtgcaccacgtggacaccgaggccaacatcgccaccgaggtgtgcctgaccatcctggacctgctgagcctgttcacccagacccaccagagacagctgcagcagtgcgactgccagaacagcctgatgaagagagtgttcgacacctacatgctgttcttccaggtgaaccagagcgccaccgccctgaagcacgtgttcgccagcctgagactgttcgtgtgcaagttccccagcgccttcttccagggccccgccgacctgtgcggcagcttctgctacgaggtgctgaagtgctgcaaccacagaagcagaagcacccagaccgaggccagcgccctgctgtacttcttcatgagaaagaacttcgagttcaacaagcagaagagcatcgtgagaagccacctgcagctgatcaaggccgtgagccagctgatcgccgacgccggcatcggcggcagcagattccagcacagcctggccatcaccaacaacttcgccaacggcgacaagcagatgaagaacagcaacttccccgccgaggtgaaggacctgaccaagagaatcagaaccgtgctgatggccaccgcccagatgaaggagcacgagaaggaccccgagatgctggtggacctgcagtacagcctggccaacagctacgccagcacccccgagctgagaagaacctggctggagagcatggccaagatccacgccagaaacggcgacctgagcgaggccgccatgtgctacatccacatcgccgccctgatcgccgagtacctgaagagaaagggctactggaaggtggagaagatctgcaccgccagcctgctgagcgaggacacccacccctgcgacagcaacagcctgctgaccacccccagcggcggcagcatgttcagcatgggctggcccgccttcctgagcatcacccccaacatcaaggaggagggcgccatgaaggaggacagcggcatgcaggacaccccctacaacgagaacatcctggtggagcagctgtacatgtgcgtggagttcctgtggaagagcgagagatacgagctgatcgccgacgtgaacaagcccatcatcgccgtgttcgagaagcagagagacttcaagaagctgagcgacctgtactacgacatccacagaagctacctgaaggtggccgaggtggtgaacagcgagaagagactgttcggcagatactacagagtggccttctacggccagggcttcttcgaggaggaggagggcaaggagtacatctacaaggagcccaagctgaccggcctgagcgagatcagccagagactgctgaagctgtacgccgacaagttcggcgccgacaacgtgaagatcatccaggacagcaacaaggtgaaccccaaggacctggaccccaagtacgcctacatccaggtgacctacgtgacccccttcttcgaggagaaggagatcgaggacagaaagaccgacttcgagatgcaccacaacatcaacagattcgtgttcgagacccccttcaccctgagcggcaagaagcacggcggcgtggccgagcagtgcaagagaagaaccatcctgaccaccagccacctgttcccctacgtgaagaagagaatccaggtgatcagccagagcagcaccgagctgaaccccatcgaggtggccatcgacgagatgagcaagaaggtgagcgagctgaaccagctgtgcaccatggaggaggtggacatgatcagactgcagctgaagctgcagggcagcgtgagcgtgaaggtgaacgccggccccatggcctacgccagagccttcctggaggagaccaacgccaagaagtaccccgacaaccaggtgaagctgctgaaggagatcttcagacagttcgccgacgcctgcggccaggccctggacgtgaacgagagactgatcaaggaggaccagctggagtaccaggaggagctgagaagccactacaaggacatgctgagcgagctgagcaccgtgatgaacgagcagatcaccggcagagacgacctgagcaagagaggcgtggaccagacctgcaccagagtgatcagcaaggccacccccgccctgcccaccgtgagcatcagcagcagcgccgaggtgtag

SEQ ID NO: 78851 - DNA, 5493 bp, Artificial Sequence
  Description of Artificial Sequence: Synthetic coding sequence
atggccccctggagaaaggccgacaaggagagacacggcgtggccatctacaacttccagggcagcggcgccccccagctgagcctgcagatcggcgacgtggtgagaatccaggagacctgcggcgactggtacagaggctacctgatcaagcacaagatgctgcagggcatcttccccaagagcttcatccacatcaaggaggtgaccgtggagaagagaagaaacaccgagaacatcatccccgccgagatccccctggcccaggaggtgaccaccaccctgtgggagtggggcagcatctggaagcagctgtacgtggccagcaagaaggagagattcctgcaggtgcagagcatgatgtacgacctgatggagtggagaagccagctgctgagcggcaccctgcccaaggacgagctgaaggagctgaagcagaaggtgaccagcaagatcgactacggcaacaagatcctggagctggacctgatcgtgagagacgaggacggcaacatcctggaccccgacaacaccagcgtgatcagcctgttccacgcccacgaggaggccaccgacaagatcaccgagagaatcaaggaggagatgagcaaggaccagcccgactacgccatgtacagcagaatcagcagcagccccacccacagcctgtacgtgttcgtgagaaacttcgtgtgcagaatcggcgaggacgccgagctgttcatgagcctgtacgaccccaacaagcagaccgtgatcagcgagaactacctggtgagatggggcagcagaggcttccccaaggagatcgagatgctgaacaacctgaaggtggtgttcaccgacctgggcaacaaggacctgaacagagacaagatctacctgatctgccagatcgtgagagtgggcaagatggacctgaaggacaccggcgccaagaagtgcacccagggcctgagaagacccttcggcgtggccgtgatggacatcaccgacatcatcaagggcaaggccgagagcgacgaggagaagcagcacttcatccccttccaccccgtgaccgccgagaacgacttcctgcacagcctgctgggcaaggtgatcgccagcaagggcgacagcggcggccagggcctgtgggtgaccatgaagatgctggtgggcgacatcatccagatcagaaaggactacccccacctggtggacagaaccaccgtggtggccagaaagctgggcttccccgagatcatcatgcccggcgacgtgagaaacgacatctacatcaccctgctgcagggcgacttcgacaagtacaacaagaccacccagagaaacgtggaggtgatcatgtgcgtgtgcgccgaggacggcaagaccctgcccaacgccatctgcgtgggcgccggcgacaagcccatgaacgagtacagaagcgtggtgtactaccaggtgaagcagcccagatggatggagaccgtgaaggtggccgtgcccatcgaggacatgcagagaatccacctgagattcatgttcagacacagaagcagcctggagagcaaggacaagggcgagaagaacttcgccatgagctacgtgaagctgatgaaggaggacggcaccaccctgcacgacggcttccacgacctggtggtgctgaagggcgacagcaagaagatggaggacgccagcgcctacctgaccctgcccagctacagacaccacgtggagaacaagggcgccaccctgagcagaagcagcagcagcgtgggcggcctgagcgtgagcagcagagacgtgttcagcatcagcaccctggtgtgcagcaccaagctgacccagaacgtgggcctgctgggcctgctgaagtggagaatgaagccccagctgctgcaggagaacctggagaagctgaagatcgtggacggcgaggaggtggtgaagttcctgcaggacaccctggacgccctgttcaacatcatgatggagcacagccagagcgacgagtacgacatcctggtgttcgacgccctgatctacatcatcggcctgatcgccgacagaaagttccagcacttcaacaccgtgctggaggcctacatccagcagcacttcagcgccaccctggcctacaagaagctgatgaccgtgctgaagacctacctggacaccagcagcagaggcgagcagtgcgagcccatcctgagaaccctgaaggccctggagtacgtgttcaagttcatcgtgagaagcagaaccctgttcagccagctgtacgagggcaaggagcagatggagttcgaggagagcatgagaagactgttcgagagcatcaacaacctgatgaagagccagtacaagaccaccatcctgctgcaggtggccgccctgaagtacatccccagcgtgctgcacgacgtggagatggtgttcgacgccaagctgctgagccagctgctgtacgagttctacacctgcatcccccccgtgaagctgcagaagcagaaggtgcagagcatgaacgagatcgtgcagagcaacctgttcaagaagcaggagtgcagagacatcctgctgcccgtgatcaccaaggagctgaaggagctgctggagcagaaggacgacatgcagcaccaggtgctggagagaaagtactgcgtggagctgctgaacagcatcctggaggtgctgagctaccaggacgccgccttcacctaccaccacatccaggagatcatggtgcagctgctgagaaccgtgaacagaaccgtgatcaccatgggcagagaccacatcctgatcagccacttcgtggcctgcatgaccgccatcctgaaccagatgggcgaccagcactacagcttctacatcgagaccttccagaccagcagcgagctggtggacttcctgatggagaccttcatcatgttcaaggacctgatcggcaagaacgtgtaccccggcgactggatggccatgagcatggtgcagaacagagtgttcctgagagccatcaacaagttcgccgagaccatgaaccagaagttcctggagcacaccaacttcgagttccagctgtggaacaactacttccacctggccgtggccttcatcacccaggacagcctgcagctggagcagttcagccacgccaagtacaacaagatcctgaacaagtacggcgacatgagaagactgatcggcttcagcatcagagacatgtggtacaagctgggccagaacaagatctgcttcatccccggcatggtgggccccatcctggagatgaccctgatccccgaggccgagctgagaaaggccaccatccccatcttcttcgacatgatgctgtgcgagtaccagagaagcggcgacttcaagaagttcgagaacgagatcatcctgaagctggaccacgaggtggagggcggcagaggcgacgagcagtacatgcagctgctggagagcatcctgatggagtgcgccgccgagcaccccaccatcgccaagagcgtggagaacttcgtgaacctggtgaagggcctgctggagaagctgctggactacagaggcgtgatgaccgacgagagcaaggacaacagaatgagctgcaccgtgaacctgctgaacttctacaaggacaacaacagagaggagatgtacatcagatacctgtacaagctgagagacctgcacctggactgcgacaactacaccgaggccgcctacaccctgctgctgcacacctggctgctgaagtggagcgacgagcagtgcgccagccaggtgatgcagaccggccagcagcacccccagacccacagacagctgaaggagaccctgtacgagaccatcatcggctacttcgacaagggcaagatgtgggaggaggccatcagcctgtgcaaggagctggccgagcagtacgagatggagatcttcgactacgagctgctgagccagaacctgatccagcaggccaagttctacgagagcatcatgaagatcctgagacccaagcccgactacttcgccgtgggctactacggccagggcttccccagcttcctgagaaacaaggtgttcatctacagaggcaaggagtacgagagaagagaggacttccagatgcagctgatgacccagttccccaacgccgagaagatgaacaccaccagcgcccccggcgacgacgtgaagaacgcccccggccagtacatccagtgcttcaccgtgcagcccgtgctggacgagcaccccagattcaagaacaagcccgtgcccgaccagatcatcaacttctacaagagcaactacgtgcagagattccactacagcagacccgtgagaagaggcaccgtggaccccgagaacgagttcgccagcatgtggatcgagagaaccagcttcgtgaccgcctacaagctgcccggcatcctgagatggttcgaggtggtgcacatgagccagaccaccatcagccccctggagaacgccatcgagaccatgagcaccgccaacgagaagatcctgatgatgatcaaccagtaccagagcgacgagaccctgcccatcaaccccctgagcatgctgctgaacggcatcgtggaccccgccgtgatgggcggcttcgccaagtacgagaaggccttcttcaccgaggagtacgtgagagaccaccccgaggaccaggacaagctgacccacctgaaggacctgatcgcctggcagatccccttcctgggcgccggcatcaagatccacgagaagagagtgagcgacaacctgagacccttccacgacagaatggaggagtgcttcaagaacctgaagatgaaggtggagaaggagtacggcgtgagagagatgcccgacttcgacgacagaagagtgggcagacccagaagcatgctgagaagctacagacagatgagcatcatcagcctggccagcatgaacagcgactgcagcacccccagcaagcccaccagcgagagcttcgacctggagctggccagccccaagacccccagagtggagcaggaggagcccatcagccccggcagcaccctgcccgaggtgaagctgagaagaagcaagaagagaaccaagagaagcagcgtggtgttcgccgacgagaaggccgccgccgagagcgacctgaagagactgagcagaaagcacgagttcatgagcgacaccaacctgagcgagcacgccgccatccccctgaaggccagcgtgctgagccagatgagcttcgccagccagagcatgcccaccatccccgccctggccctgagcgtggccggcatccccggcctggacgaggccaacaccagccccagactgagccagaccttcctgcagctgagcgacggcgacaagaagaccctgaccagaaagaaggtgaaccagttcttcaagaccatgctggccagcaagagcgccgaggagggcaagcagatccccgacagcctgagcaccgacctgtag

SEQ ID NO: 78852 - DNA, 1011 bp, Artificial Sequence
  Description of Artificial Sequence: Synthetic coding sequence
atgtgcgtgtgcgccgaggacggcaagaccctgcccgtggccgtgcccatcgaggacatgcagagaatccacctgagattcatgttcagacacagaagcagcctggagagcaaggacaagggcgagaagaacttcgccatgagctacgtgaagctgatgaaggaggacggcaccaccctgcacgacggcttccacgacctggtggtgctgaagggcgacagcaagaagatggaggacgccagcgcctacctgaccctgcccagctacagacaccacgtggagaacaagggcgccaccctgagcagaagcagcagcagcgtgggcggcctgagcgtgagcagcagagacgtgttcagcatcagcaccctggtgtgcagcaccaagctgacccagaacgtgggcctgctgggcctgctgaagtggagaatgaagccccagctggaggagagcatgagaagactgttcgagagcatcaacaacctgatgaagagccagtacaagaccaccatcctgctgcaggtggccgccctgaagtacatccccagcgtgctgcacgacgtggagatggtgttcgacgccaagctgctgagccagctgctgtacgagttctacacctgcatcccccccgtgaagctgcagaagcagaaggtgcagagcatgaacgagatcgtgcagagcaacctgttcaagaagcaggagtgcagagacatcctgctgcccgtgatcaccaaggagctgaaggagctgctggagcagaaggacgacatgcagcaccaggtgctggagagaaagtactgcgtggagctgctgaacagcatcctggaggtgctgagctaccaggacgccgccttcacctaccaccacatccaggagatcatggtgcagctgctgagaaccgtgaacagaaccgtgatcaccatgggcagagaccacatcctgatcggcgcctgctgcaactgcggcttccccagcagcaccccccacagcctgatccagtggctgtggggctag

SEQ ID NO: 78853 - DNA, 2676 bp, Artificial Sequence
  Description of Artificial Sequence: Synthetic coding sequence
atgaccgccatcctgaaccagatgggcgaccagcactacagcttctacatcgagaccttccagaccagcagcgagctggtggacttcctgatggagaccttcatcatgttcaaggacctgatcggcaagaacgtgtaccccggcgactggatggccatgagcatggtgcagaacagagtgttcctgagagccatcaacaagttcgccgagaccatgaaccagaagttcctggagcacaccaacttcgagttccagctgtggaacaactacttccacctggccgtggccttcatcacccaggacagcctgcagctggagcagttcagccacgccaagtacaacaagatcctgaacaagtacggcgacatgagaagactgatcggcttcagcatcagagacatgtggtacaagctgggccagaacaagatctgcttcatccccggcatggtgggccccatcctggagatgaccctgatccccgaggccgagctgagaaaggccaccatccccatcttcttcgacatgatgctgtgcgagtaccagagaagcggcgacttcaagaagttcgagaacgagatcatcctgaagctggaccacgaggtggagggcggcagaggcgacgagcagtacatgcagctgctggagagcatcctgatggagtgcgccgccgagcaccccaccatcgccaagagcgtggagaacttcgtgaacctggtgaagggcctgctggagaagctgctggactacagaggcgtgatgaccgacgagagcaaggacaacagaatgagctgcaccgtgaacctgctgaacttctacaaggacaacaacagagaggagatgtacatcagatacctgtacaagctgagagacctgcacctggactgcgacaactacaccgaggccgcctacaccctgctgctgcacacctggctgctgaagtggagcgacgagcagtgcgccagccaggtgatgcagaccggccagcagcacccccagacccacagacagctgaaggagaccctgtacgagaccatcatcggctacttcgacaagggcaagatgtgggaggaggccatcagcctgtgcaaggagctggccgagcagtacgagatggagatcttcgactacgagctgctgagccagaacctgatccagcaggccaagttctacgagagcatcatgaagatcctgagacccaagcccgactacttcgccgtgggctactacggccagggcttccccagcttcctgagaaacaaggtgttcatctacagaggcaaggagtacgagagaagagaggacttccagatgcagctgatgacccagttccccaacgccgagaagatgaacaccaccagcgcccccggcgacgacgtgaagaacgcccccggccagtacatccagtgcttcaccgtgcagcccgtgctggacgagcaccccagattcaagaacaagcccgtgcccgaccagatcatcaacttctacaagagcaactacgtgcagagattccactacagcagacccgtgagaagaggcaccgtggaccccgagaacgagttcgccagcatgtggatcgagagaaccagcttcgtgaccgcctacaagctgcccggcatcctgagatggttcgaggtggtgcacatgagccagaccaccatcagccccctggagaacgccatcgagaccatgagcaccgccaacgagaagatcctgatgatgatcaaccagtaccagagcgacgagaccctgcccatcaaccccctgagcatgctgctgaacggcatcgtggaccccgccgtgatgggcggcttcgccaagtacgagaaggccttcttcaccgaggagtacgtgagagaccaccccgaggaccaggacaagctgacccacctgaaggacctgatcgcctggcagatccccttcctgggcgccggcatcaagatccacgagaagagagtgagcgacaacctgagacccttccacgacagaatggaggagtgcttcaagaacctgaagatgaaggtggagaaggagtacggcgtgagagagatgcccgacttcgacgacagaagagtgggcagacccagaagcatgctgagaagctacagacagatgagcatcatcagcctggccagcatgaacagcgactgcagcacccccagcaagcccaccagcgagagcttcgacctggagctggccagccccaagacccccagagtggagcaggaggagcccatcagccccggcagcaccctgcccgaggtgaagctgagaagaagcaagaagagaaccaagagaagcagcgtggtgttcgccgacgagaaggccgccgccgagagcgacctgaagagactgagcagaaagcacgagttcatgagcgacaccaacctgagcgagcacgccgccatccccctgaaggccagcgtgctgagccagatgagcttcgccagccagagcatgcccaccatccccgccctggccctgagcgtggccggcatccccggcctggacgaggccaacaccagccccagactgagccagaccttcctgcagctgagcgacggcgacaagaagaccctgaccagaaagaaggtgaaccagttcttcaagaccatgctggccagcaagagcgccgaggagggcaagcagatccccgacagcctgagcaccgacctgtag

SEQ ID NO: 78854 - DNA, 6093 bp, Artificial Sequence
  Description of Artificial Sequence: Synthetic coding sequence
atgtggacccccaccgaggaggagaagtacggcgtggtgatctgcagcttcagaggcagcgtgccccagggcctggtgctggagatcggcgagaccgtgcagatcctggagaagtgcgagggctggtacagaggcgtgagcaccaagaagcccaacgtgaagggcatcttccccgccaactacatccacctgaagaaggccatcgtgagcaacagaggccagtacgagaccgtggtgcccctggaggacagcatcgtgaccgaggtgaccgccaccctgcaggagtgggccagcctgtggaagcagctgtacgtgaagcacaaggtggacctgttctacaagctgagacacgtgatgaacgagctgatcgacctgagaagacagctgctgagcggccacctgacccaggaccaggtgagagaggtgaagagacacatcaccgtgagactggactggggcaacgagcacctgggcctggacctggtgcccagaaaggacttcgaggtggtggacagcgaccagatcagcgtgagcgacctgtacaagatgcacctgagcagcagacagagcgtgcagcagagcaccagccaggtggacaccatgagacccagacacggcgagacctgcagaatgcccgtgccccaccacttcttcctgagcctgaagagcttcacctacaacaccatcggcgaggacaccgacgtgttcttcagcctgtacgacatgagagagggcaagcagatcagcgagagattcctggtgagactgaacaagaacggcggccccagaaaccccgagaagatcgagagaatgtgcgccctgttcaccgacctgagcagcaaggacatgaagagagacctgtacatcgtggcccacgtgatcagaatcggcagaatgctgctgaacgacagcaagaagggccccccccacctgcactacagaagaccctacggctgcgccgtgctgagcatcctggacgtgctgcagagcctgaccgaggtgaaggaggagaaggacttcgtgctgaaggtgtacacctgcaacaacgagagcgagtggagccagatccacgagaacatcatcagaaagagcagcgccaagtacagcgcccccagcgccagccacggcctgatcatcagcctgcagctgctgagaggcgacatggagcagatcagaagagagaaccccatgatcttcaacagaggcctggccatcaccagaaagctgggcttccccgacgtgatcatgcccggcgacatcagaaacgacctgtacctgaccctggagaagggcgacttcgagagaggcggcaagagcgtgcagaagaacatcgaggtgaccatgtacgtgctgtacgccgacggcgagatcctgaaggactgcatcagcctgggcagcggcgagcccaacagaagcagctaccacagcttcgtgctgtaccacagcaacagccccagatggggcgagatcatcaagctgcccatccccatcgacagattcagaggcagccacctgagattcgagttcagacactgcagcaccaaggacaagggcgagaagaagctgttcggcttcgccttcagcaccctgatgagagacgacggcaccaccctgagcgacgacatccacgagctgtacgtgtacaagtgcgacgagaacagcaccttcaacaaccacgccctgtacctgggcctgccctgctgcaaggaggactacaacggctgccccaacatccccagcagcctgatcttccagagaagcaccaaggagagcttcttcatcagcacccagctgagcagcaccaagctgacccagaacgtggacctgctggccctgctgaagtggaaggccttccccgacagaatcatggacgtgctgggcagactgagacacgtgagcggcgaggagatcgtgaagttcctgcaggacatcctggacaccctgttcgtgatcctggacgacaacaccgagaagtacggcctgctggtgttccagagcctggtgttcatcatcaacctgctgagagacatcaagtacttccacttcagacccgtgatggacacctacatccagaagcacttcgccggcgccctggcctacaaggagctgatcagatgcctgaagtggtacatggactgcagcgccgagctgatcagacaggaccacatccaggaggccatgagagccctggagtacctgttcaagttcatcgtgcagagcagaatcctgtacagcagagccacctgcggcatggaggaggagcagttcagaagcagcatccaggagctgttccagagcatcagattcgtgctgagcctggacagcagaaacagcgagaccctgctgttcacccaggccgccctgctgaacagcttccccaccatcttcgacgagctgctgcagatgttcaccgtgcaggaggtggccgagttcgtgagaggcaccctgggcagcatgcccagcaccgtgcacatcggccagagcatggacgtggtgaagctgcagagcatcgccagaaccgtggacagcagactgttcagcttcagcgagagcagaagaatcctgctgcccgtggtgctgcaccacatccacctgcacctgagacagcagaaggagctgctgatctgcagcggcatcctgggcagcatcttcagcatcgtgaagaccagcagcctggaggccgacgtgatggaggaggtggagatgatggtggagagcctgctggacgtgctgctgcagaccctgctgaccatcatgagcaagagccacgcccaggaggccgtgagaggccagagatgcccccagtgcaccgccgagatcaccggcgagtacgtgagctgcctgctgagcctgctgagacagatgtgcgacacccacttccagcacctgctggacaacttccagagcaaggacgagctgaaggagttcctgctgaagatcttctgcgtgttcagaaacctgatgaagatgagcgtgttccccagagactggatggtgatgagactgctgaccagcaacatcatcgtgaccaccgtgcagtacctgagcagcgccctgcacaagaacttcaccgagaccgacttcgacttcaaggtgtggaacagctacttcagcctggccgtgctgttcatcaaccagcccagcctgcagctggagatcatcaccagcgccaagagaaagaagatcctggacaagtacggcgacatgagagtgatgatggcctacgagctgttcagcatgtggcagaacctgggcgagcacaagatccacttcatccccggcatgatcggccccttcctgggcgtgaccctggtgccccagcccgaggtgagaaacatcatgatccccatcttccacgacatgatggactgggagcagagaaagaacggcaacttcaagcaggtggaggccgagctgatcgacaagctggacagcatggtgagcgagggcaagggcgacgagagctacagagagctgttcagcctgctgacccagctgttcggcccctaccccagcctgctggagaaggtggagcaggagacctggagagagaccggcatcagcttcgtgaccagcgtgaccagactgatggagagactgctggactacagagactgcatgaagggcgaggagaccgagaacaagaagatcggctgcaccgtgaacctgatgaacttctacaagagcgagatcaacaaggaggagatgtacatcagatacatccacaagctgtgcgacatgcacctgcaggccgagaactacaccgaggccgccttcaccctgctgctgtactgcgagctgctgcagtgggaggacagacccctgagagagttcctgcactaccccagccagaccgagtggcagagaaaggagggcctgtgcagaaagatcatccactacttcaacaagggcaagagctgggagttcggcatccccctgtgcagagagctggcctgccagtacgagagcctgtacgactaccagagcctgagctggatcagaaagatggaggccagctactacgacaacatcatggagcagcagagactggagcccgagttcttcagagtgggcttctacggcagaaagttccccttcttcctgagaaacaaggagtacgtgtgcagaggccacgactacgagagactggaggccttccagcagagaatgctgagcgagttcccccaggccgtggccatgcagcaccccaaccaccccgacgacgccatcctgcagtgcgacgcccagtacctgcagatctacgccgtgacccccatccccgactacgtggacgtgctgcagatggacagagtgcccgacagagtgaagagcttctacagagtgaacaacgtgagaaagttcagatacgacagacccttccacaagggccccaaggacaaggagaacgagttcaagagcctgtggatcgagagaaccaccctgaccctgacccacagcctgcccggcatcagcagatggttcgaggtggagagaagagagctggtggaggtgagccccctggagaacgccatccaggtggtggagaacaagaaccaggagctgagaagcctgatcagccagtaccagcacaagcaggtgcacggcaacatcaacctgctgagcatgtgcctgaacggcgtgatcgacgccgccgtgaacggcggcatcgccagataccaggaggccttcttcgacaaggactacatcaacaagcaccccggcgacgccgagaagatcacccagctgaaggagctgatgcaggagcaggtgcacgtgctgggcgtgggcctggccgtgcacgagaagttcgtgcaccccgagatgagacccctgcacaagaagctgatcgaccagttccagatgatgagagccagcctgtaccacgagttccccggcctggacaagctgagccccgcctgcagcggcaccagcacccccagaggcaacgtgctggccagccacagccccatgagccccgagagcatcaagatgacccacagacacagccccatgaacctgatgggcaccggcagacacagcagcagcagcctgagcagccacgccagcagcgaggccggcaacatggtgatgctgggcgacggcagcatgggcgacgcccccgaggacctgtaccaccacatgcagctggcctaccccaaccccagataccagggcagcgtgaccaacgtgagcgtgctgagcagcagccaggccagccccagcagcagcagcctgagcagcacccacagcgcccccagccagatgatcaccagcgcccccagcagcgccagaggcagccccagcctgcccgacaagtacagacacgccagagagatgatgctgctgctgcccacctacagagacagacccagcagcgccatgtaccccgccgccatcctggagaacggccagccccccaacttccagagagccctgttccagcaggtggtgggcgcctgcaagccctgcagcgaccccaacctgagcgtggccgagaagggccactacagcctgcacttcgacgccttccaccaccccctgggcgacaccccccccgccctgcccgccagaaccctgagaaagagccccctgcaccccatccccgccagccccaccagcccccagagcggcctggacggcagcaacagcaccctgagcggcagcgccagcagcggcgtgagcagcctgagcgagagcaacttcggccacagcagcgaggccccccccagaaccgacaccatggacagcatgcccagccaggcctggaacgccgacgaggacctggagcccccctacctgcccgtgcactacagcctgagcgagagcgccgtgctggacagcatcaaggcccagccctgcagaagccacagcgcccccggctgcgtgatcccccaggaccccatggacccccccgccctgccccccaagccctaccaccccagactgcccgccctggagcacgacgagggcgtgctgctgagagaggagaccgagagacccagaggcctgcacagaaaggcccccctgccccccggcagcgccaaggaggagcaggccagaatggcctgggagcacggcagaggcgagcagtag

SEQ ID NO: 78855 - DNA, 1785 bp, Artificial Sequence
  Description of Artificial Sequence: Synthetic coding sequence
atgcccaagtggctggaggagaccgagaacaagaagatcggctgcaccgtgaacctgatgaacttctacaagagcgagatcaacaaggaggagatgtacatcagatacatccacaagctgtgcgacatgcacctgcaggccgagaactacaccgaggccgccttcaccctgctgctgtactgcgagctgctgcagtgggaggacagacccctgagagagttcctgcactaccccagccagaccgagtggcagagaaaggagggcctgtgcagaaagatcatccactacttcaacaagggcaagagctgggagttcggcatccccctgtgcagagagctggcctgccagtacgagagcctgtacgactaccagagcctgagctggatcagaaagatggaggccagctactacgacaacatcatggagcagcagagactggagcccgagttcttcagagtgggcttctacggcagaaagttccccttcttcctgagaaacaaggagtacgtgtgcagaggccacgactacgagagactggaggccttccagcagagaatgctgagcgagttcccccaggccgtggccatgcagcaccccaaccaccccgacgacgccatcctgcagtgcgacgcccagtacctgcagatctacgccgtgacccccatccccgactacgtggacgtgctgcagatggacagagtgcccgacagagtgaagagcttctacagagtgaacaacgtgagaaagttcagatacgacagacccttccacaagggccccaaggacaaggagaacgagttcaagagcctgtggatcgagagaaccaccctgaccctgacccacagcctgcccggcatcagcagatggttcgaggtggagagaagagagctggtggaggtgagccccctggagaacgccatccaggtggtggagaacaagaaccaggagctgagaagcctgatcagccagtaccagcacaagcaggtgcacggcaacatcaacctgctgagcatgtgcctgaacggcgtgatcgacgccgccgtgaacggcggcatcgccagataccaggaggccttcttcgacaaggactacatcaacaagcaccccggcgacgccgagaagatcacccagctgaaggagctgatgcaggagcaggtgcacgtgctgggcgtgggcctggccgtgcacgagaagttcgtgcaccccgagatgagacccctgcacaagaagctgatcgaccagttccagatgatgagagccagcctgtaccacgagttccccggcctggacaagctgagccccgcctgcagcggcaccagcacccccagaggcaacgtgctggccagccacagccccatgagccccgagagcatcaagatgacccacagacacagccccatgaacctgatgggcaccggcagacacagcagcagcagcctgagcagccacgccagcagcgaggccggcaacatggtgatgctgggcgacggcagcatgggcgacgcccccgaggacctgtaccaccacatgcagctggcctaccccaaccccagataccagggcagcgtgaccaacgtgagcgtgctgagcagcagccaggccagccccagcagcagcagcctgagcagcacccacagcgcccccagccagatgatcaccagcgcccccagcagcgccagaggcagccccagcctgcccgacaagtacagacacgccagagagatgatgctgctgctgcccacctacagagacagacccagcagcgccatgtaccccgccgcctag

SEQ ID NO: 78856 - DNA, 5778 bp, Artificial Sequence
  Description of Artificial Sequence: Synthetic coding sequence
gtgatcgccagcttcagaggcaccgtgccctacggcctgagcctggagatcggcgacaccgtgcagatcctggagaagtgcgacggctggtacagaggcttcgccctgaagaaccccaacatcaagggcatcttccccagcagctacgtgcacctgaagaacgcctgcgtgaagaacaagggccagttcgagatggtgatccccaccgaggacagcgtgatcaccgagatgaccagcaccctgagagactggggcaccatgtggaagcagctgtacgtgagaaacgagggcgacctgttccacagactgtggcacatcatgaacgagatcctggacctgagaagacaggtgctggtgggccacctgacccacgacagaatgaaggacgtgaagagacacatcaccgccagactggactggggcaacgagcagctgggcctggacctggtgcccagaaaggagtacgccatggtggaccccgaggacatcagcatcaccgagctgtacagactgatggagcacagacacagaaagaaggacacccccgtgcaggccagcagccaccacctgttcgtgcagatgaagagcctgatgtgcagcaacctgggcgaggagctggaggtgatcttcagcctgttcgacagcaaggagaacagacccatcagcgagagattcttcctgagactgaacagaaacggcctgcccaaggcccccgacaagcccgagagacactgcagcctgttcgtggacctgggcagcagcgagctgagaaaggacatctacatcaccgtgcacatcatcagaatcggcagaatgggcgccggcgagaagaagaacgcctgcagcgtgcagtacagaagacccttcggctgcgccgtgctgagcatcgccgacctgctgaccggcgagaccaaggacgacctgatcctgaaggtgtacatgtgcaacaccgagagcgagtggtaccagatccacgagaacatcatcaagaagctgaacgccagatacaacctgaccggcagcaacgccggcctggccgtgagcctgcagctgctgcacggcgacatcgagcagatcagaagagagtacagcagcgtgttcagccacggcgtgagcatcaccagaaagctgggcttcagcaacatcatcatgcccggcgagatgagaaacgacctgtacatcaccatcgagagaggcgagttcgagaagggcggcaagagcgtggccagaaacgtggaggtgaccatgttcatcgtggacagcagcggccagaccctgaaggacttcatcagcttcggcagcggcgagccccccgccagcgagtaccacagcttcgtgctgtaccacaacaacagccccagatggagcgagctgctgaagctgcccatccccgtggacaagttcagaggcgcccacatcagattcgagttcagacactgcagcaccaaggagaagggcgagaagaagctgttcggcttcagcttcgtgcccctgatgcaggaggacggcagaaccctgcccgacggcacccacgagctgatcgtgcacaagtgcgaggagaacaccaacctgcaggacaccaccagatacctgaagctgcccttcagcaagggcatcttcctgggcaacaacaaccaggccatgaaggccaccaaggagagcttctgcatcaccagcttcctgtgcagcaccaagctgacccagaacggcgacatgctggacctgctgaagtggagaacccaccccgacaagatcaccggctgcctgagcaagctgaaggagatcgacggcagcgagatcgtgaagttcctgcaggacaccctggacaccctgttcggcatcctggacgagaacagccagaagtacggcagcaaggtgttcgacagcctggtgcacatcatcaacctgctgcaggacagcaagttccaccacttcaagcccgtgatggacacctacatcgagagccacttcgccggcgccctggcctacagagacctgatcaaggtgctgaagtggtacgtggacagaatcaccgaggccgagagacaggagcacatccaggaggtgctgaaggcccaggagtacatcttcaagtacatcgtgcagagcagaagactgttcagcctggccaccggcggccagaacgaggaggagttcagatgctgcatccaggagctgctgatgagcgtgagattcttcctgagccaggagagcaagggcagcggcgccctgagccagagccaggccgtgttcctgagcagcttccccgccgtgtacagcgagctgctgaagctgttcgacgtgagagaggtggccaacctggtgcaggacaccctgggcagcctgcccaccatcctgcacgtggacgacagcctgcaggccatcaagctgcagtgcatcggcaagaccgtggagagccagctgtacaccaaccccgacagcagatacatcctgctgcccgtggtgctgcaccacctgcacatccacctgcaggagcagaaggacctgatcatgtgcgccagaatcctgagcaacgtgttctgcctgatcaagaagaacagcagcgagaagagcgtgctggaggagatcgacgtgatcgtggccagcctgctggacatcctgctgagaaccatcctggagatcaccagcagaccccagcccagcagcagcgccatgagattccagttccaggacgtgaccggcgagttcgtggcctgcctgctgagcctgctgagacagatgaccgacagacactaccagcagctgctggacagcttcaacaccaaggaggagctgagagacttcctgctgcagatcttcaccgtgttcagaatcctgatcagacccgagatgttccccaaggactggaccgtgatgagactggtggccaacaacgtgatcatcaccaccgtgctgtacctgagcgacgccctgagaaagaacttcctgaacgagaacttcgactacaagatctgggacagctacttctacctggccgtgatcttcatcaaccagctgtgcctgcagctggagatgttcacccccagcaagaagaagaaggtgctggagaagtacggcgacatgagagtgaccatgggctgcgagatcttcagcatgtggcagaacctgggcgagcacaagctgcacttcatccccgccctgatcggccccttcctggaggtgaccctgatcccccagcccgacctgagaaacgtgatgatccccatcttccacgacatgatggactgggagcagagaagaagcggcaacttcaagcaggtggaggccaagctgatcgacaagctggacagcctgatgagcgagggcaagggcgacgagacctacagagagctgttcaacagcatcatccccctgttcggcccctaccccagcctgctgaagaagatcgagagagagacctggagagagagcggcgtgagcctgatcgccaccgtgaccagactgatggagagactgctggactacagagactgcatgaagatgggcgaggtggacggcaagaagatcggctgcaccgtgagcctgctgaacttctacaagaccgagctgaacaaggaggagatgtacatcagatacatccacaagctgtacgacctgcacctgaaggcccagaacttcaccgaggccgcctacaccctgctgctgtacgacgagctgctggagtggagcgacagacccctgagagagttcctgacctaccccatgcagaccgagtggcagagaaaggagcacctgcacctgaccatcatccagaacttcgacagaggcaagtgctgggagaacggcatcatcctgtgcagaaagatcgccgagcagtacgagagctactacgactacagaaacctgagcaagatgagaatgatggaggccagcctgtacgacaagatcatggaccagcagagactggagcccgagttcttcagagtgggcttctacggcaagaagttccccttcttcctgagaaacaaggagttcgtgtgcagaggccacgactacgagagactggaggccttccagcagagaatgctgaacgagttcccccacgccatcgccatgcagcacgccaaccagcccgacgagaccatcttccaggccgaggcccagtacctgcagatctacgccgtgacccccatccccgagagccaggaggtgctgcagagagagggcgtgcccgacaacatcaagagcttctacaaggtgaaccacatctggaagttcagatacgacagacccttccacaagggcaccaaggacaaggagaacgagttcaagagcctgtgggtggagagaaccagcctgtacctggtgcagagcctgcccggcatcagcagatggttcgaggtggagaagagagaggtggtggagatgagccccctggagaacgccatcgaggtgctggagaacaagaaccagcagctgaagaccctgatcagccagtgccagaccagacagatgcagaacatcaaccccctgaccatgtgcctgaacggcgtgatcgacgccgccgtgaacggcggcgtgagcagataccaggaggccttcttcgtgaaggagtacatcctgagccaccccgaggacggcgagaagatcgccagactgagagagctgatgctggagcaggcccagatcctggagttcggcctggccgtgcacgagaagttcgtgccccaggacatgagacccctgcacaagaagctggtggaccagttcttcgtgatgaagagcagcctgggcatccaggagttcagcgcctgcatgcaggccagccccgtgcacttccccaacggcagccccagagtgtgcagaaacagcgcccccgccagcgtgagccccgacggcaccagagtgatccccagaagaagccccctgagctaccccgccgtgaacagatacagcagcagcagcctgagcagccaggccagcgccgaggtgagcaacatcaccggccagagcgagagcagcgacgaggtgttcaacatgcagcccagccccagcaccagcagcctgagcagcacccacagcgccagccccaacgtgaccagcagcgcccccagcagcgccagagccagccccctgctgagcgacaagcacaagcacagcagagagaacagctgcctgagccccagagagagaccctgcagcgccatctaccccacccccgtggagcccagccagagaatgctgttcaaccacatcggcgacggcgccctgcccagaagcgaccccaacctgagcgcccccgagaaggccagccccgccagacacaccaccagcgtgagccccagccccgccggcagaagccccctgaagggcagcgtgcagagcttcacccccagccccgtggagtaccacagccccggcctgatcagcaacagccccgtgctgagcggcagctacagcagcggcatcagcagcctgagcagatgcagcaccagcgagaccagcggcttcgagaaccaggtgaacgagcagagcgcccccctgcccgtgcccgtgcccgtgcccgtgcccagctacggcggcgaggagcccgtgagaaaggagagcaagaccccccccccctacagcgtgtacgagagaaccctgagaagacccgtgcccctgccccacagcctgagcatccccgtgaccagcgagccccccgccctgccccccaagcccctggccgccagaagcagccacctggagaacggcgccagaagaaccgaccccggccccagacccagacccctgcccagaaaggtgagccagctgtag

SEQ ID NO: 78857 - DNA, 5865 bp, Artificial Sequence
  Description of Artificial Sequence: Synthetic coding sequence
gtgatcgccagcttcagaggcaccgtgccctacggcctgagcctggagatcggcgacaccgtgcagatcctggagaagtgcgacggctggtacagaggcttcgccctgaagaaccccaacatcaagggcatcttccccagcagctacgtgcacctgaagaacgcctgcgtgaagaacaagggccagttcgagatggtgatccccaccgaggacagcgtgatcaccgagatgaccagcaccctgagagactggggcaccatgtggaagcagctgtacgtgagaaacgagggcgacctgttccacagactgtggcacatcatgaacgagatcctggacctgagaagacaggtgctggtgggccacctgacccacgacagaatgaaggacgtgaagagacacatcaccgccagactggactggggcaacgagcagctgggcctggacctggtgcccagaaaggagtacgccatggtggaccccgaggacatcagcatcaccgagctgtacagactgatggagcacagacacagaaagaaggacacccccgtgcaggccagcagccaccacctgttcgtgcagatgaagagcctgatgtgcagcaacctgggcgaggagctggaggtgatcttcagcctgttcgacagcaaggagaacagacccatcagcgagagattcttcctgagactgaacagaaacggcctgcccaaggcccccgacaagcccgagagacactgcagcctgttcgtggacctgggcagcagcgagctgagaaaggacatctacatcaccgtgcacatcatcagaatcggcagaatgggcgccggcgagaagaagaacgcctgcagcgtgcagtacagaagacccttcggctgcgccgtgctgagcatcgccgacctgctgaccggcgagaccaaggacgacctgatcctgaaggtgtacatgtgcaacaccgagagcgagtggtaccagatccacgagaacatcatcaagaagctgaacgccagatacaacctgaccggcagcaacgccggcctggccgtgagcctgcagctgctgcacggcgacatcgagcagatcagaagagagtacagcagcgtgttcagccacggcgtgagcatcaccagaaagctgggcttcagcaacatcatcatgcccggcgagatgagaaacgacctgtacatcaccatcgagagaggcgagttcgagaagggcggcaagagcgtggccagaaacgtggaggtgaccatgttcatcgtggacagcagcggccagaccctgaaggacttcatcagcttcggcagcggcgagccccccgccagcgagtaccacagcttcgtgctgtaccacaacaacagccccagatggagcgagctgctgaagctgcccatccccgtggacaagttcagaggcgcccacatcagattcgagttcagacactgcagcaccaaggagaagggcgagaagaagctgttcggcttcagcttcgtgcccctgatgcaggaggacggcagaaccctgcccgacggcacccacgagctgatcgtgcacaagtgcgaggagaacaccaacctgcaggacaccaccagatacctgaagctgcccttcagcaagggcatcttcctgggcaacaacaaccaggccatgaaggccaccaaggagagcttctgcatcaccagcttcctgtgcagcaccaagctgacccagaacggcgacatgctggacctgctgaagtggagaacccaccccgacaagatcaccggctgcctgagcaagctgaaggagatcgacggcagcgagatcgtgaagttcctgcaggacaccctggacaccctgttcggcatcctggacgagaacagccagaagtacggcagcaaggtgttcgacagcctggtgcacatcatcaacctgctgcaggacagcaagttccaccacttcaagcccgtgatggacacctacatcgagagccacttcgccggcgccctggcctacagagacctgatcaaggtgctgaagtggtacgtggacagaatcaccgaggccgagagacaggagcacatccaggaggtgctgaaggcccaggagtacatcttcaagtacatcgtgcagagcagaagactgttcagcctggccaccggcggccagaacgaggaggagttcagatgctgcatccaggagctgctgatgagcgtgagattcttcctgagccaggagagcaagggcagcggcgccctgagccagagccaggccgtgttcctgagcagcttccccgccgtgtacagcgagctgctgaagctgttcgacgtgagagaggtggccaacctggtgcaggacaccctgggcagcctgcccaccatcctgcacgtggacgacagcctgcaggccatcaagctgcagtgcatcggcaagaccgtggagagccagctgtacaccaaccccgacagcagatacatcctgctgcccgtggtgctgcaccacctgcacatccacctgcaggagcagaaggacctgatcatgtgcgccagaatcctgagcaacgtgttctgcctgatcaagaagaacagcagcgagaagagcgtgctggaggagatcgacgtgatcgtggccagcctgctggacatcctgctgagaaccatcctggagatcaccagcagaccccagcccagcagcagcgccatgagattccagttccaggacgtgaccggcgagttcgtggcctgcctgctgagcctgctgagacagatgaccgacagacactaccagcagctgctggacagcttcaacaccaaggaggagctgagagacttcctgctgcagatcttcaccgtgttcagaatcctgatcagacccgagatgttccccaaggactggaccgtgatgagactggtggccaacaacgtgatcatcaccaccgtgctgtacctgagcgacgccctgagaaagaacttcctgaacgagaacttcgactacaagatctgggacagctacttctacctggccgtgatcttcatcaaccagctgtgcctgcagctggagatgttcacccccagcaagaagaagaaggtgctggagaagtacggcgacatgagagtgaccatgggctgcgagatcttcagcatgtggcagaacctgggcgagcacaagctgcacttcatccccgccctgatcggccccttcctggaggtgaccctgatcccccagcccgacctgagaaacgtgatgatccccatcttccacgacatgatggactgggagcagagaagaagcggcaacttcaagcaggtggaggccaagctgatcgacaagctggacagcctgatgagcgagggcaagggcgacgagacctacagagagctgttcaacagcatcctgctgaagaagatcgagagagagacctggagagagagcggcgtgagcctgatcgccaccgtgaccagactgatggagagactgctggactacagagactgcatgaagatgggcgaggtggacggcaagaagatcggctgcaccgtgagcctgctgaacttctacaagaccgagctgaacaaggaggagatgtacatcagatacatccacaagctgtacgacctgcacctgaaggcccagaacttcaccgaggccgcctacaccctgctgctgtacgacgagctgctggagtggagcgacagacccctgagagagttcctgacctaccccatgcagaccgagtggcagagaaaggagcacctgcacctgaccatcatccagaacttcgacagaggcaagtgctgggagaacggcatcatcctgtgcagaaagatcgccgagcagtacgagagctactacgactacagaaacctgagcaagatgagaatgatggaggccagcctgtacgacaagatcatggaccagcagagactggagcccgagttcttcagagtgggcttctacggcaagaagttccccttcttcctgagaaacaaggagttcgtgtgcagaggccacgactacgagagactggaggccttccagcagagaatgctgaacgagttcccccacgccatcgccatgcagcacgccaaccagcccgacgagaccatcttccaggccgaggcccagtacctgcagatctacgccgtgacccccatccccgagagccaggaggtgctgcagagagagggcgtgcccgacaacatcaagagcttctacaaggtgaaccacatctggaagttcagatacgacagacccttccacaagggcaccaaggacaaggagaacgagttcaagagcctgtgggtggagagaaccagcctgtacctggtgcagagcctgcccggcatcagcagatggttcgaggtggagaagagagaggtggtggagatgagccccctggagaacgccatcgaggtgctggagaacaagaaccagcagctgaagaccctgatcagccagtgccagaccagacagatgcagaacatcaaccccctgaccatgtgcctgaacggcgtgatcgacgccgccgtgaacggcggcgtgagcagataccaggaggccttcttcgtgaaggagtacatcctgagccaccccgaggacggcgagaagatcgccagactgagagagctgatgctggagcaggcccagatcctggagttcggcctggccgtgcacgagaagttcgtgccccaggacatgagacccctgcacaagaagctggtggaccagttcttcgtgatgaagagcagcctgggcatccaggagttcagcgcctgcatgcaggccagccccgtgcacttccccaacggcagccccagagtgtgcagaaacagcgcccccgccagcgtgagccccgacggcaccagagtgatccccagaagaagccccctgagctaccccgccgtgaacagatacagcagcagcagcctgagcagccaggccagcgccgaggtgagcaacatcaccggccagagcgagagcagcgacgaggtgttcaacatgcagcccagccccagcaccagcagcctgagcagcacccacagcgccagccccaacgtgaccagcagcgcccccagcagcgccagagccagccccctgctgagcgacaagcacaagcacagcagagagaacagctgcctgagccccagagagagaccctgcagcgccatctaccccacccccgtggagcccagccagagaatgctgttcaaccacatcggcgacggcgccctgcccagaagcgaccccaacctgagcgcccccgagaaggccgtgaaccccacccccagcagctggagcctggacagcggcaaggaggccaagaacatgagcgacagcggcaagctgatcagcccccccgtgccccccagacccacccagaccgccagccccgccagacacaccaccagcgtgagccccagccccgccggcagaagccccctgaagggcagcgtgcagagcttcacccccagccccgtggagtaccacagccccggcctgatcagcaacagccccgtgctgagcggcagctacagcagcggcatcagcagcctgagcagatgcagcaccagcgagaccagcggcttcgagaaccaggtgaacgagcagagcgcccccctgcccgtgcccgtgcccgtgcccgtgcccagctacggcggcgaggagcccgtgagaaaggagagcaagaccccccccccctacagcgtgtacgagagaaccctgagaagacccgtgcccctgccccacagcctgagcatccccgtgaccagcgagccccccgccctgccccccaagcccctggccgccagaagcagccacctggagaacggcgccagaagaaccgaccccggccccagacccagacccctgcccagaaaggtgagccagctgtag

SEQ ID NO: 78858 - DNA, 5928 bp, Artificial Sequence
  Description of Artificial Sequence: Synthetic coding sequence
atgtggatccccaccgagcacgagaagtacggcgtggtgatcgccagcttcagaggcaccgtgccctacggcctgagcctggagatcggcgacaccgtgcagatcctggagaagtgcgacggctggtacagaggcttcgccctgaagaaccccaacatcaagggcatcttccccagcagctacgtgcacctgaagaacgcctgcgtgaagaacaagggccagttcgagatggtgatccccaccgaggacagcgtgatcaccgagatgaccagcaccctgagagactggggcaccatgtggaagcagctgtacgtgagaaacgagggcgacctgttccacagactgtggcacatcatgaacgagatcctggacctgagaagacaggtgctggtgggccacctgacccacgacagaatgaaggacgtgaagagacacatcaccgccagactggactggggcaacgagcagctgggcctggacctggtgcccagaaaggagtacgccatggtggaccccgaggacatcagcatcaccgagctgtacagactgatggagcacagacacagaaagaaggacacccccgtgcaggccagcagccaccacctgttcgtgcagatgaagagcctgatgtgcagcaacctgggcgaggagctggaggtgatcttcagcctgttcgacagcaaggagaacagacccatcagcgagagattcttcctgagactgaacagaaacggcctgcccaaggcccccgacaagcccgagagacactgcagcctgttcgtggacctgggcagcagcgagctgagaaaggacatctacatcaccgtgcacatcatcagaatcggcagaatgggcgccggcgagaagaagaacgcctgcagcgtgcagtacagaagacccttcggctgcgccgtgctgagcatcgccgacctgctgaccggcgagaccaaggacgacctgatcctgaaggtgtacatgtgcaacaccgagagcgagtggtaccagatccacgagaacatcatcaagaagctgaacgccagatacaacctgaccggcagcaacgccggcctggccgtgagcctgcagctgctgcacggcgacatcgagcagatcagaagagagtacagcagcgtgttcagccacggcgtgagcatcaccagaaagctgggcttcagcaacatcatcatgcccggcgagatgagaaacgacctgtacatcaccatcgagagaggcgagttcgagaagggcggcaagagcgtggccagaaacgtggaggtgaccatgttcatcgtggacagcagcggccagaccctgaaggacttcatcagcttcggcagcggcgagccccccgccagcgagtaccacagcttcgtgctgtaccacaacaacagccccagatggagcgagctgctgaagctgcccatccccgtggacaagttcagaggcgcccacatcagattcgagttcagacactgcagcaccaaggagaagggcgagaagaagctgttcggcttcagcttcgtgcccctgatgcaggaggacggcagaaccctgcccgacggcacccacgagctgatcgtgcacaagtgcgaggagaacaccaacctgcaggacaccaccagatacctgaagctgcccttcagcaagggcatcttcctgggcaacaacaaccaggccatgaaggccaccaaggagagcttctgcatcaccagcttcctgtgcagcaccaagctgacccagaacggcgacatgctggacctgctgaagtggagaacccaccccgacaagatcaccggctgcctgagcaagctgaaggagatcgacggcagcgagatcgtgaagttcctgcaggacaccctggacaccctgttcggcatcctggacgagaacagccagaagtacggcagcaaggtgttcgacagcctggtgcacatcatcaacctgctgcaggacagcaagttccaccacttcaagcccgtgatggacacctacatcgagagccacttcgccggcgccctggcctacagagacctgatcaaggtgctgaagtggtacgtggacagaatcaccgaggccgagagacaggagcacatccaggaggtgctgaaggcccaggagtacatcttcaagtacatcgtgcagagcagaagactgttcagcctggccaccggcggccagaacgaggaggagttcagatgctgcatccaggagctgctgatgagcgtgagattcttcctgagccaggagagcaagggcagcggcgccctgagccagagccaggccgtgttcctgagcagcttccccgccgtgtacagcgagctgctgaagctgttcgacgtgagagaggtggccaacctggtgcaggacaccctgggcagcctgcccaccatcctgcacgtggacgacagcctgcaggccatcaagctgcagtgcatcggcaagaccgtggagagccagctgtacaccaaccccgacagcagatacatcctgctgcccgtggtgctgcaccacctgcacatccacctgcaggagcagaaggacctgatcatgtgcgccagaatcctgagcaacgtgttctgcctgatcaagaagaacagcagcgagaagagcgtgctggaggagatcgacgtgatcgtggccagcctgctggacatcctgctgagaaccatcctggagatcaccagcagaccccagcccagcagcagcgccatgagattccagttccaggacgtgaccggcgagttcgtggcctgcctgctgagcctgctgagacagatgaccgacagacactaccagcagctgctggacagcttcaacaccaaggaggagctgagagacttcctgctgcagatcttcaccgtgttcagaatcctgatcagacccgagatgttccccaaggactggaccgtgatgagactggtggccaacaacgtgatcatcaccaccgtgctgtacctgagcgacgccctgagaaagaacttcctgaacgagaacttcgactacaagatctgggacagctacttctacctggccgtgatcttcatcaaccagctgtgcctgcagctggagatgttcacccccagcaagaagaagaaggtgctggagaagtacggcgacatgagagtgaccatgggctgcgagatcttcagcatgtggcagaacctgggcgagcacaagctgcacttcatccccgccctgatcggccccttcctggaggtgaccctgatcccccagcccgacctgagaaacgtgatgatccccatcttccacgacatgatggactgggagcagagaagaagcggcaacttcaagcaggtggaggccaagctgatcgacaagctggacagcctgatgagcgagggcaagggcgacgagacctacagagagctgttcaacagcatcatccccctgttcggcccctaccccagcctgctgaagaagatcgagagagagacctggagagagagcggcgtgagcctgatcgccaccgtgaccagactgatggagagactgctggactacagagactgcatgaagatgggcgaggtggacggcaagaagatcggctgcaccgtgagcctgctgaacttctacaagaccgagctgaacaaggaggagatgtacatcagatacatccacaagctgtacgacctgcacctgaaggcccagaacttcaccgaggccgcctacaccctgctgctgtacgacgagctgctggagtggagcgacagacccctgagagagttcctgacctaccccatgcagaccgagtggcagagaaaggagcacctgcacctgaccatcatccagaacttcgacagaggcaagtgctgggagaacggcatcatcctgtgcagaaagatcgccgagcagtacgagagctactacgactacagaaacctgagcaagatgagaatgatggaggccagcctgtacgacaagatcatggaccagcagagactggagcccgagttcttcagagtgggcttctacggcaagaagttccccttcttcctgagaaacaaggagttcgtgtgcagaggccacgactacgagagactggaggccttccagcagagaatgctgaacgagttcccccacgccatcgccatgcagcacgccaaccagcccgacgagaccatcttccaggccgaggcccagtacctgcagatctacgccgtgacccccatccccgagagccaggaggtgctgcagagagagggcgtgcccgacaacatcaagagcttctacaaggtgaaccacatctggaagttcagatacgacagacccttccacaagggcaccaaggacaaggagaacgagttcaagagcctgtgggtggagagaaccagcctgtacctggtgcagagcctgcccggcatcagcagatggttcgaggtggagaagagagaggtggtggagatgagccccctggagaacgccatcgaggtgctggagaacaagaaccagcagctgaagaccctgatcagccagtgccagaccagacagatgcagaacatcaaccccctgaccatgtgcctgaacggcgtgatcgacgccgccgtgaacggcggcgtgagcagataccaggaggccttcttcgtgaaggagtacatcctgagccaccccgaggacggcgagaagatcgccagactgagagagctgatgctggagcaggcccagatcctggagttcggcctggccgtgcacgagaagttcgtgccccaggacatgagacccctgcacaagaagctggtggaccagttcttcgtgatgaagagcagcctgggcatccaggagttcagcgcctgcatgcaggccagccccgtgcacttccccaacggcagccccagagtgtgcagaaacagcgcccccgccagcgtgagccccgacggcaccagagtgatccccagaagaagccccctgagctaccccgccgtgaacagatacagcagcagcagcctgagcagccaggccagcgccgaggtgagcaacatcaccggccagagcgagagcagcgacgaggtgttcaacatgcagcccagccccagcaccagcagcctgagcagcacccacagcgccagccccaacgtgaccagcagcgcccccagcagcgccagagccagccccctgctgagcgacaagcacaagcacagcagagagaacagctgcctgagccccagagagagaccctgcagcgccatctaccccacccccgtggagcccagccagagaatgctgttcaaccacatcggcgacggcgccctgcccagaagcgaccccaacctgagcgcccccgagaaggccgtgaaccccacccccagcagctggagcctggacagcggcaaggaggccaagaacatgagcgacagcggcaagctgatcagcccccccgtgccccccagacccacccagaccgccagccccgccagacacaccaccagcgtgagccccagccccgccggcagaagccccctgaagggcagcgtgcagagcttcacccccagccccgtggagtaccacagccccggcctgatcagcaacagccccgtgctgagcggcagctacagcagcggcatcagcagcctgagcagatgcagcaccagcgagaccagcggcttcgagaaccaggtgaacgagcagagcgcccccctgcccgtgcccgtgcccgtgcccgtgcccagctacggcggcgaggagcccgtgagaaaggagagcaagaccccccccccctacagcgtgtacgagagaaccctgagaagacccgtgcccctgccccacagcctgagcatccccgtgaccagcgagccccccgccctgccccccaagcccctggccgccagaagcagccacctggagaacggcgccagaagaaccgaccccggccccagacccagacccctgcccagaaaggtgagccagctgtag

SEQ ID NO: 78859 - DNA, 5901 bp, Artificial Sequence
  Description of Artificial Sequence: Synthetic coding sequence
atgtggatccccaccgagcacgagaagtacggcgtggtgatcgccagcttcagaggcaccgtgccctacggcctgagcctggagatcggcgacaccgtgcagatcctggagaagtgcgacggctggtacagaggcttcgccctgaagaaccccaacatcaagggcatcttccccagcagctacgtgcacctgaagaacgcctgcgtgaagaacaagggccagttcgagatggtgatccccaccgaggacagcgtgatcaccgagatgaccagcaccctgagagactggggcaccatgtggaagcagctgtacgtgagaaacgagggcgacctgttccacagactgtggcacatcatgaacgagatcctggacctgagaagacaggtgctggtgggccacctgacccacgacagaatgaaggacgtgaagagacacatcaccgccagactggactggggcaacgagcagctgggcctggacctggtgcccagaaaggagtacgccatggtggaccccgaggacatcagcatcaccgagctgtacagactgatggagcacagacacagaaagaaggacacccccgtgcaggccagcagccaccacctgttcgtgcagatgaagagcctgatgtgcagcaacctgggcgaggagctggaggtgatcttcagcctgttcgacagcaaggagaacagacccatcagcgagagattcttcctgagactgaacagaaacggcctgcccaaggcccccgacaagcccgagagacactgcagcctgttcgtggacctgggcagcagcgagctgagaaaggacatctacatcaccgtgcacatcatcagaatcggcagaatgggcgccggcgagaagaagaacgcctgcagcgtgcagtacagaagacccttcggctgcgccgtgctgagcatcgccgacctgctgaccggcgagaccaaggacgacctgatcctgaaggtgtacatgtgcaacaccgagagcgagtggtaccagatccacgagaacatcatcaagaagctgaacgccagatacaacctgaccggcagcaacgccggcctggccgtgagcctgcagctgctgcacggcgacatcgagcagatcagaagagagtacagcagcgtgttcagccacggcgtgagcatcaccagaaagctgggcttcagcaacatcatcatgcccggcgagatgagaaacgacctgtacatcaccatcgagagaggcgagttcgagaagggcggcaagagcgtggccagaaacgtggaggtgaccatgttcatcgtggacagcagcggccagaccctgaaggacttcatcagcttcggcagcggcgagccccccgccagcgagtaccacagcttcgtgctgtaccacaacaacagccccagatggagcgagctgctgaagctgcccatccccgtggacaagttcagaggcgcccacatcagattcgagttcagacactgcagcaccaaggagaagggcgagaagaagctgttcggcttcagcttcgtgcccctgatgcaggaggacggcagaaccctgcccgacggcacccacgagctgatcgtgcacaagtgcgaggagaacaccaacctgcaggacaccaccagatacctgaagctgcccttcagcaagggcatcttcctgggcaacaacaaccaggccatgaaggccaccaaggagagcttctgcatcaccagcttcctgtgcagcaccaagctgacccagaacggcgacatgctggacctgctgaagtggagaacccaccccgacaagatcaccggctgcctgagcaagctgaaggagatcgacggcagcgagatcgtgaagttcctgcaggacaccctggacaccctgttcggcatcctggacgagaacagccagaagtacggcagcaaggtgttcgacagcctggtgcacatcatcaacctgctgcaggacagcaagttccaccacttcaagcccgtgatggacacctacatcgagagccacttcgccggcgccctggcctacagagacctgatcaaggtgctgaagtggtacgtggacagaatcaccgaggccgagagacaggagcacatccaggaggtgctgaaggcccaggagtacatcttcaagtacatcgtgcagagcagaagactgttcagcctggccaccggcggccagaacgaggaggagttcagatgctgcatccaggagctgctgatgagcgtgagattcttcctgagccaggagagcaagggcagcggcgccctgagccagagccaggccgtgttcctgagcagcttccccgccgtgtacagcgagctgctgaagctgttcgacgtgagagaggtggccaacctggtgcaggacaccctgggcagcctgcccaccatcctgcacgtggacgacagcctgcaggccatcaagctgcagtgcatcggcaagaccgtggagagccagctgtacaccaaccccgacagcagatacatcctgctgcccgtggtgctgcaccacctgcacatccacctgcaggagcagaaggacctgatcatgtgcgccagaatcctgagcaacgtgttctgcctgatcaagaagaacagcagcgagaagagcgtgctggaggagatcgacgtgatcgtggccagcctgctggacatcctgctgagaaccatcctggagatcaccagcagaccccagcccagcagcagcgccatgagattccagttccaggacgtgaccggcgagttcgtggcctgcctgctgagcctgctgagacagatgaccgacagacactaccagcagctgctggacagcttcaacaccaaggaggagctgagagacttcctgctgcagatcttcaccgtgttcagaatcctgatcagacccgagatgttccccaaggactggaccgtgatgagactggtggccaacaacgtgatcatcaccaccgtgctgtacctgagcgacgccctgagaaagaacttcctgaacgagaacttcgactacaagatctgggacagctacttctacctggccgtgatcttcatcaaccagctgtgcctgcagctggagatgttcacccccagcaagaagaagaaggtgctggagaagtacggcgacatgagagtgaccatgggctgcgagatcttcagcatgtggcagaacctgggcgagcacaagctgcacttcatccccgccctgatcggccccttcctggaggtgaccctgatcccccagcccgacctgagaaacgtgatgatccccatcttccacgacatgatggactgggagcagagaagaagcggcaacttcaagcaggtggaggccaagctgatcgacaagctggacagcctgatgagcgagggcaagggcgacgagacctacagagagctgttcaacagcatcctgctgaagaagatcgagagagagacctggagagagagcggcgtgagcctgatcgccaccgtgaccagactgatggagagactgctggactacagagactgcatgaagatgggcgaggtggacggcaagaagatcggctgcaccgtgagcctgctgaacttctacaagaccgagctgaacaaggaggagatgtacatcagatacatccacaagctgtacgacctgcacctgaaggcccagaacttcaccgaggccgcctacaccctgctgctgtacgacgagctgctggagtggagcgacagacccctgagagagttcctgacctaccccatgcagaccgagtggcagagaaaggagcacctgcacctgaccatcatccagaacttcgacagaggcaagtgctgggagaacggcatcatcctgtgcagaaagatcgccgagcagtacgagagctactacgactacagaaacctgagcaagatgagaatgatggaggccagcctgtacgacaagatcatggaccagcagagactggagcccgagttcttcagagtgggcttctacggcaagaagttccccttcttcctgagaaacaaggagttcgtgtgcagaggccacgactacgagagactggaggccttccagcagagaatgctgaacgagttcccccacgccatcgccatgcagcacgccaaccagcccgacgagaccatcttccaggccgaggcccagtacctgcagatctacgccgtgacccccatccccgagagccaggaggtgctgcagagagagggcgtgcccgacaacatcaagagcttctacaaggtgaaccacatctggaagttcagatacgacagacccttccacaagggcaccaaggacaaggagaacgagttcaagagcctgtgggtggagagaaccagcctgtacctggtgcagagcctgcccggcatcagcagatggttcgaggtggagaagagagaggtggtggagatgagccccctggagaacgccatcgaggtgctggagaacaagaaccagcagctgaagaccctgatcagccagtgccagaccagacagatgcagaacatcaaccccctgaccatgtgcctgaacggcgtgatcgacgccgccgtgaacggcggcgtgagcagataccaggaggccttcttcgtgaaggagtacatcctgagccaccccgaggacggcgagaagatcgccagactgagagagctgatgctggagcaggcccagatcctggagttcggcctggccgtgcacgagaagttcgtgccccaggacatgagacccctgcacaagaagctggtggaccagttcttcgtgatgaagagcagcctgggcatccaggagttcagcgcctgcatgcaggccagccccgtgcacttccccaacggcagccccagagtgtgcagaaacagcgcccccgccagcgtgagccccgacggcaccagagtgatccccagaagaagccccctgagctaccccgccgtgaacagatacagcagcagcagcctgagcagccaggccagcgccgaggtgagcaacatcaccggccagagcgagagcagcgacgaggtgttcaacatgcagcccagccccagcaccagcagcctgagcagcacccacagcgccagccccaacgtgaccagcagcgcccccagcagcgccagagccagccccctgctgagcgacaagcacaagcacagcagagagaacagctgcctgagccccagagagagaccctgcagcgccatctaccccacccccgtggagcccagccagagaatgctgttcaaccacatcggcgacggcgccctgcccagaagcgaccccaacctgagcgcccccgagaaggccgtgaaccccacccccagcagctggagcctggacagcggcaaggaggccaagaacatgagcgacagcggcaagctgatcagcccccccgtgccccccagacccacccagaccgccagccccgccagacacaccaccagcgtgagccccagccccgccggcagaagccccctgaagggcagcgtgcagagcttcacccccagccccgtggagtaccacagccccggcctgatcagcaacagccccgtgctgagcggcagctacagcagcggcatcagcagcctgagcagatgcagcaccagcgagaccagcggcttcgagaaccaggtgaacgagcagagcgcccccctgcccgtgcccgtgcccgtgcccgtgcccagctacggcggcgaggagcccgtgagaaaggagagcaagaccccccccccctacagcgtgtacgagagaaccctgagaagacccgtgcccctgccccacagcctgagcatccccgtgaccagcgagccccccgccctgccccccaagcccctggccgccagaagcagccacctggagaacggcgccagaagaaccgaccccggccccagacccagacccctgcccagaaaggtgagccagctgtag

SEQ ID NO: 78860 - DNA, 2550 bp, Artificial Sequence
  Description of Artificial Sequence: Synthetic coding sequence
atgaagatgcacagcaccgagagaatccccctgttcggcccctaccccagcctgctgaagaagatcgagagagagacctggagagagagcggcgtgagcctgatcgccaccgtgaccagactgatggagagactgctggactacagagactgcatgaagatgggcgaggtggacggcaagaagatcggctgcaccgtgagcctgctgaacttctacaagaccgagctgaacaaggaggagatgtacatcagatacatccacaagctgtacgacctgcacctgaaggcccagaacttcaccgaggccgcctacaccctgctgctgtacgacgagctgctggagtggagcgacagacccctgagagagttcctgacctaccccatgcagaccgagtggcagagaaaggagcacctgcacctgaccatcatccagaacttcgacagaggcaagtgctgggagaacggcatcatcctgtgcagaaagatcgccgagcagtacgagagctactacgactacagaaacctgagcaagatgagaatgatggaggccagcctgtacgacaagatcatggaccagcagagactggagcccgagttcttcagagtgggcttctacggcaagaagttccccttcttcctgagaaacaaggagttcgtgtgcagaggccacgactacgagagactggaggccttccagcagagaatgctgaacgagttcccccacgccatcgccatgcagcacgccaaccagcccgacgagaccatcttccaggccgaggcccagtacctgcagatctacgccgtgacccccatccccgagagccaggaggtgctgcagagagagggcgtgcccgacaacatcaagagcttctacaaggtgaaccacatctggaagttcagatacgacagacccttccacaagggcaccaaggacaaggagaacgagttcaagagcctgtgggtggagagaaccagcctgtacctggtgcagagcctgcccggcatcagcagatggttcgaggtggagaagagagaggtggtggagatgagccccctggagaacgccatcgaggtgctggagaacaagaaccagcagctgaagaccctgatcagccagtgccagaccagacagatgcagaacatcaaccccctgaccatgtgcctgaacggcgtgatcgacgccgccgtgaacggcggcgtgagcagataccaggaggccttcttcgtgaaggagtacatcctgagccaccccgaggacggcgagaagatcgccagactgagagagctgatgctggagcaggcccagatcctggagttcggcctggccgtgcacgagaagttcgtgccccaggacatgagacccctgcacaagaagctggtggaccagttcttcgtgatgaagagcagcctgggcatccaggagttcagcgcctgcatgcaggccagccccgtgcacttccccaacggcagccccagagtgtgcagaaacagcgcccccgccagcgtgagccccgacggcaccagagtgatccccagaagaagccccctgagctaccccgccgtgaacagatacagcagcagcagcctgagcagccaggccagcgccgaggtgagcaacatcaccggccagagcgagagcagcgacgaggtgttcaacatgcagcccagccccagcaccagcagcctgagcagcacccacagcgccagccccaacgtgaccagcagcgcccccagcagcgccagagccagccccctgctgagcgacaagcacaagcacagcagagagaacagctgcctgagccccagagagagaccctgcagcgccatctaccccacccccgtggagcccagccagagaatgctgttcaaccacatcggcgacggcgccctgcccagaagcgaccccaacctgagcgcccccgagaaggccgtgaaccccacccccagcagctggagcctggacagcggcaaggaggccaagaacatgagcgacagcggcaagctgatcagcccccccgtgccccccagacccacccagaccgccagccccgccagacacaccaccagcgtgagccccagccccgccggcagaagccccctgaagggcagcgtgcagagcttcacccccagccccgtggagtaccacagccccggcctgatcagcaacagccccgtgctgagcggcagctacagcagcggcatcagcagcctgagcagatgcagcaccagcgagaccagcggcttcgagaaccaggtgaacgagcagagcgcccccctgcccgtgcccgtgcccgtgcccgtgcccagctacggcggcgaggagcccgtgagaaaggagagcaagaccccccccccctacagcgtgtacgagagaaccctgagaagacccgtgcccctgccccacagcctgagcatccccgtgaccagcgagccccccgccctgccccccaagcccctggccgccagaagcagccacctggagaacggcgccagaagaaccgaccccggccccagacccagacccctgcccagaaaggtgagccagctgtag

SEQ ID NO: 78861 - DNA, 3318 bp, Artificial Sequence
  Description of Artificial Sequence: Synthetic coding sequence
tggatccccagcgagaagcagaccttcttcaccgtgatcgccagcttcagaggcaccgtgccctacggcctgagcctggagatcggcgacaccgtgcagatcctggagaagtgcgacggctggtacagaggcttcgccctgaagaaccccaacatcaagggcatcttccccagcagctacgtgcacctgaagaacgcctgcgtgaagaacaagggccagttcgagatggtgatccccaccgaggacagcgtgatcaccgagatgaccagcaccctgagagactggggcaccatgtggaagcagctgtacgtgagaaacgagggcgacctgttccacagactgtggcacatcatgaacgagatcctggacctgagaagacaggtgctggtgggccacctgacccacgacagaatgaaggacgtgaagagacacatcaccgccagactggactggggcaacgagcagctgggcctggacctggtgcccagaaaggagtacgccatggtggaccccgaggacatcagcatcaccgagctgtacagactgatggagcacagacacagaaagaaggacacccccgtgcaggccagcagccaccacctgttcgtgcagatgaagagcctgatgtgcagcaacctgggcgaggagctggaggtgatcttcagcctgttcgacagcaaggagaacagacccatcagcgagagattcttcctgagactgaacagaaacggcctgcccaaggcccccgacaagcccgagagacactgcagcctgttcgtggacctgggcagcagcgagctgagaaaggacatctacatcaccgtgcacatcatcagaatcggcagaatgggcgccggcgagaagaagaacgcctgcagcgtgcagtacagaagacccttcggctgcgccgtgctgagcatcgccgacctgctgaccggcgagaccaaggacgacctgatcctgaaggtgtacatgtgcaacaccgagagcgagtggtaccagatccacgagaacatcatcaagaagctgaacgccagatacaacctgaccggcagcaacgccggcctggccgtgagcctgcagctgctgcacggcgacatcgagcagatcagaagagagtacagcagcgtgttcagccacggcgtgagcatcaccagaaagctgggcttcagcaacatcatcatgcccggcgagatgagaaacgacctgtacatcaccatcgagagaggcgagttcgagaagggcggcaagagcgtggccagaaacgtggaggtgaccatgttcatcgtggacagcagcggccagaccctgaaggacttcatcagcttcggcagcggcgagccccccgccagcgagtaccacagcttcgtgctgtaccacaacaacagccccagatggagcgagctgctgaagctgcccatccccgtggacaagttcagaggcgcccacatcagattcgagttcagacactgcagcaccaaggagaagggcgagaagaagctgttcggcttcagcttcgtgcccctgatgcaggaggacggcagaaccctgcccgacggcacccacgagctgatcgtgcacaagtgcgaggagaacaccaacctgcaggacaccaccagatacctgaagctgcccttcagcaagggcatcttcctgggcaacaacaaccaggccatgaaggccaccaaggagagcttctgcatcaccagcttcctgtgcagcaccaagctgacccagaacggcgacatgctggacctgctgaagtggagaacccaccccgacaagatcaccggctgcctgagcaagctgaaggagatcgacggcagcgagatcgtgaagttcctgcaggacaccctggacaccctgttcggcatcctggacgagaacagccagaagtacggcagcaaggtgttcgacagcctggtgcacatcatcaacctgctgcaggacagcaagttccaccacttcaagcccgtgatggacacctacatcgagagccacttcgccggcgccctggcctacagagacctgatcaaggtgctgaagtggtacgtggacagaatcaccgaggccgagagacaggagcacatccaggaggtgctgaaggcccaggagtacatcttcaagtacatcgtgcagagcagaagactgttcagcctggccaccggcggccagaacgaggaggagttcagatgctgcatccaggagctgctgatgagcgtgagattcttcctgagccaggagagcaagggcagcggcgccctgagccagagccaggccgtgttcctgagcagcttccccgccgtgtacagcgagctgctgaagctgttcgacgtgagagaggtggccaacctggtgcaggacaccctgggcagcctgcccaccatcctgcacgtggacgacagcctgcaggccatcaagctgcagtgcatcggcaagaccgtggagagccagctgtacaccaaccccgacagcagatacatcctgctgcccgtggtgctgcaccacctgcacatccacctgcaggagcagaaggacctgatcatgtgcgccagaatcctgagcaacgtgttctgcctgatcaagaagaacagcagcgagaagagcgtgctggaggagatcgacgtgatcgtggccagcctgctggacatcctgctgagaaccatcctggagatcaccagcagaccccagcccagcagcagcgccatgagattccagttccaggacgtgaccggcgagttcgtggcctgcctgctgagcctgctgagacagatgaccgacagacactaccagcagctgctggacagcttcaacaccaaggaggagctgagagacttcctgctgcagatcttcaccgtgttcagaatcctgatcagacccgagatgttccccaaggactggaccgtgatgagactggtggccaacaacgtgatcatcaccaccgtgctgtacctgagcgacgccctgagaaagaacttcctgaacgagaacttcgactacaagatctgggacagctacttctacctggccgtgatcttcatcaaccagctgtgcctgcagctggagatgttcacccccagcaagaagaagaaggtgctggagaagtacggcgacatgagagtgaccatgggctgcgagatcttcagcatgtggcagaacctgggcgagcacaagctgcacttcatccccgccctgagacaggagaacagactgaacctgggcggcggcggctgcagcgagcccagagcctgccactgcacccccgcctgggccaccaagagagactgcgtgagcaagaagaaggagaagaagacctag

SEQ ID NO: 78862 - DNA, 6144 bp, Artificial Sequence
  Description of Artificial Sequence: Synthetic coding sequence
atggccgccagcgagagaagagccttcgcccacaagatcaacagaaccgtggccgccgaggtgagaaagcaggtgagcagagagagaagcggcagcccccacagcagcagaagatgcagcagcagcctgggcgtgcccctgaccgaggtggtggagcccctggacttcgaggacgtgctgctgagcagaccccccgacgccgagcccggccccctgagagacctggtggagttccccgccgacgacctggagctgctgctgcagcccagagagtgcagaaccaccgagcccggcatccccaaggacgagaagctggacgcccaggtgagagccgccgtggagatgtacatcgaggactgggtgatcgtgcacagaagataccagtacctgagcgccgcctacagccccgtgaccaccgacacccagagagagagacagaagggcctgcccagacaggtgttcgagcaggacgccagcggcgacgagagaagcggccccgaggacagcaacgacagcagaagaggcagcggcagccccgaggacacccccagaagcagcggcgccagcagcatcttcgacctgagaaacctggccgccgacagcctgctgcccagcctgctggagagagccgcccccgaggacgtggacagaagaaacgagaccctgagaagacagcacagaccccccgccctgctgaccctgtaccccgcccccgacgaggacgaggccgtggagagatgcagcagacccgagccccccagagagcacttcggccagagaatcctggtgaagtgcctgagcctgaagttcgagatcgagatcgagcccatcttcggcatcctggccctgtacgacgtgagagagaagaagaagatcagcgagaacttctacttcgacctgaacagcgacagcatgaagggcctgctgagagcccacggcacccaccccgccatcagcaccctggccagaagcgccatcttcagcgtgacctaccccagccccgacatcttcctggtgatcaagctggagaaggtgctgcagcagggcgacatcagcgagtgctgcgagccctacatggtgctgaaggaggtggacaccgccaagaacaaggagaagctggagaagctgagactggccgccgagcagttctgcaccagactgggcagatacagaatgcccttcgcctggaccgccgtgcacctggccaacatcgtgagcagcgccggccagctggacagagacagcgacagcgagggcgagagaagacccgcctggaccgacagaagaagaagaggcccccaggacagagccagcagcggcgacgacgcctgcagcttcagcggcttcagacccgccaccctgaccgtgaccaacttcttcaagcaggaggccgagagactgagcgacgaggacctgttcaagttcctggccgacatgagaagacccagcagcctgctgagaagactgagacccgtgaccgcccagctgaagatcgacatcagccccgcccccgagaacccccacttctgcctgagccccgagctgctgcacatcaagccctaccccgaccccagaggcagacccaccaaggagatcctggagttccccgccagagaggtgtacgccccccacaccagctacagaaacctgctgtacgtgtacccccacagcctgaacttcagcagcagacagggcagcgtgagaaacctggccgtgagagtgcagtacatgaccggcgaggaccccagccaggccctgcccgtgatcttcggcaagagcagctgcagcgagttcaccagagaggccttcacccccgtggtgtaccacaacaagagccccgagttctacgaggagttcaagctgcacctgcccgcctgcgtgaccgagaaccaccacctgctgttcaccttctaccacgtgagctgccagcccagacccggcaccgccctggagacccccgtgggcttcacctggatccccctgctgcagcacggcagactgagaaccggccccttctgcctgcccgtgagcgtggaccagcccccccccagctacagcgtgctgacccccgacgtggccctgcccggcatgagatgggtggacggccacaagggcgtgttcagcgtggagctgaccgccgtgagcagcgtgcacccccaggacccctacctggacaagttcttcaccctggtgcacgtgctggaggagggcgccttccccttcagactgaaggacaccgtgctgagcgagggcaacgtggagcaggagctgagagccagcctggccgccctgagactggccagccccgagcccctggtggccttcagccaccacgtgctggacaagctggtgagactggtgatcagaccccccatcatcagcggccagatcgtgaacctgggcagaggcgccttcgaggccatggcccacgtggtgagcctggtgcacagaagcctggaggccgcccaggacgccagaggccactgcccccagctggccgcctacgtgcactacgccttcagactgcccggcaccgagcccagcctgcccgacggcgccccccccgtgaccgtgcaggccgccaccctggccagaggcagcggcagacccgccagcctgtacctggccagaagcaagagcatcagcagcagcaaccccgacctggccgtggcccccggcagcgtggacgacgaggtgagcagaatcctggccagcaagctgctgcacgaggagctggccctgcagtgggtggtgagcagcagcgccgtgagagaggccatcctgcagcacgcctggttcttcttccagctgatggtgaagagcatggccctgcacctgctgctgggccagagactggacacccccagaaagctgagattccccggcagattcctggacgacatcaccgccctggtgggcagcgtgggcctggaggtgatcaccagagtgcacaaggacgtggagctggccgagcacctgaacgccagcctggccttcttcctgagcgacctgctgagcctggtggacagaggcttcgtgttcagcctggtgagagcccactacaagcaggtggccaccagactgcagagcagccccaaccccgccgccctgctgaccctgagaatggagttcaccagaatcctgtgcagccacgagcactacgtgaccctgaacctgccctgctgccccctgagcccccccgccagccccagccccagcgtgagcagcaccaccagccagagcagcaccttcagcagccaggcccccgaccccaaggtgaccagcatgttcgagctgagcggccccttcagacagcagcacttcctggccggcctgctgctgaccgagctggccctggccctggagcccgaggccgagggcgccttcctgctgcacaagaaggccatcagcgccgtgcacagcctgctgtgcggccacgacaccgaccccagatacgccgaggccaccgtgaaggccagagtggccgagctgtacctgcccctgctgagcatcgccagagacaccctgcccagactgcacgacttcgccgagggccccggccagagaagcagactggccagcatgctggacagcgacaccgagggcgagggcgacatcgccggcaccatcaaccccagcgtggccatggccatcgccggcggccccctggcccccggcagcagagccagcatcagccagggcccccccaccgccagcagagccggctgcgccctgagcgccgagagcagcagaaccctgctggcctgcgtgctgtgggtgctgaagaacaccgagcccgccctgctgcagagatgggccaccgacctgaccctgccccagctgggcagactgctggacctgctgtacctgtgcctggccgccttcgagtacaagggcaagaaggccttcgagagaatcaacagcctgaccttcaagaagagcctggacatgaaggccagactggaggaggccatcctgggcaccatcggcgccagacaggagatggtgagaagaagcagagagagaagccccttcggcaaccccgagaacgtgagatggagaaagagcgtgacccactggaagcagaccagcgacagagtggacaagaccaaggacgagatggagcacgaggccctggtggagggcaacctggccaccgaggccagcctggtggtgctggacaccctggagatcatcgtgcagaccgtgatgctgagcgaggccagagagagcgtgctgggcgccgtgctgaaggtggtgctgtacagcctgggcagcgcccagagcgccctgttcctgcagcacggcctggccacccagagagccctggtgagcaagttccccgagctgctgttcgaggaggacaccgagctgtgcgccgacctgtgcctgagactgctgagacactgcggcagcagaatcagcaccatcagaacccacgccagcgccagcctgtacctgctgatgagacagaacttcgagatcggccacaacttcgccagagtgaagatgcaggtgaccatgagcctgagcagcctggtgggcaccacccagaacttcagcgaggagcacctgagaagaagcctgaagaccatcctgacctacgccgaggaggacatgggcctgagagacagcaccttcgccgagcaggtgcaggacctgatgttcaacctgcacatgatcctgaccgacaccgtgaagatgaaggagcaccaggaggaccccgagatgctgatcgacctgatgtacagaatcgccagaggctaccagggcagccccgacctgagactgacctggctgcagaacatggccggcaagcacgccgagctgggcaaccacgccgaggccgcccagtgcatggtgcacgccgccgccctggtggccgagtacctggccctgctggaggaccacagacacctgcccgtgggctgcgtgagcttccagaacatcagcagcaacgtgctggaggagagcgccatcagcgacgacatcctgagccccgacgaggagggcttctgcagcggcaagcacttcaccgagctgggcctggtgggcctgctggagcaggccgccggctacttcaccatgggcggcctgtacgaggccgtgaacgaggtgtacaagaacctgatccccatcctggaggcccacagagactacaagaagctggccgccgtgcacggcaagctgcaggaggccttcaccaagatcatgcaccagagcagcggctgggagagagtgttcggcacctacttcagagtgggcttctacggcgcccacttcggcgacctggacgagcaggagttcgtgtacaaggagcccagcatcaccaagctggccgagatcagccacagactggaggagttctacaccgagagattcggcgacgacgtggtggagatcatcaaggacagcaaccccgtggacaagagcaagctggacagccagaaggcctacatccagatcacctacgtggagccctacttcgacacctacgagctgaaggacagagtgacctacttcgacagaaactacggcctgagaaccttcctgttctgcacccccttcacccccgacggcagagcccacggcgagctgcccgagcagcacaagagaaagaccctgctgagcaccgaccacgccttcccctacatcaagaccagaatcagagtgtgccacagagaggagaccgtgctgacccccgtggaggtggccatcgaggacatgcagaagaagaccagagagctggccttcgccaccgagcaggacccccccgacgccaagatgctgcagatggtgctgcagggcagcgtgggccccaccgtgaaccagggccccctggaggtggcccaggtgttcctggccgagatccccgaggaccccaagctgttcagacaccacaacaagctgagactgtgcttcaaggacttctgcaagaagtgcgaggacgccctgagaaagaacaaggccctgatcggccccgaccagaaggagtaccacagagagctggagagaaactactgcagactgagagaggccctgcagcccctgctgacccagagactgccccagctgatggcccccaccccccccggcctgagaaacagcctgaacagagccagcttcagaaaggccgacctgtag

SEQ ID NO: 78863 - DNA, 4161 bp, Artificial Sequence
  Description of Artificial Sequence: Synthetic coding sequence
atgagatgggtggacggccacaagggcgtgttcagcgtggagctgaccgccgtgagcagcgtgcacccccaggacccctacctggacaagttcttcaccctggtgcacgtgctggaggagggcgccttccccttcagactgaaggacaccgtgctgagcgagggcaacgtggagcaggagctgagagccagcctggccgccctgagactggccagccccgagcccctggtggccttcagccaccacgtgctggacaagctggtgagactggtgatcagaccccccatcatcagcggccagatcgtgaacctgggcagaggcgccttcgaggccatggcccacgtggtgagcctggtgcacagaagcctggaggccgcccaggacgccagaggccactgcccccagctggccgcctacgtgcactacgccttcagactgcccggcaccgagcccagcctgcccgacggcgccccccccgtgaccgtgcaggccgccaccctggccagaggcagcggcagacccgccagcctgtacctggccagaagcaagagcatcagcagcagcaaccccgacctggccgtggcccccggcagcgtggacgacgaggtgagcagaatcctggccagcaagggcatcgacagaagccacagctgggtgaacagcgcctacgcccccggcggcagcaaggccgtgctgagaagagcccccccctactgcggcgccgaccccagacagctgctgcacgaggagctggccctgcagtgggtggtgagcagcagcgccgtgagagaggccatcctgcagcacgcctggttcttcttccagctgatggtgaagagcatggccctgcacctgctgctgggccagagactggacacccccagaaagctgagattccccggcagattcctggacgacatcaccgccctggtgggcagcgtgggcctggaggtgatcaccagagtgcacaaggacgtggagctggccgagcacctgaacgccagcctggccttcttcctgagcgacctgctgagcctggtggacagaggcttcgtgttcagcctggtgagagcccactacaagcaggtggccaccagactgcagagcagccccaaccccgccgccctgctgaccctgagaatggagttcaccagaatcctgtgcagccacgagcactacgtgaccctgaacctgccctgctgccccctgagcccccccgccagccccagccccagcgtgagcagcaccaccagccagagcagcaccttcagcagccaggcccccgaccccaaggtgaccagcatgttcgagctgagcggccccttcagacagcagcacttcctggccggcctgctgctgaccgagctggccctggccctggagcccgaggccgagggcgccttcctgctgcacaagaaggccatcagcgccgtgcacagcctgctgtgcggccacgacaccgaccccagatacgccgaggccaccgtgaaggccagagtggccgagctgtacctgcccctgctgagcatcgccagagacaccctgcccagactgcacgacttcgccgagggccccggccagagaagcagactggccagcatgctggacagcgacaccgagggcgagggcgacatcgccggcaccatcaaccccagcgtggccatggccatcgccggcggccccctggcccccggcagcagagccagcatcagccagggcccccccaccgccagcagagccggctgcgccctgagcgccgagagcagcagaaccctgctggcctgcgtgctgtgggtgctgaagaacaccgagcccgccctgctgcagagatgggccaccgacctgaccctgccccagctgggcagactgctggacctgctgtacctgtgcctggccgccttcgagtacaagggcaagaaggccttcgagagaatcaacagcctgaccttcaagaagagcctggacatgaaggccagactggaggaggccatcctgggcaccatcggcgccagacaggagatggtgagaagaagcagagagagaagccccttcggcaaccccgagaacgtgagatggagaaagagcgtgacccactggaagcagaccagcgacagagtggacaagaccaaggacgagatggagcacgaggccctggtggagggcaacctggccaccgaggccagcctggtggtgctggacaccctggagatcatcgtgcagaccgtgatgctgagcgaggccagagagagcgtgctgggcgccgtgctgaaggtggtgctgtacagcctgggcagcgcccagagcgccctgttcctgcagcacggcctggccacccagagagccctggtgagcaagttccccgagctgctgttcgaggaggacaccgagctgtgcgccgacctgtgcctgagactgctgagacactgcggcagcagaatcagcaccatcagaacccacgccagcgccagcctgtacctgctgatgagacagaacttcgagatcggccacaacttcgccagagtgaagatgcaggtgaccatgagcctgagcagcctggtgggcaccacccagaacttcagcgaggagcacctgagaagaagcctgaagaccatcctgacctacgccgaggaggacatgggcctgagagacagcaccttcgccgagcaggtgcaggacctgatgttcaacctgcacatgatcctgaccgacaccgtgaagatgaaggagcaccaggaggaccccgagatgctgatcgacctgatgtacagaatcgccagaggctaccagggcagccccgacctgagactgacctggctgcagaacatggccggcaagcacgccgagctgggcaaccacgccgaggccgcccagtgcatggtgcacgccgccgccctggtggccgagtacctggccctgctggaggaccacagacacctgcccgtgggctgcgtgagcttccagaacatcagcagcaacgtgctggaggagagcgccatcagcgacgacatcctgagccccgacgaggagggcttctgcagcggcaagcacttcaccgagctgggcctggtgggcctgctggagcaggccgccggctacttcaccatgggcggcctgtacgaggccgtgaacgaggtgtacaagaacctgatccccatcctggaggcccacagagactacaagaagctggccgccgtgcacggcaagctgcaggaggccttcaccaagatcatgcaccagagcagcggctgggagagagtgttcggcacctacttcagagtgggcttctacggcgcccacttcggcgacctggacgagcaggagttcgtgtacaaggagcccagcatcaccaagctggccgagatcagccacagactggaggagttctacaccgagagattcggcgacgacgtggtggagatcatcaaggacagcaaccccgtggacaagagcaagctggacagccagaaggcctacatccagatcacctacgtggagccctacttcgacacctacgagctgaaggacagagtgacctacttcgacagaaactacggcctgagaaccttcctgttctgcacccccttcacccccgacggcagagcccacggcgagctgcccgagcagcacaagagaaagaccctgctgagcaccgaccacgccttcccctacatcaagaccagaatcagagtgtgccacagagaggagaccgtgctgacccccgtggaggtggccatcgaggacatgcagaagaagaccagagagctggccttcgccaccgagcaggacccccccgacgccaagatgctgcagatggtgctgcagggcagcgtgggccccaccgtgaaccagggccccctggaggtggcccaggtgttcctggccgagatccccgaggaccccaagctgttcagacaccacaacaagctgagactgtgcttcaaggacttctgcaagaagtgcgaggacgccctgagaaagaacaaggccctgatcggccccgaccagaaggagtaccacagagagctggagagaaactactgcagactgagagaggccctgcagcccctgctgacccagagactgccccagctgatggcccccaccccccccggcctgagaaacagcctgaacagagccagcttcagaaaggccgacctgtag

SEQ ID NO: 78864 - DNA, 5973 bp, Artificial Sequence
  Description of Artificial Sequence: Synthetic coding sequence
atggccaccctgcccagcgccgagagaagagccttcgccctgaagatcaacagatacagcagcgccgagatcagaaagcagttcaccctgccccccaacctgggccagtaccacagacagagcatcagcaccagcggcttccccagcctgcagctgccccagttctacgaccccgtggagcccgtggacttcgagggcctgctgatgacccacctgaacagcctggacgtgcagctggcccaggagctgggcgacttcaccgacgacgacctggacgtggtgttcacccccaaggagtgcagaaccctgcagcccagcctgcccgaggagggcgtggagctggacccccacgtgagagactgcgtgcagacctacatcagagagtggctgatcgtgaacagaaagaaccagggcagccccgagatctgcggcttcaagaagaccggcagcagaaaggacttccacaagaccctgcccaagcagaccttcgagagcgagaccctggagtgcagcgagcccgccgcccaggccggccccagacacctgaacgtgctgtgcgacgtgagcggcaagggccccgtgaccgcctgcgacttcgacctgagaagcctgcagcccgacaagagactggagaacctgctgcagcaggtgagcgccgaggacttcgagaagcagaacgaggaggccagaagaaccaacagacaggccgagctgttcgccctgtaccccagcgtggacgaggaggacgccgtggagatcagacccgtgcccgagtgccccaaggagcacctgggcaacagaatcctggtgaagctgctgaccctgaagttcgagatcgagatcgagcccctgttcgccagcatcgccctgtacgacgtgaaggagagaaagaagatcagcgagaacttccactgcgacctgaacagcgaccagttcaagggcttcctgagagcccacacccccagcgtggccgccagcagccaggccagaagcgccgtgttcagcgtgacctaccccagcagcgacatctacctggtggtgaagatcgagaaggtgctgcagcagggcgagatcggcgactgcgccgagccctacaccgtgatcaaggagagcgacggcggcaagagcaaggagaagatcgagaagctgaagctgcaggccgagagcttctgccagagactgggcaagtacagaatgcccttcgcctgggcccccatcagcctgagcagcttcttcaacgtgagcaccctggagagagaggtgaccgacgtggacagcgtggtgggcagaagcagcgtgggcgagagaagaaccctggcccagagcagaagactgagcgagagagccctgagcctggaggagaacggcgtgggcagcaacttcaagaccagcaccctgagcgtgagcagcttcttcaagcaggagggcgacagactgagcgacgaggacctgttcaagttcctggccgactacaagagaagcagcagcctgcagagaagagtgaagagcatccccggcctgctgagactggagatcagcaccgcccccgagatcatcaactgctgcctgacccccgagatgctgcccgtgaagcccttccccgagaacagaaccagaccccacaaggagatcctggagttccccaccagagaggtgtacgtgccccacaccgtgtacagaaacctgctgtacgtgtacccccagagactgaacttcgtgaacaagctggccagcgccagaaacatcaccatcaagatccagttcatgtgcggcgaggacgccagcaacgccatgcccgtgatcttcggcaagagcagcggccccgagttcctgcaggaggtgtacaccgccgtgacctaccacaacaagagccccgacttctacgaggaggtgaagatcaagctgcccgccaagctgaccgtgaaccaccacctgctgttcaccttctaccacatcagctgccagcagaagcagggcgccagcgtggagaccctgctgggctacagctggctgcccatcctgctgaacgagagactgcagaccggcagctactgcctgcccgtggccctggagaagctgccccccaactacagcatgcacagcgccgagaaggtgcccctgcagaacccccccatcaagtgggccgagggccacaagggcgtgttcaacatcgaggtgcaggccgtgagcagcgtgcacacccaggacaaccacctggagaagttcttcaccctgtgccacagcctggagagccaggtgaccttccccatcagagtgctggaccagaagatcagcgagatggccctggagcacgagctgaagctgagcatcatctgcctgaacagcagcagactggagcccctggtgctgttcctgcacctggtgctggacaagctgttccagctgagcgtgcagcccatggtgatcgccggccagaccgccaacttcagccagttcgccttcgagagcgtggtggccatcgccaacagcctgcacaacagcaaggacctgagcaaggaccagcacggcagaaactgcctgctggccagctacgtgcactacgtgttcagactgcccgaggtgcagagagacgtgcccaagagcggcgcccccaccgccctgctggaccccagaagctaccacacctacggcagaaccagcgccgccgccgtgagcagcaagctgctgcaggccagagtgatgagcagcagcaaccccgacctggccggcacccacagcgccgccgacgaggaggtgaagaacatcatgagcagcaagcacttccacgaggagctggccctgcagatggtggtgagcaccggcatggtgagagagaccgtgttcaagtacgcctggttcttcttcgagctgctggtgaagagcatggcccagcacgtgcacaacatggacaagagagacagcttcagaagaaccagattcagcgacagattcatggacgacatcaccaccatcgtgaacgtggtgaccagcgagatcgccgccctgctggtgaagccccagaaggagaacgagcaggccgagaagatgaacatcagcctggccttcttcctgtacgacctgctgagcctgatggacagaggcttcgtgttcaacctgatcagacactactgcagccagctgagcgccaagctgagcaacctgcccaccctgatcagcatgagactggagttcctgagaatcctgtgcagccacgagcactacctgaacctgaacctgttcttcatgaacgccgacaccgcccccaccagcccctgccccagcatcagcagccagaacagcagcagctgcagcagcttccaggaccagaagatcgccagcatgttcgacctgaccagcgagtacagacagcagcacttcctgaccggcctgctgttcaccgagctggccgccgccctggacgccgagggcgagggcatcagcaaggtgcagagaaaggccgtgagcgccatccacagcctgctgagcagccacgacctggaccccagatgcgtgaagcccgaggtgaaggtgaagatcgccgccctgtacctgcccctggtgggcatcatcctggacgccctgccccagctgtgcgacttcaccgtggccgacaccagaagatacagaaccagcggcagcgacgaggagcaggagggcgccggcgccatcaaccagaacgtggccctggccatcgccggcaacaacttcaacctgaagaccagcggcatcgtgctgagcagcctgccctacaagcagtacaacatgctgaacgccgacaccaccagaaacctgatgatctgcttcctgtggatcatgaagaacgccgaccagagcctgatcagaaagtggatcgccgacctgcccagcacccagctgaacagaatcctggacctgctgttcatctgcgtgctgtgcttcgagtacaagggcaagcagagcagcgacaaggtgagcacccaggtgctgcagaagagcagagacgtgaaggccagactggaggaggccctgctgagaggcgagggcgccagaggcgagatgatgagaagaagagcccccggcaacgacagattccccggcctgaacgagaacctgagatggaagaaggagcagacccactggagacaggccaacgagaagctggacaagaccaaggccgagctggaccaggaggccctgatcagcggcaacctggccaccgaggcccacctgatcatcctggacatgcaggagaacatcatccaggccagcagcgccctggactgcaaggacagcctgctgggcggcgtgctgagagtgctggtgaacagcctgaactgcgaccagagcaccacctacctgacccactgcttcgccaccctgagagccctgatcgccaagttcggcgacctgctgttcgaggaggaggtggagcagtgcttcgacctgtgccaccaggtgctgcaccactgcagcagcagcatggacgtgaccagaagccaggcctgcgccaccctgtacctgctgatgagattcagcttcggcgccaccagcaacttcgccagagtgaagatgcaggtgaccatgagcctggccagcctggtgggcagagcccccgacttcaacgaggagcacctgagaagaagcctgagaaccatcctggcctacagcgaggaggacaccgccatgcagatgacccccttccccacccaggtggaggagctgctgtgcaacctgaacagcatcctgtacgacaccgtgaagatgagagagttccaggaggaccccgagatgctgatggacctgatgtacagaatcgccaagagctaccaggccagccccgacctgagactgacctggctgcagaacatggccgagaagcacaccaagaagaagtgctacaccgaggccgccatgtgcctggtgcacgccgccgccctggtggccgagtacctgagcatgctggaggaccacagctacctgcccgtgggcagcgtgagcttccagaacatcagcagcaacgtgctggaggagagcgtggtgagcgaggacaccctgagccccgacgaggacggcgtgtgcgccggccagtacttcaccgagagcggcctggtgggcctgctggagcaggccgccgagctgttcagcaccggcggcctgtacgagaccgtgaacgaggtgtacaagctggtgatccccatcctggaggcccacagagagttcagaaagctgaccctgacccacagcaagctgcagagagccttcgacagcatcgtgaacaaggaccacaagagaatgttcggcacctacttcagagtgggcttcttcggcagcaagttcggcgacctggacgagcaggagttcgtgtacaaggagcccgccatcaccaagctgcccgagatcagccacagactggaggccttctacggccagtgcttcggcgccgagttcgtggaggtgatcaaggacagcacccccgtggacaagaccaagctggaccccaacaaggcctacatccagatcaccttcgtggagccctacttcgacgagtacgagatgaaggacagagtgacctacttcgagaagaacttcaacctgagaagattcatgtacaccacccccttcaccctggagggcagacccagaggcgagctgcacgagcagtacagaagaaacaccgtgctgaccaccatgcacgccttcccctacatcaagaccagaatcagcgtgatccagaaggaggagttcgtgctgacccccatcgaggtggccatcgaggacatgaagaagaagaccctgcagctggccgtggccatcaaccaggagccccccgacgccaagatgctgcagatggtgctgcagggcagcgtgggcgccaccgtgaaccagggccccctggaggtggcccaggtgttcctggccgagatccccgccgaccccaagctgtacagacaccacaacaagctgagactgtgcttcaaggagttcatcatgtag

SEQ ID NO: 78865 - DNA, 6096 bp, Artificial Sequence
  Description of Artificial Sequence: Synthetic coding sequence
atgacccacctgaacagcctggacgtgcagctggcccaggagctgggcgacttcaccgacgacgacctggacgtggtgttcacccccaaggagtgcagaaccctgcagcccagcctgcccgaggagggcgtggagctggacccccacgtgagagactgcgtgcagacctacatcagagagtggctgatcgtgaacagaaagaaccagggcagccccgagatctgcggcttcaagaagaccggcagcagaaaggacttccacaagaccctgcccaagcagaccttcgagagcgagaccctggagtgcagcgagcccgccgcccaggccggccccagacacctgaacgtgctgtgcgacgtgagcggcaagggccccgtgaccgcctgcgacttcgacctgagaagcctgcagcccgacaagagactggagaacctgctgcagcaggtgagcgccgaggacttcgagaagcagaacgaggaggccagaagaaccaacagacaggccgagctgttcgccctgtaccccagcgtggacgaggaggacgccgtggagatcagacccgtgcccgagtgccccaaggagcacctgggcaacagaatcctggtgaagctgctgaccctgaagttcgagatcgagatcgagcccctgttcgccagcatcgccctgtacgacgtgaaggagagaaagaagatcagcgagaacttccactgcgacctgaacagcgaccagttcaagggcttcctgagagcccacacccccagcgtggccgccagcagccaggccagaagcgccgtgttcagcgtgacctaccccagcagcgacatctacctggtggtgaagatcgagaaggtgctgcagcagggcgagatcggcgactgcgccgagccctacaccgtgatcaaggagagcgacggcggcaagagcaaggagaagatcgagaagctgaagctgcaggccgagagcttctgccagagactgggcaagtacagaatgcccttcgcctgggcccccatcagcctgagcagcttcttcaacgtgagcaccctggagagagaggtgaccgacgtggacagcgtggtgggcagaagcagcgtgggcgagagaagaaccctggcccagagcagaagactgagcgagagagccctgagcctggaggagaacggcgtgggcagcaacttcaagaccagcaccctgagcgtgagcagcttcttcaagcaggagggcgacagactgagcgacgaggacctgttcaagttcctggccgactacaagagaagcagcagcctgcagagaagagtgaagagcatccccggcctgctgagactggagatcagcaccgcccccgagatcatcaactgctgcctgacccccgagatgctgcccgtgaagcccttccccgagaacagaaccagaccccacaaggagatcctggagttccccaccagagaggtgtacgtgccccacaccgtgtacagaaacctgctgtacgtgtacccccagagactgaacttcgtgaacaagctggccagcgccagaaacatcaccatcaagatccagttcatgtgcggcgaggacgccagcaacgccatgcccgtgatcttcggcaagagcagcggccccgagttcctgcaggaggtgtacaccgccgtgacctaccacaacaagagccccgacttctacgaggaggtgaagatcaagctgcccgccaagctgaccgtgaaccaccacctgctgttcaccttctaccacatcagctgccagcagaagcagggcgccagcgtggagaccctgctgggctacagctggctgcccatcctgctgaacgagagactgcagaccggcagctactgcctgcccgtggccctggagaagctgccccccaactacagcatgcacagcgccgagaaggtgcccctgcagaacccccccatcaagtgggccgagggccacaagggcgtgttcaacatcgaggtgcaggccgtgagcagcgtgcacacccaggacaaccacctggagaagttcttcaccctgtgccacagcctggagagccaggtgaccttccccatcagagtgctggaccagaagatcagcgagatggccctggagcacgagctgaagctgagcatcatctgcctgaacagcagcagactggagcccctggtgctgttcctgcacctggtgctggacaagctgttccagctgagcgtgcagcccatggtgatcgccggccagaccgccaacttcagccagttcgccttcgagagcgtggtggccatcgccaacagcctgcacaacagcaaggacctgagcaaggaccagcacggcagaaactgcctgctggccagctacgtgcactacgtgttcagactgcccgaggtgcagagagacgtgcccaagagcggcgcccccaccgccctgctggaccccagaagctaccacacctacggcagaaccagcgccgccgccgtgagcagcaagctgctgcaggccagagtgatgagcagcagcaaccccgacctggccggcacccacagcgccgccgacgaggaggtgaagaacatcatgagcagcaagatcgccgacagaaactgcagcagaatgagctactactgcagcggcagcagcgacgcccccagcagccccgccgcccccagacccgccagcaagaagcacttccacgaggagctggccctgcagatggtggtgagcaccggcatggtgagagagaccgtgttcaagtacgcctggttcttcttcgagctgctggtgaagagcatggcccagcacgtgcacaacatggacaagagagacagcttcagaagaaccagattcagcgacagattcatggacgacatcaccaccatcgtgaacgtggtgaccagcgagatcgccgccctgctggtgaagccccagaaggagaacgagcaggccgagaagatgaacatcagcctggccttcttcctgtacgacctgctgagcctgatggacagaggcttcgtgttcaacctgatcagacactactgcagccagctgagcgccaagctgagcaacctgcccaccctgatcagcatgagactggagttcctgagaatcctgtgcagccacgagcactacctgaacctgaacctgttcttcatgaacgccgacaccgcccccaccagcccctgccccagcatcagcagccagaacagcagcagctgcagcagcttccaggaccagaagatcgccagcatgttcgacctgaccagcgagtacagacagcagcacttcctgaccggcctgctgttcaccgagctggccgccgccctggacgccgagggcgagggcatcagcaaggtgcagagaaaggccgtgagcgccatccacagcctgctgagcagccacgacctggaccccagatgcgtgaagcccgaggtgaaggtgaagatcgccgccctgtacctgcccctggtgggcatcatcctggacgccctgccccagctgtgcgacttcaccgtggccgacaccagaagatacagaaccagcggcagcgacgaggagcaggagggcgccggcgccatcaaccagaacgtggccctggccatcgccggcaacaacttcaacctgaagaccagcggcatcgtgctgagcagcctgccctacaagcagtacaacatgctgaacgccgacaccaccagaaacctgatgatctgcttcctgtggatcatgaagaacgccgaccagagcctgatcagaaagtggatcgccgacctgcccagcacccagctgaacagaatcctggacctgctgttcatctgcgtgctgtgcttcgagtacaagggcaagcagagcagcgacaaggtgagcacccaggtgctgcagaagagcagagacgtgaaggccagactggaggaggccctgctgagaggcgagggcgccagaggcgagatgatgagaagaagagcccccggcaacgacagattccccggcctgaacgagaacctgagatggaagaaggagcagacccactggagacaggccaacgagaagctggacaagaccaaggccgagctggaccaggaggccctgatcagcggcaacctggccaccgaggcccacctgatcatcctggacatgcaggagaacatcatccaggccagcagcgccctggactgcaaggacagcctgctgggcggcgtgctgagagtgctggtgaacagcctgaactgcgaccagagcaccacctacctgacccactgcttcgccaccctgagagccctgatcgccaagttcggcgacctgctgttcgaggaggaggtggagcagtgcttcgacctgtgccaccaggtgctgcaccactgcagcagcagcatggacgtgaccagaagccaggcctgcgccaccctgtacctgctgatgagattcagcttcggcgccaccagcaacttcgccagagtgaagatgcaggtgaccatgagcctggccagcctggtgggcagagcccccgacttcaacgaggagcacctgagaagaagcctgagaaccatcctggcctacagcgaggaggacaccgccatgcagatgacccccttccccacccaggtggaggagctgctgtgcaacctgaacagcatcctgtacgacaccgtgaagatgagagagttccaggaggaccccgagatgctgatggacctgatgtacagaatcgccaagagctaccaggccagccccgacctgagactgacctggctgcagaacatggccgagaagcacaccaagaagaagtgctacaccgaggccgccatgtgcctggtgcacgccgccgccctggtggccgagtacctgagcatgctggaggaccacagctacctgcccgtgggcagcgtgagcttccagaacatcagcagcaacgtgctggaggagagcgtggtgagcgaggacaccctgagccccgacgaggacggcgtgtgcgccggccagtacttcaccgagagcggcctggtgggcctgctggagcaggccgccgagctgttcagcaccggcggcctgtacgagaccgtgaacgaggtgtacaagctggtgatccccatcctggaggcccacagagagttcagaaagctgaccctgacccacagcaagctgcagagagccttcgacagcatcgtgaacaaggaccacaagagaatgttcggcacctacttcagagtgggcttcttcggcagcaagttcggcgacctggacgagcaggagttcgtgtacaaggagcccgccatcaccaagctgcccgagatcagccacagactggaggccttctacggccagtgcttcggcgccgagttcgtggaggtgatcaaggacagcacccccgtggacaagaccaagctggaccccaacaaggcctacatccagatcaccttcgtggagccctacttcgacgagtacgagatgaaggacagagtgacctacttcgagaagaacttcaacctgagaagattcatgtacaccacccccttcaccctggagggcagacccagaggcgagctgcacgagcagtacagaagaaacaccgtgctgaccaccatgcacgccttcccctacatcaagaccagaatcagcgtgatccagaaggaggagttcgtgctgacccccatcgaggtggccatcgaggacatgaagaagaagaccctgcagctggccgtggccatcaaccaggagccccccgacgccaagatgctgcagatggtgctgcagggcagcgtgggcgccaccgtgaaccagggccccctggaggtggcccaggtgttcctggccgagatccccgccgaccccaagctgtacagacaccacaacaagctgagactgtgcttcaaggagttcatcatgagatgcggcgaggccgtggagaagaacaagagactgatcaccgccgaccagagagagtaccagcaggagctgaagaagaactacaacaagctgaaggagaacctgagacccatgatcgagagaaagatccccgagctgtacaagcccatcttcagagtggagagccagaagagagacagcttccacagaagcagcttcagaaagtgcgagacccagctgagccagggcagctag

SEQ ID NO: 78866 - DNA, 6300 bp, Artificial Sequence
  Description of Artificial Sequence: Synthetic coding sequence
atggccaccctgcccagcgccgagagaagagccttcgccctgaagatcaacagatacagcagcgccgagatcagaaagcagttcaccctgccccccaacctgggccagtaccacagacagagcatcagcaccagcggcttccccagcctgcagctgccccagttctacgaccccgtggagcccgtggacttcgagggcctgctgatgacccacctgaacagcctggacgtgcagctggcccaggagctgggcgacttcaccgacgacgacctggacgtggtgttcacccccaaggagtgcagaaccctgcagcccagcctgcccgaggagggcgtggagctggacccccacgtgagagactgcgtgcagacctacatcagagagtggctgatcgtgaacagaaagaaccagggcagccccgagatctgcggcttcaagaagaccggcagcagaaaggacttccacaagaccctgcccaagcagaccttcgagagcgagaccctggagtgcagcgagcccgccgcccaggccggccccagacacctgaacgtgctgtgcgacgtgagcggcaagggccccgtgaccgcctgcgacttcgacctgagaagcctgcagcccgacaagagactggagaacctgctgcagcaggtgagcgccgaggacttcgagaagcagaacgaggaggccagaagaaccaacagacaggccgagctgttcgccctgtaccccagcgtggacgaggaggacgccgtggagatcagacccgtgcccgagtgccccaaggagcacctgggcaacagaatcctggtgaagctgctgaccctgaagttcgagatcgagatcgagcccctgttcgccagcatcgccctgtacgacgtgaaggagagaaagaagatcagcgagaacttccactgcgacctgaacagcgaccagttcaagggcttcctgagagcccacacccccagcgtggccgccagcagccaggccagaagcgccgtgttcagcgtgacctaccccagcagcgacatctacctggtggtgaagatcgagaaggtgctgcagcagggcgagatcggcgactgcgccgagccctacaccgtgatcaaggagagcgacggcggcaagagcaaggagaagatcgagaagctgaagctgcaggccgagagcttctgccagagactgggcaagtacagaatgcccttcgcctgggcccccatcagcctgagcagcttcttcaacgtgagcaccctggagagagaggtgaccgacgtggacagcgtggtgggcagaagcagcgtgggcgagagaagaaccctggcccagagcagaagactgagcgagagagccctgagcctggaggagaacggcgtgggcagcaacttcaagaccagcaccctgagcgtgagcagcttcttcaagcaggagggcgacagactgagcgacgaggacctgttcaagttcctggccgactacaagagaagcagcagcctgcagagaagagtgaagagcatccccggcctgctgagactggagatcagcaccgcccccgagatcatcaactgctgcctgacccccgagatgctgcccgtgaagcccttccccgagaacagaaccagaccccacaaggagatcctggagttccccaccagagaggtgtacgtgccccacaccgtgtacagaaacctgctgtacgtgtacccccagagactgaacttcgtgaacaagctggccagcgccagaaacatcaccatcaagatccagttcatgtgcggcgaggacgccagcaacgccatgcccgtgatcttcggcaagagcagcggccccgagttcctgcaggaggtgtacaccgccgtgacctaccacaacaagagccccgacttctacgaggaggtgaagatcaagctgcccgccaagctgaccgtgaaccaccacctgctgttcaccttctaccacatcagctgccagcagaagcagggcgccagcgtggagaccctgctgggctacagctggctgcccatcctgctgaacgagagactgcagaccggcagctactgcctgcccgtggccctggagaagctgccccccaactacagcatgcacagcgccgagaaggtgcccctgcagaacccccccatcaagtgggccgagggccacaagggcgtgttcaacatcgaggtgcaggccgtgagcagcgtgcacacccaggacaaccacctggagaagttcttcaccctgtgccacagcctggagagccaggtgaccttccccatcagagtgctggaccagaagatcagcgagatggccctggagcacgagctgaagctgagcatcatctgcctgaacagcagcagactggagcccctggtgctgttcctgcacctggtgctggacaagctgttccagctgagcgtgcagcccatggtgatcgccggccagaccgccaacttcagccagttcgccttcgagagcgtggtggccatcgccaacagcctgcacaacagcaaggacctgagcaaggaccagcacggcagaaactgcctgctggccagctacgtgcactacgtgttcagactgcccgaggtgcagagagacgtgcccaagagcggcgcccccaccgccctgctggaccccagaagctaccacacctacggcagaaccagcgccgccgccgtgagcagcaagctgctgcaggccagagtgatgagcagcagcaaccccgacctggccggcacccacagcgccgccgacgaggaggtgaagaacatcatgagcagcaagatcgccgacagaaactgcagcagaatgagctactactgcagcggcagcagcgacgcccccagcagccccgccgcccccagacccgccagcaagaagcacttccacgaggagctggccctgcagatggtggtgagcaccggcatggtgagagagaccgtgttcaagtacgcctggttcttcttcgagctgctggtgaagagcatggcccagcacgtgcacaacatggacaagagagacagcttcagaagaaccagattcagcgacagattcatggacgacatcaccaccatcgtgaacgtggtgaccagcgagatcgccgccctgctggtgaagccccagaaggagaacgagcaggccgagaagatgaacatcagcctggccttcttcctgtacgacctgctgagcctgatggacagaggcttcgtgttcaacctgatcagacactactgcagccagctgagcgccaagctgagcaacctgcccaccctgatcagcatgagactggagttcctgagaatcctgtgcagccacgagcactacctgaacctgaacctgttcttcatgaacgccgacaccgcccccaccagcccctgccccagcatcagcagccagaacagcagcagctgcagcagcttccaggaccagaagatcgccagcatgttcgacctgaccagcgagtacagacagcagcacttcctgaccggcctgctgttcaccgagctggccgccgccctggacgccgagggcgagggcatcagcaaggtgcagagaaaggccgtgagcgccatccacagcctgctgagcagccacgacctggaccccagatgcgtgaagcccgaggtgaaggtgaagatcgccgccctgtacctgcccctggtgggcatcatcctggacgccctgccccagctgtgcgacttcaccgtggccgacaccagaagatacagaaccagcggcagcgacgaggagcaggagggcgccggcgccatcaaccagaacgtggccctggccatcgccggcaacaacttcaacctgaagaccagcggcatcgtgctgagcagcctgccctacaagcagtacaacatgctgaacgccgacaccaccagaaacctgatgatctgcttcctgtggatcatgaagaacgccgaccagagcctgatcagaaagtggatcgccgacctgcccagcacccagctgaacagaatcctggacctgctgttcatctgcgtgctgtgcttcgagtacaagggcaagcagagcagcgacaaggtgagcacccaggtgctgcagaagagcagagacgtgaaggccagactggaggaggccctgctgagaggcgagggcgccagaggcgagatgatgagaagaagagcccccggcaacgacagattccccggcctgaacgagaacctgagatggaagaaggagcagacccactggagacaggccaacgagaagctggacaagaccaaggccgagctggaccaggaggccctgatcagcggcaacctggccaccgaggcccacctgatcatcctggacatgcaggagaacatcatccaggccagcagcgccctggactgcaaggacagcctgctgggcggcgtgctgagagtgctggtgaacagcctgaactgcgaccagagcaccacctacctgacccactgcttcgccaccctgagagccctgatcgccaagttcggcgacctgctgttcgaggaggaggtggagcagtgcttcgacctgtgccaccaggtgctgcaccactgcagcagcagcatggacgtgaccagaagccaggcctgcgccaccctgtacctgctgatgagattcagcttcggcgccaccagcaacttcgccagagtgaagatgcaggtgaccatgagcctggccagcctggtgggcagagcccccgacttcaacgaggagcacctgagaagaagcctgagaaccatcctggcctacagcgaggaggacaccgccatgcagatgacccccttccccacccaggtggaggagctgctgtgcaacctgaacagcatcctgtacgacaccgtgaagatgagagagttccaggaggaccccgagatgctgatggacctgatgtacagaatcgccaagagctaccaggccagccccgacctgagactgacctggctgcagaacatggccgagaagcacaccaagaagaagtgctacaccgaggccgccatgtgcctggtgcacgccgccgccctggtggccgagtacctgagcatgctggaggaccacagctacctgcccgtgggcagcgtgagcttccagaacatcagcagcaacgtgctggaggagagcgtggtgagcgaggacaccctgagccccgacgaggacggcgtgtgcgccggccagtacttcaccgagagcggcctggtgggcctgctggagcaggccgccgagctgttcagcaccggcggcctgtacgagaccgtgaacgaggtgtacaagctggtgatccccatcctggaggcccacagagagttcagaaagctgaccctgacccacagcaagctgcagagagccttcgacagcatcgtgaacaaggaccacaagagaatgttcggcacctacttcagagtgggcttcttcggcagcaagttcggcgacctggacgagcaggagttcgtgtacaaggagcccgccatcaccaagctgcccgagatcagccacagactggaggccttctacggccagtgcttcggcgccgagttcgtggaggtgatcaaggacagcacccccgtggacaagaccaagctggaccccaacaaggcctacatccagatcaccttcgtggagccctacttcgacgagtacgagatgaaggacagagtgacctacttcgagaagaacttcaacctgagaagattcatgtacaccacccccttcaccctggagggcagacccagaggcgagctgcacgagcagtacagaagaaacaccgtgctgaccaccatgcacgccttcccctacatcaagaccagaatcagcgtgatccagaaggaggagttcgtgctgacccccatcgaggtggccatcgaggacatgaagaagaagaccctgcagctggccgtggccatcaaccaggagccccccgacgccaagatgctgcagatggtgctgcagggcagcgtgggcgccaccgtgaaccagggccccctggaggtggcccaggtgttcctggccgagatccccgccgaccccaagctgtacagacaccacaacaagctgagactgtgcttcaaggagttcatcatgagatgcggcgaggccgtggagaagaacaagagactgatcaccgccgaccagagagagtaccagcaggagctgaagaagaactacaacaagctgaaggagaacctgagacccatgatcgagagaaagatccccgagctgtacaagcccatcttcagagtggagagccagaagagagacagcttccacagaagcagcttcagaaagtgcgagacccagctgagccagggcagctag

SEQ ID NO: 78867 - DNA, 6000 bp, Artificial Sequence
  Description of Artificial Sequence: Synthetic coding sequence
atgacccacctgaacagcctggacgtgcagctggcccaggagctgggcgacttcaccgacgacgacctggacgtggtgttcacccccaaggagtgcagaaccctgcagcccagcctgcccgaggagggcgtggagctggacccccacgtgagagactgcgtgcagacctacatcagagagtggctgatcgtgaacagaaagaaccagggcagccccgagatctgcggcttcaagaagaccggcagcagaaaggacttccacaagaccctgcccaagcagaccttcgagagcgagaccctggagtgcagcgagcccgccgcccaggccggccccagacacctgaacgtgctgtgcgacgtgagcggcaagggccccgtgaccgcctgcgacttcgacctgagaagcctgcagcccgacaagagactggagaacctgctgcagcaggtgagcgccgaggacttcgagaagcagaacgaggaggccagaagaaccaacagacaggccgagctgttcgccctgtaccccagcgtggacgaggaggacgccgtggagatcagacccgtgcccgagtgccccaaggagcacctgggcaacagaatcctggtgaagctgctgaccctgaagttcgagatcgagatcgagcccctgttcgccagcatcgccctgtacgacgtgaaggagagaaagaagatcagcgagaacttccactgcgacctgaacagcgaccagttcaagggcttcctgagagcccacacccccagcgtggccgccagcagccaggccagaagcgccgtgttcagcgtgacctaccccagcagcgacatctacctggtggtgaagatcgagaaggtgctgcagcagggcgagatcggcgactgcgccgagccctacaccgtgatcaaggagagcgacggcggcaagagcaaggagaagatcgagaagctgaagctgcaggccgagagcttctgccagagactgggcaagtacagaatgcccttcgcctgggcccccatcagcctgagcagcttcttcaacgtgagcaccctggagagagaggtgaccgacgtggacagcgtggtgggcagaagcagcgtgggcgagagaagaaccctggcccagagcagaagactgagcgagagagccctgagcctggaggagaacggcgtgggcagcaacttcaagaccagcaccctgagcgtgagcagcttcttcaagcaggagggcgacagactgagcgacgaggacctgttcaagttcctggccgactacaagagaagcagcagcctgcagagaagagtgaagagcatccccggcctgctgagactggagatcagcaccgcccccgagatcatcaactgctgcctgacccccgagatgctgcccgtgaagcccttccccgagaacagaaccagaccccacaaggagatcctggagttccccaccagagaggtgtacgtgccccacaccgtgtacagaaacctgctgtacgtgtacccccagagactgaacttcgtgaacaagctggccagcgccagaaacatcaccatcaagatccagttcatgtgcggcgaggacgccagcaacgccatgcccgtgatcttcggcaagagcagcggccccgagttcctgcaggaggtgtacaccgccgtgacctaccacaacaagagccccgacttctacgaggaggtgaagatcaagctgcccgccaagctgaccgtgaaccaccacctgctgttcaccttctaccacatcagctgccagcagaagcagggcgccagcgtggagaccctgctgggctacagctggctgcccatcctgctgaacgagagactgcagaccggcagctactgcctgcccgtggccctggagaagctgccccccaactacagcatgcacagcgccgagaaggtgcccctgcagaacccccccatcaagtgggccgagggccacaagggcgtgttcaacatcgaggtgcaggccgtgagcagcgtgcacacccaggacaaccacctggagaagttcttcaccctgtgccacagcctggagagccaggtgaccttccccatcagagtgctggaccagaagatcagcgagatggccctggagcacgagctgaagctgagcatcatctgcctgaacagcagcagactggagcccctggtgctgttcctgcacctggtgctggacaagctgttccagctgagcgtgcagcccatggtgatcgccggccagaccgccaacttcagccagttcgccttcgagagcgtggtggccatcgccaacagcctgcacaacagcaaggacctgagcaaggaccagcacggcagaaactgcctgctggccagctacgtgcactacgtgttcagactgcccgaggtgcagagagacgtgcccaagagcggcgcccccaccgccctgctggaccccagaagctaccacacctacggcagaaccagcgccgccgccgtgagcagcaagctgctgcaggccagagtgatgagcagcagcaaccccgacctggccggcacccacagcgccgccgacgaggaggtgaagaacatcatgagcagcaagcacttccacgaggagctggccctgcagatggtggtgagcaccggcatggtgagagagaccgtgttcaagtacgcctggttcttcttcgagctgctggtgaagagcatggcccagcacgtgcacaacatggacaagagagacagcttcagaagaaccagattcagcgacagattcatggacgacatcaccaccatcgtgaacgtggtgaccagcgagatcgccgccctgctggtgaagccccagaaggagaacgagcaggccgagaagatgaacatcagcctggccttcttcctgtacgacctgctgagcctgatggacagaggcttcgtgttcaacctgatcagacactactgcagccagctgagcgccaagctgagcaacctgcccaccctgatcagcatgagactggagttcctgagaatcctgtgcagccacgagcactacctgaacctgaacctgttcttcatgaacgccgacaccgcccccaccagcccctgccccagcatcagcagccagaacagcagcagctgcagcagcttccaggaccagaagatcgccagcatgttcgacctgaccagcgagtacagacagcagcacttcctgaccggcctgctgttcaccgagctggccgccgccctggacgccgagggcgagggcatcagcaaggtgcagagaaaggccgtgagcgccatccacagcctgctgagcagccacgacctggaccccagatgcgtgaagcccgaggtgaaggtgaagatcgccgccctgtacctgcccctggtgggcatcatcctggacgccctgccccagctgtgcgacttcaccgtggccgacaccagaagatacagaaccagcggcagcgacgaggagcaggagggcgccggcgccatcaaccagaacgtggccctggccatcgccggcaacaacttcaacctgaagaccagcggcatcgtgctgagcagcctgccctacaagcagtacaacatgctgaacgccgacaccaccagaaacctgatgatctgcttcctgtggatcatgaagaacgccgaccagagcctgatcagaaagtggatcgccgacctgcccagcacccagctgaacagaatcctggacctgctgttcatctgcgtgctgtgcttcgagtacaagggcaagcagagcagcgacaaggtgagcacccaggtgctgcagaagagcagagacgtgaaggccagactggaggaggccctgctgagaggcgagggcgccagaggcgagatgatgagaagaagagcccccggcaacgacagattccccggcctgaacgagaacctgagatggaagaaggagcagacccactggagacaggccaacgagaagctggacaagaccaaggccgagctggaccaggaggccctgatcagcggcaacctggccaccgaggcccacctgatcatcctggacatgcaggagaacatcatccaggccagcagcgccctggactgcaaggacagcctgctgggcggcgtgctgagagtgctggtgaacagcctgaactgcgaccagagcaccacctacctgacccactgcttcgccaccctgagagccctgatcgccaagttcggcgacctgctgttcgaggaggaggtggagcagtgcttcgacctgtgccaccaggtgctgcaccactgcagcagcagcatggacgtgaccagaagccaggcctgcgccaccctgtacctgctgatgagattcagcttcggcgccaccagcaacttcgccagagtgaagatgcaggtgaccatgagcctggccagcctggtgggcagagcccccgacttcaacgaggagcacctgagaagaagcctgagaaccatcctggcctacagcgaggaggacaccgccatgcagatgacccccttccccacccaggtggaggagctgctgtgcaacctgaacagcatcctgtacgacaccgtgaagatgagagagttccaggaggaccccgagatgctgatggacctgatgtacagaatcgccaagagctaccaggccagccccgacctgagactgacctggctgcagaacatggccgagaagcacaccaagaagaagtgctacaccgaggccgccatgtgcctggtgcacgccgccgccctggtggccgagtacctgagcatgctggaggaccacagctacctgcccgtgggcagcgtgagcttccagaacatcagcagcaacgtgctggaggagagcgtggtgagcgaggacaccctgagccccgacgaggacggcgtgtgcgccggccagtacttcaccgagagcggcctggtgggcctgctggagcaggccgccgagctgttcagcaccggcggcctgtacgagaccgtgaacgaggtgtacaagctggtgatccccatcctggaggcccacagagagttcagaaagctgaccctgacccacagcaagctgcagagagccttcgacagcatcgtgaacaaggaccacaagagaatgttcggcacctacttcagagtgggcttcttcggcagcaagttcggcgacctggacgagcaggagttcgtgtacaaggagcccgccatcaccaagctgcccgagatcagccacagactggaggccttctacggccagtgcttcggcgccgagttcgtggaggtgatcaaggacagcacccccgtggacaagaccaagctggaccccaacaaggcctacatccagatcaccttcgtggagccctacttcgacgagtacgagatgaaggacagagtgacctacttcgagaagaacttcaacctgagaagattcatgtacaccacccccttcaccctggagggcagacccagaggcgagctgcacgagcagtacagaagaaacaccgtgctgaccaccatgcacgccttcccctacatcaagaccagaatcagcgtgatccagaaggaggagttcgtgctgacccccatcgaggtggccatcgaggacatgaagaagaagaccctgcagctggccgtggccatcaaccaggagccccccgacgccaagatgctgcagatggtgctgcagggcagcgtgggcgccaccgtgaaccagggccccctggaggtggcccaggtgttcctggccgagatccccgccgaccccaagctgtacagacaccacaacaagctgagactgtgcttcaaggagttcatcatgagatgcggcgaggccgtggagaagaacaagagactgatcaccgccgaccagagagagtaccagcaggagctgaagaagaactacaacaagctgaaggagaacctgagacccatgatcgagagaaagatccccgagctgtacaagcccatcttcagagtggagagccagaagagagacagcttccacagaagcagcttcagaaagtgcgagacccagctgagccagggcagctag

SEQ ID NO: 78868 - DNA, 1182 bp, Artificial Sequence
  Description of Artificial Sequence: Synthetic coding sequence
atgaagagaaccagagacgaggtggacgccaccctgcagatcgccaagctgaacgccgccgagctgctgcccgccgtgcactgcctgggcttcggccccggcgccagcggcgccgccgccggcgacttctgcctgctggagctggagcccaccctgtgccagcagctggaggacggccacagcctggtgatcagaggcgacaaggacgagcaggccgtgctgtgcagcaaggacaagacctacgacctgaagatcgccgacaccagcaacatgctgctgttcatccccggctgcaagacccccgaccagctgaagaaggaggacagccactgcaacatcatccacaccgagatcttcggcttcagcaacaactactgggagctgagaagaagaagacccaagctgaagaagctgaagaagctgctgatggagaacccctacgagggccccgacagccagaaggagaaggacagcaacagcagcaagtacaccaccgaggacctgctggaccagatccaggccagcgaggaggagatcatgacccagctgcaggtgctgaacgcctgcaagatcggcggctactggagaatcctggagttcgactacgagatgaagctgctgaaccacgtgacccagctggtggacagcgagagctggagcttcggcaaggtgcccctgaacacctgcctgcaggagctgggccccctggagcccgaggagatgatcgagcactgcctgaagtgctacggcaagaagtacgtggacgagggcgaggtgtacttcgagctggacgccgacaagatctgcagagccgccgccagaatgctgctgcagaacgccgtgaagttcaacctggccgagttccaggaggtgtggcagcagagcgtgcccgagggcatggtgaccagcctggaccagctgaagggcctggccctggtggacagacacagcagacccgagatcatcttcctgctgaaggtggacgacctgcccgaggacaaccaggagagattcaacagcctgttcagcctgagagagaagtggaccgaggaggacatcgccccctacatccaggacctgtgcggcgagaagcagaccatcggcgccctgctgaccaagtacagccacagcagcatgcagaacggcgtgaaggtgtacaacagcagaagacccatcagctag

SEQ ID NO: 78869 - DNA, 342 bp, Artificial Sequence
  Description of Artificial Sequence: Synthetic coding sequence
atgagcgccagcgtggtgagcgtgatcagcagattcctggaggagtacctgagcagcaccccccagagactgaagctgctggacgcctacctgctgtacatcctgctgaccggcgccctgcagttcggctactgcctgctggtgggcaccttccccttcaacagcttcctgagcggcttcatcagctgcgtgggcagcttcatcctggccgtgtgcctgagaatccagatcaacccccagaacaaggccgacttccagggcatcagccccgagagagccttcgccgacttcctgttcgccagcaccatcctgcacctggtggtgatgaacttcgtgggctag

SEQ ID NO: 78870 - DNA, 285 bp, Artificial Sequence
  Description of Artificial Sequence: Synthetic coding sequence
atgagaaccctggccatcctggccgccatcctgctggtggccctgcaggcccaggccgagcccctgcaggccagagccgacgaggtggccgccgcccccgagcagatcgccgccgacatccccgaggtggtggtgagcctggcctgggacgagagcctggcccccaagcaccccggcagcagaaagaacatggcctgctactgcagaatccccgcctgcatcgccggcgagagaagatacggcacctgcatctaccagggcagactgtgggccttctgctgctag

SEQ ID NO: 78871 - DNA, 285 bp, Artificial Sequence; identical to SEQ ID NO: 78870
  Description of Artificial Sequence: Synthetic coding sequence

SEQ ID NO: 78872 - DNA, 294 bp, Artificial Sequence
  Description of Artificial Sequence: Synthetic coding sequence
atgagaatcatcgccctgctggccgccatcctgctggtggccctgcaggtgagagccggccccctgcaggccagaggcgacgaggcccccggccaggagcagagaggccccgaggaccaggacatcagcatcagcttcgcctgggacaagagcagcgccctgcaggtgagcggcagcaccagaggcatggtgtgcagctgcagactggtgttctgcagaagaaccgagctgagagtgggcaactgcctgatcggcggcgtgagcttcacctactgctgcaccagagtggactag

SEQ ID NO: 78873 - DNA, 285 bp, Artificial Sequence
  Description of Artificial Sequence: Synthetic coding sequence
atgagaaccatcgccatcctggccgccatcctgctggtggccctgcaggcccaggccgagagcctgcaggagagagccgacgaggccaccacccagaagcagagcggcgaggacaaccaggacctggccatcagcttcgccggcaacggcctgagcgccctgagaaccagcggcagccaggccagagccacctgctactgcagaaccggcagatgcgccaccagagagagcctgagcggcgtgtgcgagatcagcggcagactgtacagactgtgctgcagatag

SEQ ID NO: 78874 - DNA, 303 bp, Artificial Sequence
  Description of Artificial Sequence: Synthetic coding sequence
atgagaaccctgaccatcctgaccgccgtgctgctggtggccctgcaggccaaggccgagcccctgcaggccgaggacgaccccctgcaggccaaggcctacgaggccgacgcccaggagcagagaggcgccaacgaccaggacttcgccgtgagcttcgccgaggacgccagcagcagcctgagagccctgggcagcaccagagccttcacctgccactgcagaagaagctgctacagcaccgagtacagctacggcacctgcaccgtgatgggcatcaaccacagattctgctgcctgtag

SEQ ID NO: 78875 - DNA, 207 bp, Artificial Sequence
  Description of Artificial Sequence: Synthetic coding sequence
atgagaaccagctacctgctgctgttcaccctgtgcctgctgctgagcgagatggccagcggcggcaacttcctgaccggcctgggccacagaagcgaccactacaactgcgtgagcagcggcggccagtgcctgtacagcgcctgccccatcttcaccaagatccagggcacctgctacagaggcaaggccaagtgctgcaagtag

SEQ ID NO: 78876 - DNA, 372 bp, Artificial Sequence
  Description of Artificial Sequence: Synthetic coding sequence
atgaagctgctgctgctggccctgcccatgctggtgctgctgccccaggtgatccccgcctacagcggcgagaagaagtgctggaacagaagcggccactgcagaaagcagtgcaaggacggcgaggccgtgaaggacacctgcaagaacctgagagcctgctgcatccccagcaacgaggaccacagaagagtgcccgccaccagccccacccccctgagcgacagcacccccggcatcatcgacgacatcctgaccgtgagattcaccaccgactacttcgaggtgagcagcaagaaggacatggtggaggagagcgaggccggcagaggcaccgagaccagcctgcccaacgtgcaccacagcagctag

SEQ ID NO: 78877 - DNA, 1002 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaaggagaagctgcagaagcacggcgtgtgcatcagagtgctgggcgacctgcacctgctgcccctggacctgcaggagctgatcgcccaggccgtgcaggccaccaagaactacaacaagtgcttcctgaacgtgtgcttcgcctacaccagcagacacgagatcagcaacgccgtgagagagatggcctggggcgtggagcagggcctgctggaccccagcgacatcagcgagagcctgctggacaagtgcctgtacaccaacagaagcccccaccccgacatcctgatcagaaccagcggcgaggtgagactgagcgacttcctgctgtggcagaccagccacagctgcctggtgttccagcccgtgctgtggcccgagtacaccttctggaacctgttcgaggccatcctgcagttccagatgaaccacagcgtgctgcagaaggccagagacatgtacgccgaggagagaaagagacagcagctggagagagaccaggccaccgtgaccgagcagctgctgagagagggcctgcaggccagcggcgacgcccagctgagaagaaccagactgcacaagctgagcgccagaagagaggagagagtgcagggcttcctgcaggccctggagctgaagagagccgactggctggccagactgggcaccgccagcgcctag

SEQ ID NO: 78878 - DNA, 1005 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaaggagaagctgcagaagcacggcgtgtgcatcagagtgctgggcgacctgcacctgctgcccctggacctgcaggagctgatcgcccaggccgtgcaggccaccaagaactacaacaagtgcttcctgaacgtgtgcttcgcctacaccagcagacacgagatcagcaacgccgtgagagagatggcctggggcgtggagcagggcctgctggaccccagcgacatcagcgagagcctgctggacaagtgcctgtacaccaacagaagcccccaccccgacatcctgatcagaaccagcggcgaggtgagactgagcgacttcctgctgtggcagaccagccacagctgcctggtgttccagcccgtgctgtggcccgagtacaccttctggaacctgttcgaggccatcctgcagttccagatgaaccacagcgtgctgcagcagaaggccagagacatgtacgccgaggagagaaagagacagcagctggagagagaccaggccaccgtgaccgagcagctgctgagagagggcctgcaggccagcggcgacgcccagctgagaagaaccagactgcacaagctgagcgccagaagagaggagagagtgcagggcttcctgcaggccctggagctgaagagagccgactggctggccagactgggcaccgccagcgcctag

SEQ ID NO: 78879 - DNA, 516 bp, Artificial Sequence
  Description of Artificial Sequence: Synthetic coding sequence
atggacctggccagacagaagttcagcagactgatggaggagaaggagaagctgcagaagcacggcgtgtgcatcagagtgctgggcgacctgcacctgctgcccctggacctgcaggagctgatcgcccaggccgtgcaggccaccaagaactacaacaacgacatcagcgagagcctgctggacaagtgcctgtacaccaacagaagcccccaccccgacatcctgatcagaaccagcggcgaggtgagactgagcgacttcctgctgtggcagcagaaggccagagacatgtacgccgaggagagaaagagacagcagctggagagagaccaggccaccgtgaccgagcagctgctgagagagggcctgcaggccagcggcgacgcccagctgagaagaaccagactgcacaagctgagcgccagaagagaggagagagtgcagggcttcctgcaggccctggagctgaagagagccgactggctggccagactgggcaccgccagcgcctag

SEQ ID NO: 78880 - DNA, 501 bp, Artificial Sequence
  Description of Artificial Sequence: Synthetic coding sequence
atggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaaggagaagctgcagaagcacggcgtgtgcatcagagtgctgggcgacctgcacctgctgcccctggacctgcaggagctgatcgcccaggccgtgcaggccaccaagaactacaacaagtgcttcctgaacgtgtgcttcgcctacaccagcagacacgagatcagcaacgccgtgagagagatggcctggggcgtggagcagggcctgctggaccccagcagagacagattccaccacatcggccaggccagcctggagctgctgaccagctag

SEQ ID NO: 78881 - DNA, 546 bp, Artificial Sequence
  Description of Artificial Sequence: Synthetic coding sequence
atggaggagaaggagaagctgcagaagcacggcgtgtgcatcagagtgctgggcgacctgcacctgctgcccctggacctgcaggagctgatcgcccaggccgtgcaggccaccaagaactacaacaagtgcttcctgaacgtgtgcttcgcctacaccagcagacacgagatcagcaacgccgtgagagagatggcctggggcgtggagcagggcctgctggaccccagcgacatcagcgagagcctgctggacaagtgcctgtacaccaacagaagcccccaccccgacatcctgatcagaaccagcggcgaggtgagactgagcgacttcctgctgtggcagaccagccacagctgcctggtgttccagcccgtgctgtggcccgagtacaccttctggaacctgttcgaggccatcctgcagttccagatgaaccacagcgtgctgcagcaccccggcagcctgctgaccaaggcctggaagaagcccttccagcaggacggcgagctgtacggcaactgcagcagccccaagagcagctag

SEQ ID NO: 78882 - DNA, 669 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaaggagaagctgcagaagcacggcgtgtgcatcagagtgctgggcgacctgcacctgctgcccctggacctgcaggagctgatcgcccaggccgtgcaggccaccaagaactacaacaagtgcttcctgaacgtgtgcttcgcctacaccagcagacacgagatcagcaacgccgtgagagagatggcctggggcgtggagcagggcctgctggaccccagataccccgacgacatcagcgagagcctgctggacaagtgcctgtacaccaacagaagcccccaccccgacatcctgatcagaaccagcggcgaggtgagactgagcgacttcctgctgtggcagtag

SEQ ID NO: 78883 - DNA, 369 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaaggagaagctgcagaagcacggcgtgtgcatcagagtgctgggctag

SEQ ID NO: 78884 - DNA, 216 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctgtag

SEQ ID NO: 78885 - DNA, 258 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagatag

SEQ ID NO: 78886 - DNA, 885 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaagtgcttcctgaacgtgtgcttcgcctacaccagcagacacgagatcagcaacgccgtgagagagatggcctggggcgtggagcagggcctgctggaccccagcgacatcagcgagagcctgctggacaagtgcctgtacaccaacagaagcccccaccccgacatcctgatcagaaccagcggcgaggtgagactgagcgacttcctgctgtggcagaccagccacagctgcctggtgttccagcccgtgctgtggcccgagtacaccttctggaacctgttcgaggccatcctgcagttccagatgaaccacagcgtgctgcagaaggccagagacatgtacgccgaggagagaaagagacagcagctggagagagaccaggccaccgtgaccgagcagctgctgagagagggcctgcaggccagcggcgacgcccagctgagaagaaccagactgcacaagctgagcgccagaagagaggagagagtgcagggcttcctgcaggccctggagctgaagagagccgactggctggccagactgggcaccgccagcgcctag

SEQ ID NO: 78887 - DNA, 183 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagtag

SEQ ID NO: 78888 - DNA, 396 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaaggagaagctgcagaagcacggcgtgtgcatcagagtgctgggcgacctgcacctgctgcccctggacctgtag

SEQ ID NO: 78889 - DNA, 501 bp, Artificial Sequence
  Description of Artificial Sequence: Synthetic coding sequence
atgagctggatcaaggagggcgagctgagcctgtgggagagattctgcgccaacatcatcaaggccggccccatgcccaagcacatcgccttcatcatggacggcaacagaagatacgccaagaagtgccaggtggagagacaggagggccacagccagggcttcaacaagctggccgagaccctgagatggtgcctgaacctgggcatcctggaggtgaccgtgtacgccttcagcatcgagaacttcaagagaagcaagagcgaggtggacggcctgatggacctggccagacagaagttcagcagactgatggaggagaaggagaagctgcagaagcacggcgtgtgcatcagagtgctgggcgacctgcacctgctgcccctggacctgcaggagctgatcgcccaggccgtgcaggccaccaagaactacaacaagtgcttcctgaacgtgtgcttcgcctacaccagcagacacgagatcagcaacgccgtgtag

SEQ ID NO: 78890 - DNA, 909 bp, Artificial Sequence
  Description of Artificial Sequence: Synthetic coding sequence
atggtgtggaagagactgggcgccctggtgatgttccccctgcagatgatctacctggtggtgaaggccgccgtgggcctggtgctgcccgccaagctgagagacctgagcagagagaacgtgctgatcaccggcggcggcagaggcatcggcagacagctggccagagagttcgccgagagaggcgccagaaagatcgtgctgtggggcagaaccgagaagtgcctgaaggagaccaccgaggagatcagacagatgggcaccgagtgccactacttcatctgcgacgtgggcaacagagaggaggtgtaccagaccgccaaggccgtgagagagaaggtgggcgacatcaccatcctggtgaacaacgccgccgtggtgcacggcaagagcctgatggacagcgacgacgacgccctgctgaagagccagcacatcaacaccctgggccagttctggaccaccaaggccttcctgcccagaatgctggagctgcagaacggccacatcgtgtgcctgaacagcgtgctggccctgagcgccatccccggcgccatcgactactgcaccagcaaggccagcgccttcgccttcatggagagcctgaccctgggcctgctggactgccccggcgtgagcgccaccaccgtgctgcccttccacaccagcaccgagatgttccagggcatgagagtgagattccccaacctgttcccccccctgaagcccgagaccgtggccagaagaaccgtggaggccgtgcagctgaaccaggccctgctgctgctgccctggaccatgcacgccctggtgatcctgaagagcatcctgccccaggccgccctggaggagatccacaagttcagcggcacctacacctgcatgaacaccttcaagggcagaacctag

SEQ ID NO: 78891 - DNA, 444 bp, Artificial Sequence
  Description of Artificial Sequence: Synthetic coding sequence
atgggcaccgagtgccactacttcatctgcgacgtgggcaacagagaggaggtgtaccagaccgccaaggccgtgagagagaaggtgggcgacatcaccatcctggtgaacaacgccgccgtggtgcacggcaagagcctgatggacagcgacgacgacgccctgctgaagagccagcacatcaacaccctgggccagttctggaccaccaaggccttcctgcccagaatgctggagctgcagaacggccacatcgtgtgcctgaacagcgtgctggccctgagcgccatccccggcgccatcgactactgcaccagcaaggccagcgccttcgccttcatggagagcctgaccctgggcctgctggactgccccggcgtgagcgccaccaccgtgctgcccttccacaccagcaccgagatgttccagggcatgagagtgtag

SEQ ID NO: 78892 - DNA, 423 bp, Artificial Sequence
  Description of Artificial Sequence: Synthetic coding sequence
atggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 78893 - DNA, 837 bp, Artificial Sequence
  Description of Artificial Sequence: Synthetic coding sequence
atgcacaaggccggcctgctgggcctgtgcgccagagcctggaacagcgtgagaatggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccgccgtgaagctgcacggcggcatcgacatcctggtgagcaacgccgccgtgaaccccttcttcggcagcatcatggacgtgaccgaggaggtgtgggacaagaccctggacatcaacgtgaaggcccccgccctgatgaccaaggccgtggtgcccgagatggagaagagaggcggcggcagcgtggtgatcgtgagcagcatcgccgccttcagccccagccccggcttcagcccctacaacgtgagcaagaccgccctgctgggcctgaccaagaccctggccatcgagctggcccccagaaacatcagagtgaactgcctggcccccggcctgatcaagaccagcttcagcagaatgctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 78894 - DNA, 513 bp, Artificial Sequence
  Description of Artificial Sequence: Synthetic coding sequence
atggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccgccgtgaagctgcacggcggcatcgacatcctggtgagcaacgccgccgtgaaccccttcttcggcagcatcatggacgtgaccgaggaggtgtgggacaagagaagactgagcggcgacagagtgttccacagcagcctgcagagcatcagcagcctggacggccagggcaagagaggcaagcacgagagaaaccccgccgacaagaaggtgagaagagccagaggcctgtgctggcacagagtgttccccgtgctgtag

SEQ ID NO: 78895 - DNA, 546 bp, Artificial Sequence
  Description of Artificial Sequence: Synthetic coding sequence
atggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccaccctggacatcaacgtgaaggcccccgccctgatgaccaaggccgtggtgcccgagatggagaagagaggcggcggcagcgtggtgatcgtgagcagcatcgccgccttcagccccagccccctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 78896 - DNA, 477 bp, Artificial Sequence
  Description of Artificial Sequence: Synthetic coding sequence
atgcacaaggccggcctgctgggcctgtgcgccagagcctggaacagcgtgagaatggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 78897 - DNA, 579 bp, Artificial Sequence
  Description of Artificial Sequence: Synthetic coding sequence
atgcacaaggccggcctgctgggcctgtgcgccagagcctggaacagcgtgagaatggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccgccgtgaagctgcacggcggcatcgacatcctggtgagcaacgccgccgtgaaccccttcttcggcagcatcatggacgtgaccgaggaggtgtgggacaagctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 78898 - DNA, 681 bp, Artificial Sequence
  Description of Artificial Sequence: Synthetic coding sequence
atggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccaccctggacatcaacgtgaaggcccccgccctgatgaccaaggccgtggtgcccgagatggagaagagaggcggcggcagcgtggtgatcgtgagcagcatcgccgccttcagccccagccccggcttcagcccctacaacgtgagcaagaccgccctgctgggcctgaccaagaccctggccatcgagctggcccccagaaacatcagagtgaactgcctggcccccggcctgatcaagaccagcttcagcagaatgctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 78899 - DNA, 567 bp, Artificial Sequence
  Description of Artificial Sequence: Synthetic coding sequence
atgcacaaggccggcctgctgggcctgtgcgccagagcctggaacagcgtgagaatggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccgccgtgaagctgcacggcggcatcgacatcctggtgagcaacgccgccgtgaaccccttcttcggcagcatcatggacgtgaccgaggaggtgtgggacaagagaagactgagcggcgacagagtgttccacagcagcctgcagagcatcagcagcctggacggccagggcaagagaggcaagcacgagagaaaccccgccgacaagaaggtgagaagagccagaggcctgtgctggcacagagtgttccccgtgctgtag

SEQ ID NO: 78900 - DNA, 600 bp, Artificial Sequence
  Description of Artificial Sequence: Synthetic coding sequence
atgcacaaggccggcctgctgggcctgtgcgccagagcctggaacagcgtgagaatggccagcagcggcatgaccagaagagaccccctggccaacaaggtggccctggtgaccgccagcaccgacggcatcggcttcgccatcgccagaagactggcccaggacggcgcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccaccaccctggacatcaacgtgaaggcccccgccctgatgaccaaggccgtggtgcccgagatggagaagagaggcggcggcagcgtggtgatcgtgagcagcatcgccgccttcagccccagccccctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 78901 - DNA, 1374 bp, Artificial Sequence
  Description of Artificial Sequence: Synthetic coding sequence
atgagaagcgccgccgtgctggccctgctgctgtgcgccggccaggtgaccgccctgcccgtgaacagccccatgaacaagggcgacaccgaggtgatgaagtgcatcgtggaggtgatcagcgacaccctgagcaagcccagccccatgcccgtgagccaggagtgcttcgagaccctgagaggcgacgagagaatcctgagcatcctgagacaccagaacctgctgaaggagctgcaggacctggccctgcagggcgccaaggagagagcccaccagcagaagaagcacagcggcttcgaggacgagctgagcgaggtgctggagaaccagagcagccaggccgagctgaaggaggccgtggaggagcccagcagcaaggacgtgatggagaagagagaggacagcaaggaggccgagaagagcggcgaggccaccgacggcgccagaccccaggccctgcccgagcccatgcaggagagcaaggccgagggcaacaaccaggcccccggcgaggaggaggaggaggaggaggaggccaccaacacccacccccccgccagcctgcccagccagaagtaccccggcccccaggccgagggcgacagcgagggcctgagccagggcctggtggacagagagaagggcctgagcgccgagcccggctggcaggccaagagagaggaggaggaggaggaggaggaggaggccgaggccggcgaggaggccgtgcccgaggaggagggccccaccgtggtgctgaacccccaccccagcctgggctacaaggagatcagaaagggcgagagcagaagcgaggccctggccgtggacggcgccggcaagcccggcgccgaggaggcccaggaccccgagggcaagggcgagcaggagcacagccagcagaaggaggaggaggaggagatggccgtggtgccccagggcctgttcagaggcggcaagagcggcgagctggagcaggaggaggagagactgagcaaggagtgggaggacagcaagagatggagcaagatggaccagctggccaaggagctgaccgccgagaagagactggagggccaggaggaggaggaggacaacagagacagcagcatgaagctgagcttcagagccagagcctacggcttcagaggccccggcccccagctgagaagaggctggagacccagcagcagagaggacagcctggaggccggcctgcccctgcaggtgagaggctaccccgaggagaagaaggaggaggagggcagcgccaacagaagacccgaggaccaggagctggagagcctgagcgccatcgaggccgagctggagaaggtggcccaccagctgcaggccctgagaagaggctag

SEQ ID NO: 78902 - DNA, 1128 bp, Artificial Sequence
  Description of Artificial Sequence: Synthetic coding sequence
atgaactgggagctgctgctgtggctgctggtgctgtgcgccctgctgctgctgctggtgcagctgctgagattcctgagagccgacggcgacctgaccctgctgtgggccgagtggcagggcagaagacccgagtgggagctgaccgacatggtggtgtgggtgaccggcgccagcagcggcatcggcgaggagctggcctaccagctgagcaagctgggcgtgagcctggtgctgagcgccagaagagtgcacgagctggagagagtgaagagaagatgcctggagaacggcaacctgaaggagaaggacatcctggtgctgcccctggacctgaccgacaccggcagccacgaggccgccaccaaggccgtgctgcaggagttcggcagaatcgacatcctggtgaacaacggcggcatgagccagagaagcctgtgcatggacaccagcctggacgtgtacagaaagctgatcgagctgaactacctgggcaccgtgagcctgaccaagtgcgtgctgccccacatgatcgagagaaagcagggcaagatcgtgaccgtgaacagcatcctgggcatcatcagcgtgcccctgagcatcggctactgcgccagcaagcacgccctgagaggcttcttcaacggcctgagaaccgagctggccacctaccccggcatcatcgtgagcaacatctgccccggccccgtgcagagcaacatcgtggagaacagcctggccggcgaggtgaccaagaccatcggcaacaacggcgaccagagccacaagatgaccaccagcagatgcgtgagactgatgctgatcagcatggccaacgacctgaaggaggtgtggatcagcgagcagcccttcctgctggtgacctacctgtggcagtacatgcccacctgggcctggtggatcaccagatggggcagaaagggcctgagaaccctgagagtggtgtggatgcagaccctgctgatcctgaagagcctgagacagaacatgaccgagaagagcacctgcaccttccaggccaccggcggcagaaacggcaagcacgagaacagcaacctgctgatgctgctgaacaaccagagactgatctgcgacttcaccttctag

SEQ ID NO: 78903 - DNA, 870 bp, Artificial Sequence
  Description of Artificial Sequence: Synthetic coding sequence
atggtggtgtgggtgaccggcgccagcagcggcatcggcgaggagctggcctaccagctgagcaagctgggcgtgagcctggtgctgagcgccagaagagtgcacgagctggagagagtgaagagaagatgcctggagaacggcaacctgaaggagaaggacatcctggtgctgcccctggacctgaccgacaccggcagccacgaggccgccaccaaggccgtgctgcaggagttcggcagaatcgacatcctggtgaacaacggcggcatgagccagagaagcctgtgcatggacaccagcctggacgtgtacagaaagctgatcgagctgaactacctgggcaccgtgagcctgaccaagtgcgtgctgccccacatgatcgagagaaagcagggcaagatcgtgaccgtgaacagcatcctgggcatcatcagcgtgcccctgagcatcggctactgcgccagcaagcacgccctgagaggcttcttcaacggcctgagaaccgagctggccacctaccccggcatcatcgtgagcaacatctgccccggccccgtgcagagcaacatcgtggagaacagcctggccggcgaggtgaccaagaccatcggcaacaacggcgaccagagccacaagatgaccaccagcagatgcgtgagactgatgctgatcagcatggccaacgacctgaaggaggtgtggatcagcgagcagcccttcctgctggtgacctacctgtggcagtacatgcccacctgggcctggtggatcaccaacaagatgggcaagaagagaatcgagaacttcaagagcggcgtggacgccgacagcagctacttcaagatcttcaagaccaagcacgactag

SEQ ID NO: 78904 - DNA, 1020 bp, Artificial Sequence
  Description of Artificial Sequence: Synthetic coding sequence
atgaactgggagctgctgctgtggctgctggtgctgtgcgccctgctgctgctgctggtgcagctgctgagattcctgagagccgacggcgacctgaccctgctgtgggccgagtggcagggcagaagacccgagtgggagctgaccgacatggtggtgtgggtgaccggcgccagcagcggcatcggcgaggagctggcctaccagctgagcaagctgggcgtgagcctggtgctgagcgccagaagagtgcacgagctggagagagtgaagagaagatgcctggagaacggcaacctgaaggagaaggacatcctggtgctgcccctggacctgaccgacaccggcagccacgaggccgccaccaaggccgtgctgcaggagttcggcagaatcgacatcctggtgaacaacggcggcatgagccagagaagcctgtgcatggacaccagcctggacgtgtacagaaagctgatcgagctgaactacctgggcaccgtgagcctgaccaagtgcgtgctgccccacatgatcgagagaaagcagggcaagatcgtgaccgtgaacagcatcctgggcatcatcagcgtgcccctgagcatcggctactgcgccagcaagcacgccctgagaggcttcttcaacggcctgagaaccgagctggccacctaccccggcatcatcgtgagcaacatctgccccggccccgtgcagagcaacatcgtggagaacagcctggccggcgaggtgaccaagaccatcggcaacaacggcgaccagagccacaagatgaccaccagcagatgcgtgagactgatgctgatcagcatggccaacgacctgaaggaggtgtggatcagcgagcagcccttcctgctggtgacctacctgtggcagtacatgcccacctgggcctggtggatcaccaacaagatgggcaagaagagaatcgagaacttcaagagcggcgtggacgccgacagcagctacttcaagatcttcaagaccaagcacgactag

SEQ ID NO: 78905 - DNA, 186 bp, Artificial Sequence
  Description of Artificial Sequence: Synthetic coding sequence
atgaactgggagctgctgctgtggctgctggtgctgtgcgccctgctgctgctgctggtgcagctgctgagattcctgagagccgacggcgacctgaccctgctgtgggccgagtggcagggcagaagacccgagtgggagctgaccgacatggtggtgtgggtgaccggcgccagcagcggctag

SEQ ID NO: 78906 - DNA, 960 bp, Artificial Sequence
  Description of Artificial Sequence: Synthetic coding sequence
atgctgttctgggtgctgggcctgctgatcctgtgcggcttcctgtggaccagaaagggcaagctgaagatcgaggacatcaccgacaagtacatcttcatcaccggctgcgacagcggcttcggcaacctggccgccagaaccttcgacaagaagggcttccacgtgatcgccgcctgcctgaccgagagcggcagcaccgccctgaaggccgagaccagcgagagactgagaaccgtgctgctggacgtgaccgaccccgagaacgtgaagagaaccgcccagtgggtgaagaaccaggtgggcgagaagggcctgtggggcctgatcaacaacgccggcgtgcccggcgtgctggcccccaccgactggctgaccctggaggactacagagagcccatcgaggtgaacctgttcggcctgatcagcgtgaccctgaacatgctgcccctggtgaagaaggcccagggcagagtgatcaacgtgagcagcgtgggcggcagactggccatcgtgggcggcggctacacccccagcaagtacgccgtggagggcttcaacgacagcctgagaagagacatgaaggccttcggcgtgcacgtgagctgcatcgagcccggcctgttcaagaccaacctggccgaccccgtgaaggtgatcgagaagaagctggccatctgggagcagctgagccccgacatcaagcagcagtacggcgagggctacatcgagaagagcctggacaagctgaagggcaacaagagctacgtgaacatggacctgagccccgtggtggagtgcatggaccacgccctgaccagcctgttccccaagacccactacgccgccggcaaggacgccaagatcttctggatccccctgagccacatgcccgccgccctgcaggacttcctgctgctgaagcagaaggccgagctggccaaccccaaggccgtgtag

SEQ ID NO: 78907 - DNA, 960 bp, Artificial Sequence; identical to SEQ ID NO: 78906
  Description of Artificial Sequence: Synthetic coding sequence

SEQ ID NO: 78908 - DNA, 960 bp, Artificial Sequence; identical to SEQ ID NO: 78906
  Description of Artificial Sequence: Synthetic coding sequence

SEQ ID NO: 78909 - DNA, 519 bp, Artificial Sequence
  Description of Artificial Sequence: Synthetic coding sequence
atgctgcccctggtgaagaaggcccagggcagagtgatcaacgtgagcagcgtgggcggcagactggccatcgtgggcggcggctacacccccagcaagtacgccgtggagggcttcaacgacagcctgagaagagacatgaaggccttcggcgtgcacgtgagctgcatcgagcccggcctgttcaagaccaacctggccgaccccgtgaaggtgatcgagaagaagctggccatctgggagcagctgagccccgacatcaagcagcagtacggcgagggctacatcgagaagagcctggacaagctgaagggcaacaagagctacgtgaacatggacctgagccccgtggtggagtgcatggaccacgccctgaccagcctgttccccaagacccactacgccgccggcaaggacgccaagatcttctggatccccctgagccacatgcccgccgccctgcaggacttcctgctgctgaagcagaaggccgagctggccaaccccaaggccgtgtag

SEQ ID NO: 78910 - DNA, 960 bp, Artificial Sequence; identical to SEQ ID NO: 78906
  Description of Artificial Sequence: Synthetic coding sequence

SEQ ID NO: 78911 - DNA, 1140 bp, Artificial Sequence
  Description of Artificial Sequence: Synthetic coding sequence
atgcccgagggcagaagccactgcgcctgcagcatcaccagcctgaccctgctggtgagcctgaccagagtgaccctggacatcctgcagaagctggaccccccccagcccgcccactggagacaccacctgctggtgctgtacaagaagggcgtgtacctgagccacaccggcggcaagatgctgttctgggtgctgggcctgctgatcctgtgcggcttcctgtggaccagaaagggcaagctgaagatcgaggacatcaccgacaagtacatcttcatcaccggctgcgacagcggcttcggcaacctggccgccagaaccttcgacaagaagggcttccacgtgatcgccgcctgcctgaccgagagcggcagcaccgccctgaaggccgagaccagcgagagactgagaaccgtgctgctggacgtgaccgaccccgagaacgtgaagagaaccgcccagtgggtgaagaaccaggtgggcgagaagggcctgtggggcctgatcaacaacgccggcgtgcccggcgtgctggcccccaccgactggctgaccctggaggactacagagagcccatcgaggtgaacctgttcggcctgatcagcgtgaccctgaacatgctgcccctggtgaagaaggcccagggcagagtgatcaacgtgagcagcgtgggcggcagactggccatcgtgggcggcggctacacccccagcaagtacgccgtggagggcttcaacgacagcctgagaagagacatgaaggccttcggcgtgcacgtgagctgcatcgagcccggcctgttcaagaccaacctggccgaccccgtgaaggtgatcgagaagaagctggccatctgggagcagctgagccccgacatcaagcagcagtacggcgagggctacatcgagaagagcctggacaagctgaagggcaacaagagctacgtgaacatggacctgagccccgtggtggagtgcatggaccacgccctgaccagcctgttccccaagacccactacgccgccggcaaggacgccaagatcttctggatccccctgagccacatgcccgccgccctgcaggacttcctgctgctgaagcagaaggccgagctggccaaccccaaggccgtgtag

SEQ ID NO: 78912 - DNA, 960 bp, Artificial Sequence; identical to SEQ ID NO: 78906
  Description of Artificial Sequence: Synthetic coding sequence

SEQ ID NO: 78913 - DNA, 201 bp, Artificial Sequence
  Description of Artificial Sequence: Synthetic coding sequence
atgctgttctgggtgctgggcctgctgatcctgtgcggcttcctgtggaccagaaagggcaagctgaagatcgaggacatcaccgacaagtacatcttcatcaccggctgcgacagcggcttcggcaacctggccgccagaaccttcgacaagaagggcttccacgtgatcgccgcctgcctgaccgagagcggcagctag

SEQ ID NO: 78914 - DNA, 486 bp, Artificial Sequence
  Description of Artificial Sequence: Synthetic coding sequence
  Description of Combined DNA/RNA Molecule: Synthetic coding sequence
atgggcctgccccagcccggcctgtggctgaagagactgtgggtgctgctggaggtggccgtgcacgtggtggtgggcaaggtgctgctgatcctgttccccgacagagtgaagagaaacatcctggccatgggcgagaagaccggcatgaccagaaacccccacttcagccacgacaactggatccccaccttcttcagcacccagtacttctggttcgtgctgaaggtgagatggcagagactggaggacaccaccgagctgggcggcctggcccccaactgccccgtggtgagactgagcggccagagatgcaacatctgggagttcatgcagggcaacagacccctggtgctgaacttcggcagctgcaccugacccagcttcatgttcaagttcgaccagttcaagagactgatcgaggacttcagcagcatcgccgacttcctggtgatctacatcgaggaggcccacgccagcggctag

SEQ ID NO: 78915 - DNA, 750 bp, Artificial Sequence
  Description of Artificial Sequence: Synthetic coding sequence
  Description of Combined DNA/RNA Molecule: Synthetic coding sequence
atgggcctgccccagcccggcctgtggctgaagagactgtgggtgctgctggaggtggccgtgcacgtggtggtgggcaaggtgctgctgatcctgttccccgacagagtgaagagaaacatcctggccatgggcgagaagaccggcatgaccagaaacccccacttcagccacgacaactggatccccaccttcttcagcacccagtacttctggttcgtgctgaaggtgagatggcagagactggaggacaccaccgagctgggcggcctggcccccaactgccccgtggtgagactgagcggccagagatgcaacatctgggagttcatgcagggcaacagacccctggtgctgaacttcggcagctgcaccugacccagcttcatgttcaagttcgaccagttcaagagactgatcgaggacttcagcagcatcgccgacttcctggtgatctacatcgaggaggcccacgccagcgacggctgggccttcaagaacaacatggacatcagaaaccaccagaacctgcaggacagactgcaggccgcccacctgctgctggccagaagcccccagtgccccgtggtggtggacaccatgcagaaccagagcagccagctgtacgccgccctgcccgagagactgtacatcatccaggagggcagaatcctgtacaagggcaagagcggcccctggaactacaaccccgaggaggtgagagccgtgctggagaagctgcacagctag

SEQ ID NO: 78916 - DNA, 606 bp, Artificial Sequence
  Description of Artificial Sequence: Synthetic coding sequence
atgggcctgccccagcccggcctgtggctgaagagactgtgggtgctgctggaggtggccgtgcacgtggtggtgggcaaggtgctgctgatcctgttccccgacagagtgaagagaaacatcctggccatgggcgagaagaccggcatgaccagaaacccccacttcagccacgacaactggatccccaccttcttcagcacccagtacttctggttcgtgctgaaggtgagatggcagagactggaggacaccaccgagctgggcggcctggcccccaactgccccgtggtgagactgagcggccagagatgcaacatctgggagttcatgcaggacggctgggccttcaagaacaacatggacatcagaaaccaccagaacctgcaggacagactgcaggccgcccacctgctgctggccagaagcccccagtgccccgtggtggtggacaccatgcagaaccagagcagccagctgtacgccgccctgcccgagagactgtacatcatccaggagggcagaatcctgtacaagggcaagagcggcccctggaactacaaccccgaggaggtgagagccgtgctggagaagctgcacagctag

SEQ ID NO: 78917 - DNA, 363 bp, Artificial Sequence
  Description of Artificial Sequence: Synthetic coding sequence
atgttcaagttcgaccagttcaagagactgatcgaggacttcagcagcatcgccgacttcctggtgatctacatcgaggaggcccacgccagcgacggctgggccttcaagaacaacatggacatcagaaaccaccagaacctgcaggacagactgcaggccgcccacctgctgctggccagaagcccccagtgccccgtggtggtggacaccatgcagaaccagagcagccagctgtacgccgccctgcccgagagactgtacatcatccaggagggcagaatcctgtacaagggcaagagcggcccctggaactacaaccccgaggaggtgagagccgtgctggagaagctgcacagctag

SEQ ID NO: 78918 - DNA, 558 bp, Artificial Sequence
  Description of Artificial Sequence: Synthetic coding sequence
  Description of Combined DNA/RNA Molecule: Synthetic coding sequence
atgggcctgccccagcccggcctgtggctgaagagactgtgggtgctgctggaggtggccgtgcacgtggtggtgggcaaggtgctgctgatcctgttccccgacagagtgaagagaaacatcctggccatgggcgagaagaccggcaacagacccctggtgctgaacttcggcagctgcaccugacccagcttcatgttcaagttcgaccagttcaagagactgatcgaggacttcagcagcatcgccgacttcctggtgatctacatcgaggaggcccacgccagcgacggctgggccttcaagaacaacatggacatcagaaaccaccagaacctgcaggacagactgcaggccgcccacctgctgctggccagaagcccccagtgccccgtggtggtggacaccatgcagaaccagagcagccagctgtacgccgccctgcccgagagactgtacatcatccaggagggcagaatcctgtacaagggcaagagcggcccctggaactacaaccccgaggaggtgagagccgtgctggagaagctgcacagctag

SEQ ID NO: 78919 - DNA, 342 bp, Artificial Sequence
  Description of Artificial Sequence: Synthetic coding sequence
atgggcctgccccagcccggcctgtggctgaagagactgtgggtgctgctggaggtggccgtgcacgtggtggtgggcaaggtgctgctgatcctgttccccgacagagtgaagagaaacatcctggccatgggcgagaagaccggcatgaccagaaacccccacttcagccacgacaactggatccccaccttcttcagcacccagtacttctggttcgtgctgaaggtgagatggcagagactggaggacaccaccgagctgggcggcctggcccccaactgccccgtggtgagactgagcggccagagatgcaacatctgggagttcatgcagggctag

SEQ ID NO: 78920 - DNA, 270 bp, Artificial Sequence
  Description of Artificial Sequence: Synthetic coding sequence
atgggcatcctgagcgtggacctgctgatcaccctgcagatcctgcccgtgttcttcagcaactgcctgttcctggccctgtacgacagcgtgatcctgctgaagcacgtggtgctgctgctgagcagaagcaagagcaccagaggcgagtggagaagaatgctgaccagcgagggcctgagatgcgtgtggaagagcttcctgctggacgcctacaagcagctgaactgcccccccagcggcttcagcaaggacggccacatcctgtag

SEQ ID NO: 78921 - DNA, 399 bp, Artificial Sequence
  Description of Artificial Sequence: Synthetic coding sequence
atgggcatcctgagcgtggacctgctgatcaccctgcagatcctgcccgtgttcttcagcaactgcctgttcctggccctgtacgacagcgtgatcctgctgaagcacgtggtgctgctgctgagcagaagcaagagcaccagaggcgagtggagaagaatgctgaccagcgagggcctgagatgcgtgtggaagagcttcctgctggacgcctacaagcaggtgaagctgggcgaggacgcccccaacagcagcgtggtgcacgtgagcagcaccgagggcggcgacaacagcggcaacggcacccaggagaagatcgccgagggcgccacctgccacctgctggacttcgccagccccgagagacccctggtggtgaacttcggcagcgccacctag

SEQ ID NO: 78922 - DNA, 822 bp, Artificial Sequence
  Description of Artificial Sequence: Synthetic coding sequence
  Description of Combined DNA/RNA Molecule: Synthetic coding sequence
atgggcatcctgagcgtggacctgctgatcaccctgcagatcctgcccgtgttcttcagcaactgcctgttcctggccctgtacgacagcgtgatcctgctgaagcacgtggtgctgctgctgagcagaagcaagagcaccagaggcgagtggagaagaatgctgaccagcgagggcctgagatgcgtgtggaagagcttcctgctggacgcctacaagcaggtgaagctgggcgaggacgcccccaacagcagcgtggtgcacgtgagcagcaccgagggcggcgacaacagcggcaacggcacccaggagaagatcgccgagggcgccacctgccacctgctggacttcgccagccccgagagacccctggtggtgaacttcggcagcgccaccugaccccccttcaccagccagctgcccgccttcagaaagctggtggaggagttcagcagcgtggccgacttcctgctggtgtacatcgacgaggcccaccccagcgacggctgggccatccccggcgacagcagcctgagcttcgaggtgaagaagcaccagaaccaggaggacagatgcgccgccgcccagcagctgctggagagattcagcctgcccccccagtgcagagtggtggccgacagaatggacaacaacgccaacatcgcctacggcgtggccttcgagagagtgtgcatcgtgcagagacagaagatcgcctacctgggcggcaagggccccttcagctacaacctgcaggaggtgagacactggctggagaagaacttcagcaagagaugaaagaagaccagactggccggctag

SEQ ID NO: 78923 - DNA, 21 bp, Artificial Sequence
  Description of Artificial Sequence: Synthetic coding sequence
atgggcatcctgagcgtgtag

SEQ ID NO: 78924 - DNA, 21 bp, Artificial Sequence
  Description of Artificial Sequence: Synthetic coding sequence
atgggcatcctgagcgtgtag

SEQ ID NO: 78925 - DNA, 168 bp, Artificial Sequence
  Description of Artificial Sequence: Synthetic coding sequence
atgggcatcctgagcgtggacctgctgatcaccctgcagatcctgcccgtgttcttcagcaactgcctgttcctggccctgtacgacagcgtgatcctgctgaagcacgtggtgctgctgctgagcagaagcaagagcaccagaggcgagtggagaagaatgctgtag

SEQ ID NO: 78926 - DNA, 930 bp, Artificial Sequence
  Description of Artificial Sequence: Synthetic coding sequence
  Description of Combined DNA/RNA Molecule: Synthetic coding sequence
atgggcatcctgagcgtggacctgctgatcaccctgcagatcctgcccgtgttcttcagcaactgcctgttcctggccctgtacgacagcgtgatcctgctgaagcacgtggtgctgctgctgagcagaagcaagagcaccagaggcgagtggagaagaatgctgaccagcgagggcctgagatgcgtgtggaagagcttcctgctggacgcctacaagcagctgaactgcccccccagcggcttcagcaaggacggccacatcctgugactggtgtacgaggcctacaagagcagactgctggtgtacagccacctggacctgtggatggtgaagctgggcgaggacgcccccaacagcagcgtggtgcacgtgagcagcaccgagggcggcgacaacagcggcaacggcacccaggagaagatcgccgagggcgccacctgccacctgctggacttcgccagccccgagagacccctggtggtgaacttcggcagcgccaccugaccccccttcaccagccagctgcccgccttcagaaagctggtggaggagttcagcagcgtggccgacttcctgctggtgtacatcgacgaggcccaccccagcgacggctgggccatccccggcgacagcagcctgagcttcgaggtgaagaagcaccagaaccaggaggacagatgcgccgccgcccagcagctgctggagagattcagcctgcccccccagtgcagagtggtggccgacagaatggacaacaacgccaacatcgcctacggcgtggccttcgagagagtgtgcatcgtgcagagacagaagatcgcctacctgggcggcaagggccccttcagctacaacctgcaggaggtgagacactggctggagaagaacttcagcaagagaugaaagaagaccagactggccggctag

SEQ ID NO: 78927 - DNA, 822 bp, Artificial Sequence; identical to SEQ ID NO: 78922
  Description of Artificial Sequence: Synthetic coding sequence
  Description of Combined DNA/RNA Molecule: Synthetic coding sequence

SEQ ID NO: 78928 - DNA, 915 bp, Artificial Sequence
  Description of Artificial Sequence: Synthetic coding sequence
  Description of Combined DNA/RNA Molecule: Synthetic coding sequence
atgcccagacaggccaccagcagactggtggtgggcgagggcgagggcagccagggcgccagcggccccgccgccaccatgctgagaagcctgctgctgcacagcctgagactgtgcgcccagaccgccagctgcctggtgctgttccccagattcctgggcaccgccttcatgctgtggctgctggacttcctgtgcatcagaaagcacttcctgggcagaagaagaagaggccagcccgagcccgaggtggagctgaacagcgagggcgaggaggtgccccccgacgacccccccatctgcgtgagcgacgacaacagactgtgcaccctggccagcctgaaggccgtgtggcacggccagaagctggacttcttcaagcaggcccacgagggcggccccgcccccaacagcgaggtggtgctgcccgacggcttccagagccagcacatcctggactacgcccagggcaacagacccctggtgctgaacttcggcagctgcaccugaccccccttcatggccagaatgagcgccttccagagactggtgaccaagtaccagagagacgtggacttcctgatcatctacatcgaggaggcccaccccagcgacggctgggtgaccaccgacagcccctacatcatcccccagcacagaagcctggaggacagagtgagcgccgccagagtgctgcagcagggcgcccccggctgcgccctggtgctggacaccatggccaacagcagcagcagcgcctacggcgcctacttcgagagactgtacgtgatccagagcggcaccatcatgtaccagggcggcagaggccccgacggctaccaggtgagcgagctgagaacctggctggagagatacgacgagcagctgcacggcgccagacccagaagagtgtag

SEQ ID NO: 78929 - DNA, 1026 bp, Artificial Sequence
  Description of Artificial Sequence: Synthetic coding sequence
atgagcgccagcgcccccgccgccgagggcgagggcacccccacccagcccgccagcgagaaggagcccgagatgcccggccccagagaggagagcgaggaggaggaggacgaggacgacgaggaggaggaggaggaggagaagggcaagggccagaagctgtgcgagatcgagagaatccacttcttcctgagcaagaagaagaccgacgagctgagaaacctgcacaagctgctgtacaacagacccggcaccgtgagcagcctgaagaagaacgtgggccagttcagcggcttccccttcgagaagggcagcgtgcagtacaagaagaaggaggagatgctgaagaagttcagaaacgccatgctgaagagcatctgcgaggtgctggacctggagagaagcggcgtgaacagcgagctggtgaagagaatcctgaacttcctgatgcaccccaagcccagcggcaagcccctgcccaagagcaagaagacctgcagcaagggcagcaagaaggagagaaacagcagcggcatggccagaaaggccaagagaaccaagtgccccgagatcctgagcgacgagagcagcagcgacgaggacgagaagaagaacaaggaggagagcagcgacgacgaggacaaggagagcgaggaggagccccccaagaagaccgccaagagagagaagcccaagcagaaggccaccagcaagagcaagaagagcgtgaagagcgccaacgtgaagaaggccgacagcagcaccaccaagaagaaccagaacagcagcaagaaggagagcgagagcgaggacagcagcgacgacgagcccctgatcaagaagctgaagaagccccccaccgacgaggagctgaaggagaccatcaagaagctgctggccagcgccaacctggaggaggtgaccatgaagcagatctgcaagaaggtgtacgagaactaccccacctacgacctgaccgagagaaaggacttcatcaagaccaccgtgaaggagctgatcagctag

SEQ ID NO: 78930 - DNA, 1128 bp, Artificial Sequence
  Description of Artificial Sequence: Synthetic coding sequence
atgagcgccagcgcccccgccgccgagggcgagggcacccccacccagcccgccagcgagaaggagcccgagatgcccggccccagagaggagagcgaggaggaggaggacgaggacgacgaggaggaggaggaggaggagaaggagaagagcctgatcgtggagggcaagagagagaagaagaaggtggagagactgaccatgcaggtgagcagcctgcagagagagcccttcaccatcgcccagggcaagggccagaagctgtgcgagatcgagagaatccacttcttcctgagcaagaagaagaccgacgagctgagaaacctgcacaagctgctgtacaacagacccggcaccgtgagcagcctgaagaagaacgtgggccagttcagcggcttccccttcgagaagggcagcgtgcagtacaagaagaaggaggagatgctgaagaagttcagaaacgccatgctgaagagcatctgcgaggtgctggacctggagagaagcggcgtgaacagcgagctggtgaagagaatcctgaacttcctgatgcaccccaagcccagcggcaagcccctgcccaagagcaagaagacctgcagcaagggcagcaagaaggagagaaacagcagcggcatggccagaaaggccaagagaaccaagtgccccgagatcctgagcgacgagagcagcagcgacgaggacgagaagaagaacaaggaggagagcagcgacgacgaggacaaggagagcgaggaggagccccccaagaagaccgccaagagagagaagcccaagcagaaggccaccagcaagagcaagaagagcgtgaagagcgccaacgtgaagaaggccgacagcagcaccaccaagaagaaccagaacagcagcaagaaggagagcgagagcgaggacagcagcgacgacgagcccctgatcaagaagctgaagaagccccccaccgacgaggagctgaaggagaccatcaagaagctgctggccagcgccaacctggaggaggtgaccatgaagcagatctgcaagaaggtgtacgagaactaccccacctacgacctgaccgagagaaaggacttcatcaagaccaccgtgaaggagctgatcagctag

SEQ ID NO: 78931 - DNA, 1101 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagcagccccttccaggtgaccgccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78932 - DNA, 1605 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78933 - DNA, 1821 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78934 - DNA, 1461 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78935 - DNA, 1677 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78936 - DNA, 1086 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccagatgcccccctag

SEQ ID NO: 78937 - DNA, 1965 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78938 - DNA, 1605 bp, Artificial Sequence; identical to SEQ ID NO: 78932
  Description of Artificial Sequence: Synthetic coding sequence

SEQ ID NO: 78939 - DNA, 1317 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccttccaggtggccaccggctaccagttccccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78940 - DNA, 1173 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78941 - DNA, 1746 bp, Artificial Sequence
  Description of Artificial Sequence: Synthetic coding sequence
atgatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78942 - DNA, 1014 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccagatgcccccctag

SEQ ID NO: 78943 - DNA, 1101 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccgtgcaggtgaccaccggctaccagctgcccgtgtacaactaccaggccttccccgcctaccccaacagccccgtgcaggtgaccaccggctaccagctgcccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78944 - DNA, 1317 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78945 - DNA, 1086 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccgtgcaggtgaccaccggctaccagctgcccgtgtacaactaccagatgcccccctag

SEQ ID NO: 78946 - DNA, 1173 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 78947 - DNA, 948 bp, Artificial Sequence
  Description of Artificial Sequence: Synthetic coding sequence
atggccgcccccagctgcggcggcgacagaaaggccagactgacccccagcctgccccacgagagcaccgccaaccccgagacccccaacagcaccatcagcagagaggccagcacccagagcagcagcgccgccaccagccagggctacatcctgcccgagggcaagatcatgcccaacaccgtgttcgtgggcggcatcgacgtgagaatggacgagaccgagatcagaagcttcttcgccagatacggcagcgtgaaggaggtgaagatcatcaccgacagaaccggcgtgagcaagggctacggcttcgtgagcttcttcaacgacgtggacgtgcagaagatcgtggagagccagatcaacttccacggcaagaagctgaagctgggccccgccatcagaaagcagaacctgtgcgcctaccacgtgcagcccagacccctggtgttcaaccaccccccccccccccagttccagaacgtgtggaccaaccccaacaccgagacctacatgcagcccaccaccaccatgaaccccatcacccagtacgtgcaggcctaccccacctaccccaacagccccgtgcaggtgatcaccggctaccagctgcccgtgtacaactaccagatgcccccccagtggcccgtgggcgagcagagaagctacgtggtgccccccgcctacagcgccgtgaactaccactgcaacgaggtggaccccggcgccgaggtggtgcccaacgagtgcagcgtgcacgaggccaccccccccagcggcaacggcccccagaagaagagcgtggacagaagcatccagaccgtggtgagctgcctgttcaaccccgagaacagactgagaaacagcgtggtgacccaggacgactacttcaaggacaagagagtgcaccacttcagaagaagcagagccatgctgaagagcgtgtag

SEQ ID NO: 78948 - DNA, 888 bp, Artificial Sequence
  Description of Artificial Sequence: Synthetic coding sequence
atgagcaccgccaaccccgagacccccaacagcaccatcagcagagaggccagcacccagagcagcagcgccgccaccagccagggctacatcctgcccgagggcaagatcatgcccaacaccgtgttcgtgggcggcatcgacgtgagaatggacgagaccgagatcagaagcttcttcgccagatacggcagcgtgaaggaggtgaagatcatcaccgacagaaccggcgtgagcaagggctacggcttcgtgagcttcttcaacgacgtggacgtgcagaagatcgtggagagccagatcaacttccacggcaagaagctgaagctgggccccgccatcagaaagcagaacctgtgcgcctaccacgtgcagcccagacccctggtgttcaaccaccccccccccccccagttccagaacgtgtggaccaaccccaacaccgagacctacatgcagcccaccaccaccatgaaccccatcacccagtacgtgcaggcctaccccacctaccccaacagccccgtgcaggtgatcaccggctaccagctgcccgtgtacaactaccagatgcccccccagtggcccgtgggcgagcagagaagctacgtggtgccccccgcctacagcgccgtgaactaccactgcaacgaggtggaccccggcgccgaggtggtgcccaacgagtgcagcgtgcacgaggccaccccccccagcggcaacggcccccagaagaagagcgtggacagaagcatccagaccgtggtgagctgcctgttcaaccccgagaacagactgagaaacagcgtggtgacccaggacgactacttcaaggacaagagagtgcaccacttcagaagaagcagagccatgctgaagagcgtgtag

SEQ ID NO: 78949 - DNA, 2286 bp, Artificial Sequence
  Description of Artificial Sequence: Synthetic coding sequence
atgaactggagattcgtggagctgctgtacttcctgttcatctggggcagaatcagcgtgcagcccagccaccaggagcccgccggcaccgaccagcacgtgagcaaggagttcgactggctgatcagcgacagaggccccttccaccacagcagaagctacctgagcttcgtggagagacacagacagggcttcaccaccagatacaagatctacagagagttcgccagatggaaggtgagaaacaccgccatcgagagaagagacctggtgagacaccccgtgcccctgatgcccgagttccagagaagcatcagactgctgggcagaagacccaccacccagcagttcatcgacaccatcatcaagaagtacggcacccacctgctgatcagcgccaccctgggcggcgaggaggccctgaccatgtacatggacaagagcagactggacagaaagagcggcaacgccacccagagcgtggaggccctgcaccagctggccagcagctacttcgtggacagagacggcaccatgagaagactgcacgagatccagatcagcaccggcgccatcaaggtgaccgagaccagaaccggccccctgggctgcaacagctacgacaacctggacagcgtgagcagcgtgctgctgcagagcaccgagagcaagctgcacctgcagggcctgcagatcatcttcccccagtacctgcaggagaagttcgtgcagagcgccctgagctacatcatgtgcaacggcgagggcgagtacctgtgccagaacagccagtgcagatgccagtgcgccgaggagttcccccagtgcaactgccccatcaccgacatccagatcatggagtacaccctggccaacatggccaagagctgggccgaggcctacaaggacctggagaacagcgacgagttcaagagcttcatgaagagactgcccagcaaccacttcctgaccatcggcagcatccaccagcactggggcaacgactgggacctgcagaacagatacaagctgctgcagagcgccaccgaggcccagagacagaagatccagagaaccgccagaaagctgttcggcctgagcgtgagatgcagacacaaccccaaccaccagctgcccagagagagaaccatccagcagtggctggccagagtgcagagcctgctgtactgcaacgagaacggcttctggggcaccttcctggagagccagagaagctgcgtgtgccacggcagcaccaccctgtgccagagacccatcccctgcgtgatcggcggcaacaacagctgcgccatgtgcagcctggccaacatcagcctgtgcggcagctgcaacaagggctacaagctgtacagaggcagatgcgagccccagaacgtggacagcgagagaagcgagcagttcatcagcttcgagaccgacctggacttccaggacctggagctgaagtacctgctgcagaagatggacagcagactgtacgtgcacaccaccttcatcagcaacgagatcagactggacaccttcttcgaccccagatggagaaagagaatgagcctgaccctgaagagcaacaagaacagaatggacttcatccacatggtgatcggcatgagcatgagaatctgccagatgagaaacagcagcctggaccccatgttcttcgtgtacgtgaaccccttcagcggcagccacagcgagggctggaacatgcccttcggcgagttcggctaccccagatgggagaagatcagactgcagaacagccagtgctacaactggaccctgctgctgggcaacagatggaagaccttcttcgagaccgtgcacatctacctgagaagcagaaccagactgcccaccctgctgagaaacgagaccggccagggccccgtggacctgagcgaccccagcaagagacagttctacatcaagatcagcgacgtgcaggtgttcggctacagcctgagattcaacgccgacctgctgagaagcgccgtgcagcaggtgaaccagagctacacccagggcggccagttctacagcagcagcagcgtgatgctgctgctgctggacatcagagacagaatcaacagactggccccccccgtggcccccggcaagccccagctggacctgttcagctgcatgctgaagcacagactgaagctgaccaacagcgagatcatcagagtgaaccacgccctggacctgtacaacaccgagatcctgaagcagagcgaccagatgaccgccaagctgtgctag

SEQ ID NO: 78950 - DNA, 963 bp, Artificial Sequence
  Description of Artificial Sequence: Synthetic coding sequence
atgaactggagattcgtggagctgctgtacttcctgttcatctggggcagaatcagcgtgcagcccagccaccaggagcccgccggcaccgaccagcacgtgagcaaggagttcgactggctgatcagcgacagaggccccttccaccacagcagaagctacctgagcttcgtggagagacacagacagggcttcaccaccagatacaagatctacagagagttcgccagatggaaggtgagaaacaccgccatcgagagaagagacctggtgagacaccccgtgcccctgatgcccgagttccagagaagcatcagactgctgggcagaagacccaccacccagcagttcatcgacaccatcatcaagaagtacggcacccacctgctgatcagcgccaccctgggcggcgaggaggccctgaccatgtacatggacaagagcagactggacagaaagagcggcaacgccacccagagcgtggaggccctgcaccagctggccagcagctacttcgtggacagagacggcaccatgagaagactgcacgagatccagatcagcaccggcgccatcaaggtgaccgagaccagaaccggccccctgggctgcaacagctacgacaacctggacagcgtgagcagcgtgctgctgcagagcaccgagagcaagctgcacctgcagggcctgcagatcatcttcccccagtacctgcaggagaagttcgtgcagagcgccctgagctacatcatgtgcaacggcgagggcgagtacctgtgccagaacagccagtgcagatgccagtgcgccgaggagttcccccagtgcaactgccccatcaccgacatccagatcatggagtacaccctggccaacatggccaagagctgggccgaggcctacaaggacctggagaacagcggcagagagagccacagcgtgcccctgcacgagtggccctag

SEQ ID NO: 78951 - DNA, 2286 bp, Artificial Sequence; identical to SEQ ID NO: 78949
  Description of Artificial Sequence: Synthetic coding sequence

SEQ ID NO: 78952 - DNA, 1404 bp, Artificial Sequence
  Description of Artificial Sequence: Synthetic coding sequence
atgaagagaatcaaggtgcccgactacaaggacagaagcgtgttcggcgtgcccctgaccgtgaacgtgcagagaaccggccagcccctgccccagagcatccagcaggccatgagatacctgagaaaccactgcctggaccaggtgggcctgttcagaaagagcggcgtgaagagcagaatccaggccctgagacagatgaacgagggcgccatcgactgcgtgaactacgagggccagagcgcctacgacgtggccgacatgctgaagcagtacttcagagacctgcccgagcccctgatgaccaacaagctgagcgagaccttcctgcagatctaccagtacgtgcccaaggaccagagactgcaggccatcaaggccgccatcatgctgctgcccgacgagaacagagaggtgctgcagaccctgctgtacttcctgagcgacgtgaccgccgccgtgaaggagaaccagatgacccccaccaacctggccgtgtgcctggcccccagcctgttccacctgaacaccctgaagagagagaacagcagccccagagtgatgcagagaaagcagagcctgggcaagcccgaccagaaggacctgaacgagaacctggccgccacccagggcctggcccacatgatcgccgagtgcaagaagctgttccaggtgcccgaggagatgagcagatgcagaaacagctacaccgagcaggagctgaagcccctgaccctggaggccctgggccacctgggcaacgacgacagcgccgactaccagcacttcctgcaggactgcgtggacggcctgttcaaggaggtgaaggagaagttcaagggctgggtgagctacagcaccagcgagcaggccgagctgagctacaagaaggtgagcgagggcccccccctgagactgtggagaagcgtgatcgaggtgcccgccgtgcccgaggagatcctgaagagactgctgaaggagcagcacctgtgggacgtggacctgctggacagcaaggtgatcgagatcctggacagccagaccgagatctaccagtacgtgcagaacagcatggccccccaccccgccagagactacgtggtgctgagaacctggagaaccaacctgcccaagggcgcctgcgccctgctgctgaccagcgtggaccacgacagagcccccgtggtgggcgtgagagtgaacgtgctgctgagcagatacctgatcgagccctgcggccccggcaagagcaagctgacctacatgtgcagagtggacctgagaggccacatgcccgagtggtacaccaagagcttcggccacctgtgcgccgccgaggtggtgaagatcagagacagcttcagcaaccagaacaccgagaccaaggacaccaagagcagatag

SEQ ID NO: 78953 - DNA, 3378 bp, Artificial Sequence
  Description of Artificial Sequence: Synthetic coding sequence
atgggcgaccccaaggcccacgtgatggccagacccctgagagcccccctgagaagaagcttcagcgaccacatcagagacagcaccgccagagccctggacgtgatctggaagaacaccagagacagaagactggccgagatcgaggccaaggaggcctgcgactggctgagagccaccggcttcccccagtacgcccagctgtacgaggacttcctgttccccatcgacatcagcctggtgaagagagagcacgacttcctggacagagacgccatcgaggccctgtgcagaagactgaacaccctgaacaagtgcgccgtgatgaagctggagatcagcccccacagaaagagaagcgacgacagcgacgaggacgagccctgcgccatcagcggcaagtggaccttccagagagacagcaagagatggagcagactggaggagttcgacgtgttcagccccaagcaggacctggtgcccggcagccccgacgacagccaccccaaggacggccccagccccggcggcaccctgatggacctgagcgagagacaggaggtgagcagcgtgagaagcctgagcagcaccggcagcctgcccagccacgccccccccagcgaggacgccgccacccccagaaccaacagcgtgatcagcgtgtgcagcagcagcaacctggccggcaacgacgacagcttcggcagcctgcccagccccaaggagctgagcagcttcagcttcagcatgaagggccacgagaagaccgccaagagcaagaccagaagcctgctgaagagaatggagagcctgaagctgaagagcagccaccacagcaagcacaaggcccccagcaagctgggcctgatcatcagcggccccatcctgcaggagggcatggacgaggagaagctgaagcagctgaactgcgtggagatcagcgccctgaacggcaacagaatcaacgtgcccatggtgagaaagagaagcgtgagcaacagcacccagaccagcagcagcagcagccagagcgagaccagcagcgccgtgagcacccccagccccgtgaccagaaccagaagcctgagcgcctgcaacaagagagtgggcatgtacctggagggcttcgaccccttcaaccagagcaccttcaacaacgtggtggagcagaacttcaagaacagagagagctaccccgaggacaccgtgttctacatccccgaggaccacaagcccggcaccttccccaaggccctgaccaacggcagcttcagccccagcggcaacaacggcagcgtgaactggagaaccggcagcttccacggccccggccacatcagcctgagaagagagaacagcagcgacagccccaaggagctgaagagaagaaacagcagcagcagcatgagcagcagactgagcatctacgacaacgtgcccggcagcatcctgtacagcagcagcggcgacctggccgacctggagaacgaggacatcttccccgagctggacgacatcctgtaccacgtgaagggcatgcagagaatcgtgaaccagtggagcgagaagttcagcgacgagggcgacagcgacagcgccctggacagcgtgagcccctgccccagcagccccaagcagatccacctggacgtggacaacgacagaaccacccccagcgacctggacagcaccggcaacagcctgaacgagcccgaggagcccagcgagatccccgagagaagagacagcggcgtgggcgccagcctgaccagaagcaacagacacagactgagatggcacagcttccagagcagccacagacccagcctgaacagcgtgagcctgcagatcaactgccagagcgtggcccagatgaacctgctgcagaagtacagcctgctgaagctgaccgccctgctggagaagtacacccccagcaacaagcacggcttcagctgggccgtgcccaagttcatgaagagaatcaaggtgcccgactacaaggacagaagcgtgttcggcgtgcccctgaccgtgaacgtgcagagaaccggccagcccctgccccagagcatccagcaggccatgagatacctgagaaaccactgcctggaccaggtgggcctgttcagaaagagcggcgtgaagagcagaatccaggccctgagacagatgaacgagggcgccatcgactgcgtgaactacgagggccagagcgcctacgacgtggccgacatgctgaagcagtacttcagagacctgcccgagcccctgatgaccaacaagctgagcgagaccttcctgcagatctaccagtacgtgcccaaggaccagagactgcaggccatcaaggccgccatcatgctgctgcccgacgagaacagagaggtgctgcagaccctgctgtacttcctgagcgacgtgaccgccgccgtgaaggagaaccagatgacccccaccaacctggccgtgtgcctggcccccagcctgttccacctgaacaccctgaagagagagaacagcagccccagagtgatgcagagaaagcagagcctgggcaagcccgaccagaaggacctgaacgagaacctggccgccacccagggcctggcccacatgatcgccgagtgcaagaagctgttccaggtgcccgaggagatgagcagatgcagaaacagctacaccgagcaggagctgaagcccctgaccctggaggccctgggccacctgggcaacgacgacagcgccgactaccagcacttcctgcaggactgcgtggacggcctgttcaaggaggtgaaggagaagttcaagggctgggtgagctacagcaccagcgagcaggccgagctgagctacaagaaggtgagcgagggcccccccctgagactgtggagaagcgtgatcgaggtgcccgccgtgcccgaggagatcctgaagagactgctgaaggagcagcacctgtgggacgtggacctgctggacagcaaggtgatcgagatcctggacagccagaccgagatctaccagtacgtgcagaacagcatggccccccaccccgccagagactacgtggtgctgagaacctggagaaccaacctgcccaagggcgcctgcgccctgctgctgaccagcgtggaccacgacagagcccccgtggtgggcgtgagagtgaacgtgctgctgagcagatacctgatcgagccctgcggccccggcaagagcaagctgacctacatgtgcagagtggacctgagaggccacatgcccgagtggtacaccaagagcttcggccacctgtgcgccgccgaggtggtgaagatcagagacagcttcagcaaccagaacaccgagaccaaggacaccaagagcagatag

SEQ ID NO: 78954 - DNA, 3054 bp, Artificial Sequence
  Description of Artificial Sequence: Synthetic coding sequence
atgaagctggagatcagcccccacagaaagagaagcgacgacagcgacgaggacgagccctgcgccatcagcggcaagtggaccttccagagagacagcaagagatggagcagactggaggagttcgacgtgttcagccccaagcaggacctggtgcccggcagccccgacgacagccaccccaaggacggccccagccccggcggcaccctgatggacctgagcgagagacaggaggtgagcagcgtgagaagcctgagcagcaccggcagcctgcccagccacgccccccccagcgaggacgccgccacccccagaaccaacagcgtgatcagcgtgtgcagcagcagcaacctggccggcaacgacgacagcttcggcagcctgcccagccccaaggagctgagcagcttcagcttcagcatgaagggccacgagaagaccgccaagagcaagaccagaagcctgctgaagagaatggagagcctgaagctgaagagcagccaccacagcaagcacaaggcccccagcaagctgggcctgatcatcagcggccccatcctgcaggagggcatggacgaggagaagctgaagcagctgaactgcgtggagatcagcgccctgaacggcaacagaatcaacgtgcccatggtgagaaagagaagcgtgagcaacagcacccagaccagcagcagcagcagccagagcgagaccagcagcgccgtgagcacccccagccccgtgaccagaaccagaagcctgagcgcctgcaacaagagagtgggcatgtacctggagggcttcgaccccttcaaccagagcaccttcaacaacgtggtggagcagaacttcaagaacagagagagctaccccgaggacaccgtgttctacatccccgaggaccacaagcccggcaccttccccaaggccctgaccaacggcagcttcagccccagcggcaacaacggcagcgtgaactggagaaccggcagcttccacggccccggccacatcagcctgagaagagagaacagcagcgacagccccaaggagctgaagagaagaaacagcagcagcagcatgagcagcagactgagcatctacgacaacgtgcccggcagcatcctgtacagcagcagcggcgacctggccgacctggagaacgaggacatcttccccgagctggacgacatcctgtaccacgtgaagggcatgcagagaatcgtgaaccagtggagcgagaagttcagcgacgagggcgacagcgacagcgccctggacagcgtgagcccctgccccagcagccccaagcagatccacctggacgtggacaacgacagaaccacccccagcgacctggacagcaccggcaacagcctgaacgagcccgaggagcccagcgagatccccgagagaagagacagcggcgtgggcgccagcctgaccagaagcaacagacacagactgagatggcacagcttccagagcagccacagacccagcctgaacagcgtgagcctgcagatcaactgccagagcgtggcccagatgaacctgctgcagaagtacagcctgctgaagctgaccgccctgctggagaagtacacccccagcaacaagcacggcttcagctgggccgtgcccaagttcatgaagagaatcaaggtgcccgactacaaggacagaagcgtgttcggcgtgcccctgaccgtgaacgtgcagagaaccggccagcccctgccccagagcatccagcaggccatgagatacctgagaaaccactgcctggaccaggtgggcctgttcagaaagagcggcgtgaagagcagaatccaggccctgagacagatgaacgagggcgccatcgactgcgtgaactacgagggccagagcgcctacgacgtggccgacatgctgaagcagtacttcagagacctgcccgagcccctgatgaccaacaagctgagcgagaccttcctgcagatctaccagtacgtgcccaaggaccagagactgcaggccatcaaggccgccatcatgctgctgcccgacgagaacagagaggtgctgcagaccctgctgtacttcctgagcgacgtgaccgccgccgtgaaggagaaccagatgacccccaccaacctggccgtgtgcctggcccccagcctgttccacctgaacaccctgaagagagagaacagcagccccagagtgatgcagagaaagcagagcctgggcaagcccgaccagaaggacctgaacgagaacctggccgccacccagggcctggcccacatgatcgccgagtgcaagaagctgttccaggtgcccgaggagatgagcagatgcagaaacagctacaccgagcaggagctgaagcccctgaccctggaggccctgggccacctgggcaacgacgacagcgccgactaccagcacttcctgcaggactgcgtggacggcctgttcaaggaggtgaaggagaagttcaagggctgggtgagctacagcaccagcgagcaggccgagctgagctacaagaaggtgagcgagggcccccccctgagactgtggagaagcgtgatcgaggtgcccgccgtgcccgaggagatcctgaagagactgctgaaggagcagcacctgtgggacgtggacctgctggacagcaaggtgatcgagatcctggacagccagaccgagatctaccagtacgtgcagaacagcatggccccccaccccgccagagactacgtggtgctgagaacctggagaaccaacctgcccaagggcgcctgcgccctgctgctgaccagcgtggaccacgacagagcccccgtggtgggcgtgagagtgaacgtgctgctgagcagatacctgatcgagccctgcggccccggcaagagcaagctgacctacatgtgcagagtggacctgagaggccacatgcccgagtggtacaccaagagcttcggccacctgtgcgccgccgaggtggtgaagatcagagacagcttcagcaaccagaacaccgagaccaaggacaccaagagcagatag

SEQ ID NO: 78955 - DNA, 972 bp, Artificial Sequence
  Description of Artificial Sequence: Synthetic coding sequence
atgggcaacagcgccagcagaagcgacttcgagtgggtgtacaccgaccagccccacacccagagaagaaaggagatcctggccaagtaccccgccatcaaggccctgatgagacccgaccccagactgaagtgggccgtgctggtgctggtgctggtgcagatgctggcctgctggctggtgagaggcctggcctggagatggctgctgttctgggcctacgccttcggcggctgcgtgaaccacagcctgaccctggccatccacgacatcagccacaacgccgccttcggcaccggcagagccgccagaaacagatggctggccgtgttcgccaacctgcccgtgggcgtgccctacgccgccagcttcaagaagtaccacgtggaccaccacagatacctgggcggcgacggcctggacgtggacgtgcccaccagactggagggctggttcttctgcacccccgccagaaagctgctgtggctggtgctgcagcccttcttctacagcctgagacccctgtgcgtgcaccccaaggccgtgaccagaatggaggtgctgaacaccctggtgcagctggccgccgacctggccatcttcgccctgtggggcctgaagcccgtggtgtacctgctggccagcagcttcctgggcctgggcctgcaccccatcagcggccacttcgtggccgagcactacatgttcctgaagggccacgagacctacagctactacggccccctgaactggatcaccttcaacgtgggctaccacgtggagcaccacgacttccccagcatccccggctacaacctgcccctggtgagaaagatcgcccccgagtactacgaccacctgccccagcaccacagctgggtgaaggtgctgtgggacttcgtgttcgaggacagcctgggcccctacgccagagtgaagagagtgtacagactggccaaggacggcctgtag

SEQ ID NO: 78956 - DNA, 2214 bp, Artificial Sequence
  Description of Artificial Sequence: Synthetic coding sequence
atgcagcccagaagagcccaggcccccggcgcccagctgctgcccgccctggccctgctgctgctgctgctgggcgccggccccagaggcagcagcctggccaaccccgtgcccgccgcccccctgagcgcccccggcccctgcgccgcccagccctgcagaaacggcggcgtgtgcaccagcagacccgagcccgacccccagcaccccgcccccgccggcgagcccggctacagctgcacctgccccgccggcatcagcggcgccaactgccagctggtggccgacccctgcgccagcaacccctgccaccacggcaactgcagcagcagcagcagcagcagcagcgacggctacctgtgcatctgcaacgagggctacgagggccccaactgcgagcaggccctgcccagcctgcccgccaccggctggaccgagagcatggcccccagacagctgcagcccgtgcccgccacccaggagcccgacaagatcctgcccagaagccaggccaccgtgaccctgcccacctggcagcccaagaccggccagaaggtggtggagatgaagtgggaccaggtggaggtgatccccgacatcgcctgcggcaacgccagcagcaacagcagcgccggcggcagactggtgagcttcgaggtgccccagaacaccagcgtgaagatcagacaggacgccaccgccagcctgatcctgctgtggaaggtgaccgccaccggcttccagcagtgcagcctgatcgacggcagaagcgtgacccccctgcaggccagcggcggcctggtgctgctggaggagatgctggccctgggcaacaaccacttcatcggcttcgtgaacgacagcgtgaccaagagcatcgtggccctgagactgaccctggtggtgaaggtgagcacctgcgtgcccggcgagagccacgccaacgacctggagtgcagcggcaagggcaagtgcaccaccaagcccagcgaggccaccttcagctgcacctgcgaggagcagtacgtgggcaccttctgcgaggagtacgacgcctgccagagaaagccctgccagaacaacgccagctgcatcgacgccaacgagaagcaggacggcagcaacttcacctgcgtgtgcctgcccggctacaccggcgagctgtgccagagcaagatcgactactgcatcctggacccctgcagaaacggcgccacctgcatcagcagcctgagcggcttcacctgccagtgccccgagggctacttcggcagcgcctgcgaggagaaggtggacccctgcgccagcagcccctgccagaacaacggcacctgctacgtggacggcgtgcacttcacctgcaactgcagccccggcttcaccggccccacctgcgcccagctgatcgacttctgcgccctgagcccctgcgcccacggcacctgcagaagcgtgggcaccagctacaagtgcctgtgcgaccccggctaccacggcctgtactgcgaggaggagtacaacgagtgcctgagcgccccctgcctgaacgccgccacctgcagagacctggtgaacggctacgagtgcgtgtgcctggccgagtacaagggcacccactgcgagctgtacaaggacccctgcgccaacgtgagctgcctgaacggcgccacctgcgacagcgacggcctgaacggcacctgcatctgcgcccccggcttcaccggcgaggagtgcgacatcgacatcaacgagtgcgacagcaacccctgccaccacggcggcagctgcctggaccagcccaacggctacaactgccactgcccccacggctgggtgggcgccaactgcgagatccacctgcagtggaagagcggccacatggccgagagcctgaccaacatgcccagacacagcctgtacatcatcatcggcgccctgtgcgtggccttcatcctgatgctgatcatcctgatcgtgggcatctgcagaatcagcagaatcgagtaccagggcagcagcagacccgcctacgaggagttctacaactgcagaagcatcgacagcgagttcagcaacgccatcgccagcatcagacacgccagattcggcaagaagagcagacccgccatgtacgacgtgagccccatcgcctacgaggactacagccccgacgacaagcccctggtgaccctgatcaagaccaaggacctgtag

SEQ ID NO: 78957 - DNA, 1368 bp, Artificial Sequence
  Description of Artificial Sequence: Synthetic coding sequence
atgctggccctgggcaacaaccacttcatcggcttcgtgaacgacagcgtgaccaagagcatcgtggccctgagactgaccctggtggtgaaggtgagcacctgcgtgcccggcgagagccacgccaacgacctggagtgcagcggcaagggcaagtgcaccaccaagcccagcgaggccaccttcagctgcacctgcgaggagcagtacgtgggcaccttctgcgaggagtacgacgcctgccagagaaagccctgccagaacaacgccagctgcatcgacgccaacgagaagcaggacggcagcaacttcacctgcgtgtgcctgcccggctacaccggcgagctgtgccagagcaagatcgactactgcatcctggacccctgcagaaacggcgccacctgcatcagcagcctgagcggcttcacctgccagtgccccgagggctacttcggcagcgcctgcgaggagaaggtggacccctgcgccagcagcccctgccagaacaacggcacctgctgcagccccggcttcaccggccccacctgcgcccagctgatcgacttctgcgccctgagcccctgcgcccacggcacctgcagaagcgtgggcaccagctacaagtgcctgtgcgaccccggctaccacggcctgtactgcgaggaggagtacaacgagtgcctgagcgccccctgcctgaacgccgccacctgcagagacctggtgaacggctacgagtgcgtgtgcctggccgagtacaagggcacccactgcgagctgtacaaggacccctgcgccaacgtgagctgcctgaacggcgccacctgcgacagcgacggcctgaacggcacctgcatctgcgcccccggcttcaccggcgaggagtgcgacatcgacatcaacgagtgcgacagcaacccctgccaccacggcggcagctgcctggaccagcccaacggctacaactgccactgcccccacggctgggtgggcgccaactgcgagatccacctgcagtggaagagcggccacatggccgagagcctgaccaacatgcccagacacagcctgtacatcatcatcggcgccctgtgcgtggccttcatcctgatgctgatcatcctgatcgtgggcatctgcagaatcagcagaatcgagtaccagggcagcagcagacccgcctacgaggagttctacaactgcagaagcatcgacagcgagttcagcaacgccatcgccagcatcagacacgccagattcggcaagaagagcagacccgccatgtacgacgtgagccccatcgcctacgaggactacagccccgacgacaagcccctggtgaccctgatcaagaccaaggacctgtag

SEQ ID NO: 78958 - DNA, 933 bp, Artificial Sequence
  Description of Artificial Sequence: Synthetic coding sequence
atgaccgccaccgaggccctgctgagagtgctgctgctgctgctggccttcggccacagcacctacggcgccgagtgcttccccgcctgcaacccccagaacggcttctgcgaggacgacaacgtgtgcagatgccagcccggctggcagggccccctgtgcgaccagtgcgtgaccagccccggctgcctgcacggcctgtgcggcgagcccggccagtgcatctgcaccgacggctgggacggcgagctgtgcgacagagacgtgagagcctgcagcagcgccccctgcgccaacaacagaacctgcgtgagcctggacgacggcctgtacgagtgcagctgcgcccccggctacagcggcaaggactgccagaagaaggacggcccctgcgtgatcaacggcagcccctgccagcacggcggcacctgcgtggacgacgagggcagagccagccacgccagctgcctgtgcccccccggcttcagcggcaacttctgcgagatcgtggccaacagctgcacccccaacccctgcgagaacgacggcgtgtgcaccgacatcggcggcgacttcagatgcagatgccccgccggcttcatcgacaagacctgcagcagacccgtgaccaactgcgccagcagcccctgccagaacggcggcacctgcctgcagcacacccagggccaggccatctgcttcaccatcctgggcgtgctgaccagcctggtggtgctgggcaccgtgggcatcgtgttcctgaacaagtgcgagacctgggtgagcaacctgagatacaaccacatgctgagaaagaagaagaacctgctgctgcagtacaacagcggcgaggacctggccgtgaacatcatcttccccgagaagatcgacatgaccaccttcagcaaggaggccggcgacgaggagatctag

SEQ ID NO: 78959 - DNA, 1152 bp, Artificial Sequence
  Description of Artificial Sequence: Synthetic coding sequence
atgaccgccaccgaggccctgctgagagtgctgctgctgctgctggccttcggccacagcacctacggcgccgagtgcttccccgcctgcaacccccagaacggcttctgcgaggacgacaacgtgtgcagatgccagcccggctggcagggccccctgtgcgaccagtgcgtgaccagccccggctgcctgcacggcctgtgcggcgagcccggccagtgcatctgcaccgacggctgggacggcgagctgtgcgacagagacgtgagagcctgcagcagcgccccctgcgccaacaacagaacctgcgtgagcctggacgacggcctgtacgagtgcagctgcgcccccggctacagcggcaaggactgccagaagaaggacggcccctgcgtgatcaacggcagcccctgccagcacggcggcacctgcgtggacgacgagggcagagccagccacgccagctgcctgtgcccccccggcttcagcggcaacttctgcgagatcgtggccaacagctgcacccccaacccctgcgagaacgacggcgtgtgcaccgacatcggcggcgacttcagatgcagatgccccgccggcttcatcgacaagacctgcagcagacccgtgaccaactgcgccagcagcccctgccagaacggcggcacctgcctgcagcacacccaggtgagctacgagtgcctgtgcaagcccgagttcaccggcctgacctgcgtgaagaagagagccctgagcccccagcaggtgaccagactgcccagcggctacggcctggcctacagactgacccccggcgtgcacgagctgcccgtgcagcagcccgagcacagaatcctgaaggtgagcatgaaggagctgaacaagaagacccccctgctgaccgagggccaggccatctgcttcaccatcctgggcgtgctgaccagcctggtggtgctgggcaccgtgggcatcgtgttcctgaacaagtgcgagacctgggtgagcaacctgagatacaaccacatgctgagaaagaagaagaacctgctgctgcagtacaacagcggcgaggacctggccgtgaacatcatcttccccgagaagatcgacatgaccaccttcagcaaggaggccggcgacgaggagatctag

SEQ ID NO: 78960 - DNA, 294 bp, Artificial Sequence
  Description of Artificial Sequence: Synthetic coding sequence
atgaccgccaccgaggccctgctgagagtgctgctgctgctgctggccttcggccacagcacctacggcgccgagtgcttccccgcctgcaacccccagaacggcttctgcgaggacgacaacgtgtgcagatgccagcccggctggcagggccccctgtgcgaccagtgcgtgaccagccccggctgcctgcacggcctgtgcggcgagcccggccagtgcatctgcaccgacggctgggacggcgagctgtgcgacagagacgtgagagcctgcagcagcgccccctgctag

SEQ ID NO: 78961 - DNA, 3612 bp, Artificial Sequence
  Description of Artificial Sequence: Synthetic coding sequence
atggccgcctgcggcagagtgagaagaatgttcagactgagcgccgccctgcacctgctgctgctgttcgccgccggcgccgagaagctgcccggccagggcgtgcacagccagggccagggccccggcgccaacttcgtgagcttcgtgggccaggccggcggcggcggccccgccggccagcagctgccccagctgccccagagcagccagctgcagcagcagcagcagcagcagcagcagcagcagcagccccagcccccccagccccccttccccgccggcggcccccccgccagaagaggcggcgccggcgccggcggcggctggaagctggccgaggaggagagctgcagagaggacgtgaccagagtgtgccccaagcacacctggagcaacaacctggccgtgctggagtgcctgcaggacgtgagagagcccgagaacgagatcagcagcgactgcaaccacctgctgtggaactacaagctgaacctgaccaccgaccccaagttcgagagcgtggccagagaggtgtgcaagagcaccatcaccgagatcaaggagtgcgccgacgagcccgtgggcaagggctacatggtgagctgcctggtggaccacagaggcaacatcaccgagtaccagtgccaccagtacatcaccaagatgaccgccatcatcttcagcgactacagactgatctgcggcttcatggacgactgcaagaacgacatcaacatcctgaagtgcggcagcatcagactgggcgagaaggacgcccacagccagggcgaggtggtgagctgcctggagaagggcctggtgaaggaggccgaggagagagagcccaagatccaggtgagcgagctgtgcaagaaggccatcctgagagtggccgagctgagcagcgacgacttccacctggacagacacctgtacttcgcctgcagagacgacagagagagattctgcgagaacacccaggccggcgagggcagagtgtacaagtgcctgttcaaccacaagttcgaggagagcatgagcgagaagtgcagagaggccctgaccaccagacagaagctgatcgcccaggactacaaggtgagctacagcctggccaagagctgcaagagcgacctgaagaagtacagatgcaacgtggagaacctgcccagaagcagagaggccagactgagctacctgctgatgtgcctggagagcgccgtgcacagaggcagacaggtgagcagcgagtgccagggcgagatgctggactacagaagaatgctgatggaggacttcagcctgagccccgagatcatcctgagctgcagaggcgagatcgagcaccactgcagcggcctgcacagaaagggcagaaccctgcactgcctgatgaaggtggtgagaggcgagaagggcaacctgggcatgaactgccagcaggccctgcagaccctgatccaggagaccgaccccggcgccgactacagaatcgacagagccctgaacgaggcctgcgagagcgtgatccagaccgcctgcaagcacatcagaagcggcgaccccatgatcctgagctgcctgatggagcacctgtacaccgagaagatggtggaggactgcgagcacagactgctggagctgcagtacttcatcagcagagactggaagctggaccccgtgctgtacagaaagtgccagggcgacgccagcagactgtgccacacccacggctggaacgagaccagcgagttcatgccccagggcgccgtgttcagctgcctgtacagacacgcctacagaaccgaggagcagggcagaagactgagcagagagtgcagagccgaggtgcagagaatcctgcaccagagagccatggacgtgaagctggaccccgccctgcaggacaagtgcctgatcgacctgggcaagtggtgcagcgagaagaccgagaccggccaggagctggagtgcctgcaggaccacctggacgacctggtggtggagtgcagagacatcgtgggcaacctgaccgagctggagagcgaggacatccagatcgaggccctgctgatgagagcctgcgagcccatcatccagaacttctgccacgacgtggccgacaaccagatcgacagcggcgacctgatggagtgcctgatccagaacaagcaccagaaggacatgaacgagaagtgcgccatcggcgtgacccacttccagctggtgcagatgaaggacttcagattcagctacaagttcaagatggcctgcaaggaggacgtgctgaagctgtgccccaacatcaagaagaaggtggacgtggtgatctgcctgagcaccaccgtgagaaacgacaccctgcaggaggccaaggagcacagagtgagcctgaagtgcagaagacagctgagagtggaggagctggagatgaccgaggacatcagactggagcccgacctgtacgaggcctgcaagagcgacatcaagaacttctgcagcgccgtgcagtacggcaacgcccagatcatcgagtgcctgaaggagaacaagaagcagctgagcaccagatgccaccagaaggtgttcaagctgcaggagaccgagatgatggaccccgagctggactacaccctgatgagagtgtgcaagcagatgatcaagagattctgccccgaggccgacagcaagaccatgctgcagtgcctgaagcagaacaagaacagcgagctgatggaccccaagtgcaagcagatgatcaccaagagacagatcacccagaacaccgactacagactgaaccccatgctgagaaaggcctgcaaggccgacatccccaagttctgccacggcatcctgaccaaggccaaggacgacagcgagctggagggccaggtgatcagctgcctgaagctgagatacgccgaccagagactgagcagcgactgcgaggaccagatcagaatcatcatccaggagagcgccctggactacagactggacccccagctgcagctgcactgcagcgacgagatcagcagcctgtgcgccgaggaggccgccgcccaggagcagaccggccaggtggaggagtgcctgaaggtgaacctgctgaagatcaagaccgagctgtgcaagaaggaggtgctgaacatgctgaaggagagcaaggccgacatcttcgtggaccccgtgctgcacaccgcctgcgccctggacatcaagcaccactgcgccgccatcacccccggcagaggcagacagatgagctgcctgatggaggccctggaggacaagagagtgagactgcagcccgagtgcaagaagagactgaacgacagaatcgagatgtggagctacgccgccaaggtggcccccgccgacggcttcagcgacctggccatgcaggtgatgaccagccccagcaagaactacatcctgagcgtgatcagcggcagcatctgcatcctgttcctgatcggcctgatgtgcggcagaatcaccaagagagtgaccagagagctgaaggacagactgcagtacagaagcgagaccatggcctacaagggcctggtgtggagccaggacgtgaccggcagccccgcctag

SEQ ID NO: 78962 - DNA, 1764 bp, Artificial Sequence
  Description of Artificial Sequence: Synthetic coding sequence
atggtgagccccagaatgagcggcctgctgagccagaccgtgatcctggccctgatcttcctgccccagaccagacccgccggcgtgttcgagctgcagatccacagcttcggccccggccccggccccggcgcccccagaagcccctgcagcgccagactgccctgcagactgttcttcagagtgtgcctgaagcccggcctgagcgaggaggccgccgagagcccctgcgccctgggcgccgccctgagcgccagaggccccgtgtacaccgagcagcccggcgcccccgcccccgacctgcccctgcccgacggcctgctgcaggtgcccttcagagacgcctggcccggcaccttcagcttcatcatcgagacctggagagaggagctgggcgaccagatcggcggccccgcctggagcctgctggccagagtggccggcagaagaagactggccgccggcggcccctgggccagagacatccagagagccggcgcctgggagctgagattcagctacagagccagatgcgagccccccgccgtgggcaccgcctgcaccagactgtgcagacccagaagcgcccccagcagatgcggccccggcctgagaccctgcgcccccctggaggacgagtgcgaggcccccctggtgtgcagagccggctgcagccccgagcacggcttctgcgagcagcccggcgagtgcagatgcctggagggctggaccggccccctgtgcaccgtgcccgtgagcaccagcagctgcctgagccccagaggccccagcagcgccaccaccggctgcctggtgcccggccccggcccctgcgacggcaacccctgcgccaacggcggcagctgcagcgagacccccagaagcttcgagtgcacctgccccagaggcttctacggcctgagatgcgaggtgagcggcgtgacctgcgccgacggcccctgcttcaacggcggcctgtgcgtgggcggcgccgaccccgacagcgcctacatctgccactgcccccccggcttccagggcagcaactgcgagaagagagtggacagatgcagcctgcagccctgcagaaacggcggcctgtgcctggacctgggccacgccctgagatgcagatgcagagccggcttcgccggccccagatgcgagcacgacctggacgactgcgccggcagagcctgcgccaacggcggcacctgcgtggagggcggcggcgcccacagatgcagctgcgccctgggcttcggcggcagagactgcagagagagagccgacccctgcgccgccagaccctgcgcccacggcggcagatgctacgcccacttcagcggcctggtgtgcgcctgcgcccccggctacatgggcgccagatgcgagttccccgtgcaccccgacggcgccagcgccctgcccgccgccccccccggcctgagacccggcgacccccagagatacctgctgccccccgccctgggcctgctggtggccgccggcgtggccggcgccgccctgctgctggtgcacgtgagaagaagaggccacagccaggacgccggcagcagactgctggccggcacccccgagcccagcgtgcacgccctgcccgacgccctgaacaacctgagaacccaggagggcagcggcgacggccccagcagcagcgtggactggaacagacccgaggacgtggacccccagggcatctacgtgatcagcgcccccagcatctacgccagagaggcctag

SEQ ID NO: 78963 - DNA, 2058 bp, Artificial Sequence
  Description of Artificial Sequence: Synthetic coding sequence
atggccgccgccagcagaagcgccagcggctgggccctgctgctgctggtggccctgtggcagcagagagccgccggcagcggcgtgttccagctgcagctgcaggagttcatcaacgagagaggcgtgctggccagcggcagaccctgcgagcccggctgcagaaccttcttcagagtgtgcctgaagcacttccaggccgtggtgagccccggcccctgcaccttcggcaccgtgagcacccccgtgctgggcaccaacagcttcgccgtgagagacgacagcagcggcggcggcagaaaccccctgcagctgcccttcaacttcacctggcccggcaccttcagcctgatcatcgaggcctggcacgcccccggcgacgacctgagacccgaggccctgccccccgacgccctgatcagcaagatcgccatccagggcagcctggccgtgggccagaactggctgctggacgagcagaccagcaccctgaccagactgagatacagctacagagtgatctgcagcgacaactactacggcgacaactgcagcagactgtgcaagaagagaaacgaccacttcggccactacgtgtgccagcccgacggcaacctgagctgcctgcccggctggaccggcgagtactgccagcagcccatctgcctgagcggctgccacgagcagaacggctactgcagcaagcccgccgagtgcctgtgcagacccggctggcagggcagactgtgcaacgagtgcatcccccacaacggctgcagacacggcacctgcagcaccccctggcagtgcacctgcgacgagggctggggcggcctgttctgcgaccaggacctgaactactgcacccaccacagcccctgcaagaacggcgccacctgcagcaacagcggccagagaagctacacctgcacctgcagacccggctacaccggcgtggactgcgagctggagctgagcgagtgcgacagcaacccctgcagaaacggcggcagctgcaaggaccaggaggacggctaccactgcctgtgcccccccggctactacggcctgcactgcgagcacagcaccctgagctgcgccgacagcccctgcttcaacggcggcagctgcagagagagaaaccagggcgccaactacgcctgcgagtgcccccccaacttcaccggcagcaactgcgagaagaaggtggacagatgcaccagcaacccctgcgccaacggcggccagtgcctgaacagaggccccagcagaatgtgcagatgcagacccggcttcaccggcacctactgcgagctgcacgtgagcgactgcgccagaaacccctgcgcccacggcggcacctgccacgacctggagaacggcctgatgtgcacctgccccgccggcttcagcggcagaagatgcgaggtgagaaccagcatcgacgcctgcgccagcagcccctgcttcaacagagccacctgctacaccgacctgagcaccgacaccttcgtgtgcaactgcccctacggcttcgtgggcagcagatgcgagttccccgtgggcctgccccccagcttcccctgggtggccgtgagcctgggcgtgggcctggccgtgctgctggtgctgctgggcatggtggccgtggccgtgagacagctgagactgagaagacccgacgacggcagcagagaggccatgaacaacctgagcgacttccagaaggacaacctgatccccgccgcccagctgaagaacaccaaccagaagaaggagctggaggtggactgcggcctggacaagagcaactgcggcaagcagcagaaccacaccctggactacaacctggcccccggccccctgggcagaggcaccatgcccggcaagttcccccacagcgacaagagcctgggcgagaaggcccccctgagactgcacagcgagaagcccgagtgcagaatcagcgccatctgcagccccagagacagcatgtaccagagcgtgtgcctgatcagcgaggagagaaacgagtgcgtgatcgccaccgaggtgtag

SEQ ID NO: 78964 - DNA, 2223 bp, Artificial Sequence
  Description of Artificial Sequence: Synthetic coding sequence
atggccagccacctgagaccccccagccccctgctggtgagagtgtacaagagcggccccagagtgagaagaaagctggagagctacttccagagcagcaagagcagcggcggcggcgagtgcaccgtgagcacccaggagcacgaggcccccggcaccttcagagtggagttcagcgagagagccgccaaggagagagtgctgaagaagggcgagcaccagatcctggtggacgagaagcccgtgcccatcttcctggtgcccaccgagaacagcatcaagaagaacaccagaccccagatcagcagcctgacccagagccaggccgagacccccagcggcgacatgcaccagcacgagggccacatccccaacgccgtggacagctgcctgcagaagatcttcctgaccgtgaccgccgacctgaactgcaacctgttcagcaaggagcagagagcctacatcaccaccctgtgccccagcatcagaaagatggagggccacgacggcatcgagaaggtgtgcggcgacttccaggacatcgagagaatccaccagttcctgagcgagcagttcctggagagcgagcagaagcagcagttcagccccagcatgaccgagagaaagcccctgagccagcaggagagagacagctgcatcagccccagcgagcccgagaccaaggccgagcagaagagcaactacttcgaggtgcccctgccctacttcgagtacttcaagtacatctgccccgacaagatcaacagcatcgagaagagattcggcgtgaacatcgagatccaggagagcagccccaacatggtgtgcctggacttcaccagcagcagaagcggcgacctggaggccgccagagagagcttcgccagcgagttccagaagaacaccgagcccctgaagcaggagtgcgtgagcctggccgacagcaagcaggccaacaagttcaagcaggagctgaaccaccagttcaccaagctgctgatcaaggagaagggcggcgagctgaccctgctgggcacccaggacgacatcagcgccgccaagcagaagatcagcgaggccttcgtgaagatccccgtgaagctgttcgccgccaactacatgatgaacgtgatcgaggtggacagcgcccactacaagctgctggagaccgagctgctgcaggagatcagcgagatcgagaagagatacgacatctgcagcaaggtgagcgagaagggccagaagacctgcatcctgttcgagagcaaggacagacaggtggacctgagcgtgcacgcctacgccagcttcatcgacgccttccagcacgccagctgccagctgatgagagaggtgctgctgctgaagagcctgggcaaggagagaaagcacctgcaccagaccaagttcgccgacgacttcagaaagagacaccccaacgtgcacttcgtgctgaaccaggagagcatgaccctgaccggcctgcccaaccacctggccaaggccaagcagtacgtgctgaagggcggcggcatgagcagcctggccggcaagaagctgaaggagggccacgagacccccatggacatcgacagcgacgacagcaaggccgccagcccccccctgaagggcagcgtgagcagcgaggccagcgagctggacaagaaggagaagggcatctgcgtgatctgcatggacaccatcagcaacaagaaggtgctgcccaagtgcaagcacgagttctgcgccccctgcatcaacaaggccatgagctacaagcccatctgccccacctgccagaccagctacggcatccagaagggcaaccagcccgagggcagcatggtgttcaccgtgagcagagacagcctgcccggctacgagagcttcggcaccatcgtgatcacctacagcatgaaggccggcatccagaccgaggagcaccccaaccccggcaagagataccccggcatccagagaaccgcctacctgcccgacaacaaggagggcagaaaggtgctgaagctgctgtacagagccttcgaccagaagctgatcttcaccgtgggctacagcagagtgctgggcgtgagcgacgtgatcacctggaacgacatccaccacaagaccagcagattcggcggccccgagatgtacggctaccccgaccccagctacctgaagagagtgaaggaggagctgaaggccaagggcatcgagtag

SEQ ID NO: 78965 - DNA, 1863 bp, Artificial Sequence
  Description of Artificial Sequence: Synthetic coding sequence
atgagcagacccggccacggcggcctgatgcccgtgaacggcctgggcttccccccccagaacgtggccagagtggtggtgtgggagtggctgaacgagcacagcagatggagaccctacaccgccaccgtgtgccaccacatcgagaacgtgctgaaggaggacgccagaggcagcgtggtgctgggccaggtggacgcccagctggtgccctacatcatcgacctgcagagcatgcaccagttcagacaggacaccggcaccatgagacccgtgagaagaaacttctacgaccccagcagcgcccccggcaagggcatcgtgtgggagtgggagaacgacggcggcgcctggaccgcctacgacatggacatctgcatcaccatccagaacgcctacgagaagcagcacccctggctggacctgagcagcctgggcttctgctacctgatctacttcaacagcatgagccagatgaacagacagaccagaagaagaagaagactgagaagaagactggacctggcctaccccctgaccgtgggcagcatccccaagagccagagctggcccgtgggcgccagcagcggccagccctgcagctgccagcagtgcctgctggtgaacagcaccagagccgccagcaacgccatcctggccagccagagaagaaaggccccccccgccccccccctgccccccccccccccccccggcggcccccccggcgccctggccgtgagacccagcgccaccttcaccggcgccgccctgtgggccgcccccgccgccggccccgccgagcccgcccccccccccggcgccccccccagaagccccggcgcccccggcggcgccagaacccccggccagaacaacctgaacagacccggcccccagagaaccaccagcgtgagcgccagagccagcatcccccccggcgtgcccgccctgcccgtgaagaacctgaacggcaccggccccgtgcaccccgccctggccggcatgaccggcatcctgctgtgcgccgccggcctgcccgtgtgcctgaccagagcccccaagcccatcctgcaccccccccccgtgagcaagagcgacgtgaagcccgtgcccggcgtgcccggcgtgtgcagaaagaccaagaagaagcacctgaagaagagcaagaaccccgaggacgtggtgagaagatacatgcagaaggtgaagaacccccccgacgaggactgcaccatctgcatggagagactggtgaccgccagcggctacgagggcgtgctgagacacaagggcgtgagacccgagctggtgggcagactgggcagatgcggccacatgtaccacctgctgtgcctggtggccatgtacagcaacggcaacaaggacggcagcctgcagtgccccacctgcaaggccatctacggcgagaagaccggcacccagccccccggcaagatggagttccacctgatcccccacagcctgcccggcttccccgacacccagaccatcagaatcgtgtacgacatccccaccggcatccagggccccgagcaccccaaccccggcaagaagttcaccgccagaggcttccccagacactgctacctgcccaacaacgagaagggcagaaaggtgctgagactgctgatcaccgcctgggagagaagactgatcttcaccatcggcaccagcaacaccaccggcgagagcgacaccgtggtgtggaacgagatccaccacaagaccgagttcggcagcaacctgaccggccacggctaccccgacgccagctacctggacaacgtgctggccgagctgaccgcccagggcgtgagcgaggccgccgccaaggcctag

SEQ ID NO: 78966 - DNA, 1044 bp, Artificial Sequence
  Description of Artificial Sequence: Synthetic coding sequence
atgagcttcgtgctgagcagaatggccgcctgcggcggcacctgcaagaacaaggtgaccgtgagcaagcccgtgtgggacttcctgagcaaggagacccccgccagactggccagactgagagaggagcacagagtgagcatcctgatcgacggcgagaccagcgacatctacgtgctgcagctgagcccccagggccccccccccgccccccccaacggcctgtacctggccagaaaggccctgaagggcctgctgaaggaggccgagaaggagctgaagaaggcccagagacagggcgagctgatgggctgcctggccctgggcggcggcggcgagcaccccgagatgcacagagccggccccccccccctgagagccgcccccctgctgccccccggcgccagaggcctgccccccccccccccccccctgcccccccccctgccccccagactgagagaggaggccgaggagcaggagagcacctgccccatctgcctgggcgagatccagaacgccaagaccctggagaagtgcagacacagcttctgcgagggctgcatcaccagagccctgcaggtgaagaaggcctgccccatgtgcggcagattctacggccagctggtgggcaaccagccccagaacggcagaatgctggtgagcaaggacgccaccctgctgctgcccagctacgagaagtacggcaccatcgtgatccagtacgtgttcccccccggcgtgcagggcgccgagcaccccaaccccggcgtgagataccccggcaccaccagagtggcctacctgcccgactgccccgagggcaacaaggtgctgaccctgttcagaaaggccttcgaccagagactgaccttcaccatcggcaccagcatgaccaccggcagacccaacgtgatcacctggaacgacatccaccacaagaccagctgcaccggcggcccccagctgttcggctaccccgaccccacctacctgaccagagtgcaggaggagctgagagccaagggcatcaccgacgactag

SEQ ID NO: 78967 - DNA, 1044 bp, Artificial Sequence; identical to SEQ ID NO: 78966
  Description of Artificial Sequence: Synthetic coding sequence

SEQ ID NO: 78968 - DNA, 1044 bp, Artificial Sequence; identical to SEQ ID NO: 78966
  Description of Artificial Sequence: Synthetic coding sequence

SEQ ID NO: 78969 - DNA, 615 bp, Artificial Sequence
  Description of Artificial Sequence: Synthetic coding sequence
atgcccatcctgagcagcagcggcagcaagatggccgcctgcggcggcacctgcaagaacaaggtgaccgtgagcaagcccgtgtgggacttcctgagcaaggagacccccgccagactggccagactgagagaggagcacagagtgagcatcctgatcgacggcgagaccagcgacatctacgtgctgcagctgagcccccagggccccccccccgccccccccaacggcctgtacctggccagaaaggccctgaagggcctgctgaaggaggccgagaaggagctgaagaaggcccagagacagggcgagctgatgggctgcctggccctgggcggcggcggcgagcaccccgagatgcacagagccggccccccccccctgagagccgcccccctgctgccccccggcgccagaggcctgccccccccccccccccccctgcccccccccctgccccccagactgagagaggaggccgaggagcaggagagcacctgccccatctgcctgggcgagatccagaacgccaagaccctggagaagtgcagacacagcttctgcgagggctgcatcaccagagccctgcaggtgaagaaggcctgccccatgtag

SEQ ID NO: 78970 - DNA, 24 bp, Artificial Sequence
  Description of Artificial Sequence: Synthetic coding sequence
atgcccatcctgagcagcagctag

SEQ ID NO: 78971 - DNA, 1053 bp, Artificial Sequence
  Description of Artificial Sequence: Synthetic coding sequence
atgcccatcctgagcagcagcggcagcaagatggccgcctgcggcggcacctgcaagaacaaggtgaccgtgagcaagcccgtgtgggacttcctgagcaaggagacccccgccagactggccagactgagagaggagcacagagtgagcatcctgatcgacggcgagaccagcgacatctacgtgctgcagctgagcccccagggccccccccccgccccccccaacggcctgtacctggccagaaaggccctgaagggcctgctgaaggaggccgagaaggagctgaagaaggcccagagacagggcgagctgatgggctgcctggccctgggcggcggcggcgagcaccccgagatgcacagagccggccccccccccctgagagccgcccccctgctgccccccggcgccagaggcctgccccccccccccccccccctgcccccccccctgccccccagactgagagaggaggccgaggagcaggagagcacctgccccatctgcctgggcgagatccagaacgccaagaccctggagaagtgcagacacagcttctgcgagggctgcatcaccagagccctgcaggtgaagaaggcctgccccatgtgcggcagattctacggccagctggtgggcaaccagccccagaacggcagaatgctggtgagcaaggacgccaccctgctgctgcccagctacgagaagtacggcaccatcgtgatccagtacgtgttcccccccggcgtgcagggcgccgagcaccccaaccccggcgtgagataccccggcaccaccagagtggcctacctgcccgactgccccgagggcaacaaggtgctgaccctgttcagaaaggccttcgaccagagactgaccttcaccatcggcaccagcatgaccaccggcagacccaacgtgatcacctggaacgacatccaccacaagaccagctgcaccggcggcccccagctgttcggctaccccgaccccacctacctgaccagagtgcaggaggagctgagagccaagggcatcaccgacgactag

SEQ ID NO: 78972 - DNA, 150 bp, Artificial Sequence
  Description of Artificial Sequence: Synthetic coding sequence
atgagcttcgtgctgagcagaatggccgcctgcggcggcacctgcaagaacaaggtgaccgtgagcaagcccgtgtgggacttcctgagcaaggagacccccgccagactggccagactgagagaggagcacagagtgagcatcctgtag

SEQ ID NO: 78973 - DNA, 2136 bp, Artificial Sequence
  Description of Artificial Sequence: Synthetic coding sequence
atgctggacggccccctgttcagcgagggccccgacagccccagagagctgcaggacgaggagagcggcagctgcctgtgggtgcagaagagcaagctgctggtgatcgaggtgaagaccatcagctgccactacagcagaagagcccccagcagacagcccatggacttccaggccagccactgggccagaggcttccagaacagaacctgcggccccagacccggcagcccccagcccccccccagaagaccctgggccagcagagtgctgcaggaggccaccaactggagagccggccccctggccgaggtgagagccagagagcaggagaagagaaaggccgccagccaggagagagaggccaaggagaccgagagaaagagaagaaaggccggcggcgccagaagaagcccccccggcagacccagacccgagcccagaaacgcccccagagtggcccagctggccggcctgcccgcccccctgagacccgagagactggcccccgtgggcagagcccccagacccagcgcccagccccagagcgaccccggcagcgcctgggccggcccctggggcggcagaagacccggcccccccagctacgaggcccacctgctgctgagaggcagcgccggcaccgcccccagaagaagatgggacagaccccccccctacgtggccccccccagctacgagggcccccacagaaccctgggcaccaagagaggccccggcaacagccaggtgcccaccagcagcgcccccgccgccacccccgccagaaccgacggcggcagaaccaagaagagactggaccccagaatctacagagacgtgctgggcgcctggggcctgagacagggccagggcctgctgggcggcagccccggctgcggcgccgccagagccagacccgagcccggcaagggcgtggtggagaagagcctgggcctggccgccgccgacctgaacagcggcagcgacagccacccccaggccaaggccaccggcagcgccggcaccgagatcgcccccgccggcagcgccaccgccgccccctgcgccccccaccccgcccccagaagcagacaccacctgaagggcagcagagagggcaaggagggcgagcagatctggttccccaagtgctggatccccagccccaagaagcagccccccagacacagccagaccctgcccagaccctgggcccccggcggcaccggctggagagagagcctgggcctgggcgagggcgccggccccgagaccctggagggctggaaggccaccagaagagcccacaccctgcccagaagcagccagggcctgagcagaggcgagggcgtgttcgtgatcgacgccacctgcgtggtgatcagaagccagtacgtgcccacccccagaacccagcaggtgcagctgctgcccagcggcgtgaccagagtggtgggcgacagccccagccagagcaagcccggcaaggaggagggcgagggcgccaccgtgttccccagcccctgccagaagagactgagcagcagcagactgctgcaccagcccggcggcggcagaggcggcgaggccgagggcggcagacccggcgacagcaccctggaggagagaaccttcagaatcctgggcctgcccgcccccgaggtgaacctgagagacgcccccacccagcccggcagccccgagcaccaggccctgggccccgccgccagcggcgcccagggcagagccgagggcagcgaggtggccgtggtgcagagaagagccggcagaggctgggccagaacccccggcccctacgccggcgccctgagagaggccgtgagcagaatcagaagacacaccgcccccgacagcgacaccgacgaggccgaggagctgagcgtgcacagcggcagcagcgacggcagcgacaccgaggcccccggcgccagctggagaaacgagagaaccctgcccgaggtgggcaacagcagccccgaggaggacggcaagaccgccgagctgagcgacagcgtgggcgagatcctggacgtgatcagccagaccgaggaggtgctgttcggcgtgagagacatcagaggcacccagcagggcaacagaaagagacagtag

SEQ ID NO: 78974 - DNA, 852 bp, Artificial Sequence
  Description of Artificial Sequence: Synthetic coding sequence
atgggcatctggaccagcggcaccgacatcttcctgagcctgtgggagatctacgtgagccccagaagccccggctggatggacttcatccagcacctgggcgtgtgctgcctggtggccctgatcagcgtgggcctgctgagcgtggccgcctgctggttcctgcccagcatcatcgccgccgccgccagctggatcatcacctgcgtgctgctgtgctgcagcaagcacgccagatgcttcatcctgctggtgttcctgagctgcggcctgagagagggcagaaacgccctgatcgccgccggcaccggcatcgtgatcctgggccacgtggagaacatcttccacaacttcaagggcctgctggacggcatgacctgcaacctgagagccaagagcttcagcatccacttccccctgctgaagaagtacatcgaggccatccagtggatctacggcctggccacccccctgagcgtgttcgacgacctggtgagctggaaccagaccctggccgtgagcctgttcagccccagccacgtgctggaggcccagctgaacgacagcaagggcgaggtgctgagcgtgctgtaccagatggccaccaccaccgaggtgctgagcagcctgggccagaagctgctggccttcgccggcctgagcctggtgctgctgggcaccggcctgttcatgaagagattcctgggcccctgcggctggaagtacgagaacatctacatcaccagacagttcgtgcagttcgacgagagagagagacaccagcagagaccctgcgtgctgcccctgaacaaggaggagagaagaaagttcatcagcggcttccagagctag

SEQ ID NO: 78975 - DNA, 1401 bp, Artificial Sequence
  Description of Artificial Sequence: Synthetic coding sequence
atgctgaagtggcccatccccggccaggtggccctgttccagatcctgagatgcagaggcaacagcagaagaaccaccgtgaccagcctgaccgtgagccaggtgggccagaacttcaccttcgtgctgaccgacatcgacagcaagcagagattcggcttctgcagactgagcagcggcgccaagagctgcttctgcatcctgagctacctgccctggttcgaggtgttctacaagctgctgaacatcctggccgactacaccaccaagagacaggagaaccagtggaacgagctgctggagaccctgcacaagctgcccatccccgaccccggcgtgagcgtgcacctgagcgtgcacagctacttcaccgtgcccgacaccagagagctgcccagcatccccgagaacagaaacctgaccgagtacttcgtggccgtggacgtgaacaacatgctgcacctgtacgccagcatgctgtacgagagaagaatcctgatcatctgcagcaagctgagcaccctgaccgcctgcatccacggcagcgccgccatgctgtaccccatgtactggcagcacgtgtacatccccgtgctgcccccccacctgctggactactgctgcgcccccatgccctacctgatcggcatccacctgagcctgatggagaaggtgagaaacatggccctggacgacgtggtgatcctgaacgtggacaccaacaccctggagacccccttcgacgacctgcagagcctgcccaacgacgtgatcagcagcctgaagaacagactgaagaaggtgagcaccaccaccggcgacggcgtggccagagccttcctgaaggcccaggccgccttcttcggcagctacagaaacgccctgaagatcgagcccgaggagcccatcaccttctgcgaggaggccttcgtgagccactacagaagcggcgccatgagacagttcctgcagaacgccacccagctgcagctgttcaagcagttcatcgacggcagactggacctgctgaacagcggcgagggcttcagcgacgtgttcgaggaggagatcaacatgggcgagtacgccggcagcgacaagctgtaccaccagtggctgagcaccgtgagaaagggcagcggcgccatcctgaacaccgtgaagaccaaggccaaccccgccatgaagaccgtgtacaagttcgccaaggaccacgccaagatgggcatcaaggaggtgaagaacagactgaagcagaaggacatcgccgagaacggctgcgcccccacccccgaggagcagctgcccaagaccgcccccagccccctggtggaggccaaggaccccaagctgagagaggacagaagacccatcaccgtgcacttcggccaggccctgtag

SEQ ID NO: 78976 - DNA, 1680 bp, Artificial Sequence
  Description of Artificial Sequence: Synthetic coding sequence
atgggcagcagaatcaagcagaaccccgagaccaccttcgaggtgtacgtggaggtggcctaccccagaaccggcggcaccctgagcgaccccgaggtgcagagacagttccccgaggactacagcgaccaggaggtgctgcagaccctgaccaagttctgcttccccttctacgtggacagcctgaccgtgagccaggtgggccagaacttcaccttcgtgctgaccgacatcgacagcaagcagagattcggcttctgcagactgagcagcggcgccaagagctgcttctgcatcctgagctacctgccctggttcgaggtgttctacaagctgctgaacatcctggccgactacaccaccaagagacaggagaaccagtggaacgagctgctggagaccctgcacaagctgcccatccccgaccccggcgtgagcgtgcacctgagcgtgcacagctacttcaccgtgcccgacaccagagagctgcccagcatccccgagaacagaaacctgaccgagtacttcgtggccgtggacgtgaacaacatgctgcacctgtacgccagcatgctgtacgagagaagaatcctgatcatctgcagcaagctgagcaccctgaccgcctgcatccacggcagcgccgccatgctgtaccccatgtactggcagcacgtgtacatccccgtgctgcccccccacctgctggactactgctgcgcccccatgccctacctgatcggcatccacctgagcctgatggagaaggtgagaaacatggccctggacgacgtggtgatcctgaacgtggacaccaacaccctggagacccccttcgacgacctgcagagcctgcccaacgacgtgatcagcagcctgaagaacagactgaagaaggtgagcaccaccaccggcgacggcgtggccagagccttcctgaaggcccaggccgccttcttcggcagctacagaaacgccctgaagatcgagcccgaggagcccatcaccttctgcgaggaggccttcgtgagccactacagaagcggcgccatgagacagttcctgcagaacgccacccagctgcagctgttcaagcagttcatcgacggcagactggacctgctgaacagcggcgagggcttcagcgacgtgttcgaggaggagatcaacatgggcgagtacgccggcagcgacaagctgtaccaccagtggctgagcaccgtgagaaagggcagcggcgccatcctgaacaccgtgaagaccaaggccaaccccgccatgaagaccgtgtacaagttcgccaaggaccacgccaagatgggcatcaaggaggtgaagaacagactgaagcagaaggacatcgccgagaacggctgcgcccccacccccgaggagcagctgcccaagaccgcccccagccccctggtggaggccaaggaccccaagctgagagaggacagaagacccatcaccgtgcacttcggccaggtgagaccccccagaccccacgtggtgaagagacccaagagcaacatcgccgtggagggcagaagaaccagcgtgcccagccccgagcagaacaccatcgccacccccgccaccctgcacatcctgcagaagagcatcacccacttcgccgccaagttccccaccagaggctggaccagcagcagccactag

SEQ ID NO: 78977 - DNA, 3030 bp, Artificial Sequence
  Description of Artificial Sequence: Synthetic coding sequence
atgggcagcagaatcaagcagaaccccgagaccaccttcgaggtgtacgtggaggtggcctaccccagaaccggcggcaccctgagcgaccccgaggtgcagagacagttccccgaggactacagcgaccaggaggtgctgcagaccctgaccaagttctgcttccccttctacgtggacagcctgaccgtgagccaggtgggccagaacttcaccttcgtgctgaccgacatcgacagcaagcagagattcggcttctgcagactgagcagcggcgccaagagctgcttctgcatcctgagctacctgccctggttcgaggtgttctacaagctgctgaacatcctggccgactacaccaccaagagacaggagaaccagtggaacgagctgctggagaccctgcacaagctgcccatccccgaccccggcgtgagcgtgcacctgagcgtgcacagctacttcaccgtgcccgacaccagagagctgcccagcatccccgagaacagaaacctgaccgagtacttcgtggccgtggacgtgaacaacatgctgcacctgtacgccagcatgctgtacgagagaagaatcctgatcatctgcagcaagctgagcaccctgaccgcctgcatccacggcagcgccgccatgctgtaccccatgtactggcagcacgtgtacatccccgtgctgcccccccacctgctggactactgctgcgcccccatgccctacctgatcggcatccacctgagcctgatggagaaggtgagaaacatggccctggacgacgtggtgatcctgaacgtggacaccaacaccctggagacccccttcgacgacctgcagagcctgcccaacgacgtgatcagcagcctgaagaacagactgaagaaggtgagcaccaccaccggcgacggcgtggccagagccttcctgaaggcccaggccgccttcttcggcagctacagaaacgccctgaagatcgagcccgaggagcccatcaccttctgcgaggaggccttcgtgagccactacagaagcggcgccatgagacagttcctgcagaacgccacccagctgcagctgttcaagcagttcatcgacggcagactggacctgctgaacagcggcgagggcttcagcgacgtgttcgaggaggagatcaacatgggcgagtacgccggcagcgacaagctgtaccaccagtggctgagcaccgtgagaaagggcagcggcgccatcctgaacaccgtgaagaccaaggccaaccccgccatgaagaccgtgtacaagttcgccaaggaccacgccaagatgggcatcaaggaggtgaagaacagactgaagcagaaggacatcgccgagaacggctgcgcccccacccccgaggagcagctgcccaagaccgcccccagccccctggtggaggccaaggaccccaagctgagagaggacagaagacccatcaccgtgcacttcggccaggtgagaccccccagaccccacgtggtgaagagacccaagagcaacatcgccgtggagggcagaagaaccagcgtgcccagccccgagcagccccagccctacagaaccctgagagagagcgacagcgccgagggcgacgaggccgagagccccgagcagcaggtgagaaagagcaccggccccgtgcccgccccccccgacagagccgccagcatcgacctgctggaggacgtgttcagcaacctggacatggaggccgccctgcagcccctgggccaggccaagagcctggaggacctgagagcccccaaggacctgagagagcagcccggcaccttcgactaccagagactggacctgggcggcagcgagagaagcagaggcgtgaccgtggccctgaagctgacccacccctacaacaagctgtggagcctgggccaggacgacatggccatccccagcaagccccccgccgccagccccgagaagcccagcgccctgctgggcaacagcctggccctgcccagaagaccccagaacagagacagcatcctgaaccccagcgacaaggaggaggtgcccacccccaccctgggcagcatcaccatccccagaccccagggcagaaagacccccgagctgggcatcgtgccccccccccccatccccagacccgccaagctgcaggccgccggcgccgccctgggcgacgtgagcgagagactgcagaccgacagagacagaagagccgccctgagccccggcctgctgcccggcgtggtgccccagggccccaccgagctgctgcagcccctgagccccggccccggcgccgccggcaccagcagcgacgccctgctggccctgctggaccccctgagcaccgcctggagcggcagcaccctgcccagcagacccgccacccccaacgtggccacccccttcaccccccagttcagcttcccccccgccggcacccccacccccttcccccagccccccctgaaccccttcgtgcccagcatgcccgccgccccccccaccctgcccctggtgagcacccccgccggccccttcggcgccccccccgccagcctgggccccgccttcgccagcggcctgctgctgagcagcgccggcttctgcgccccccacagaagccagcccaacctgagcgccctgagcatgcccaacctgttcggccagatgcccatgggcacccacaccagccccctgcagcccctgggcccccccgccgtggcccccagcagaatcagaaccctgcccctggccagaagcagcgccagagccgccgagaccaagcagggcctggccctgagacccggcgacccccccctgctgccccccagacccccccagggcctggagcccaccctgcagcccagcgccccccagcaggccagagaccccttcgaggacctgctgcagaagaccaagcaggacgtgagccccagccccgccctggcccccgcccccgacagcgtggagcagctgagaaagcagtgggagaccttcgagtag

SEQ ID NO: 78978 - DNA, 1590 bp, Artificial Sequence
  Description of Artificial Sequence: Synthetic coding sequence
atgctgaagtggcccatccccggccaggtggccctgttccaggaggtgctgcagaccctgaccaagttctgcttccccttctacgtggacagcctgaccgtgagccaggtgggccagaacttcaccttcgtgctgaccgacatcgacagcaagcagagattcggcttctgcagactgagcagcggcgccaagagctgcttctgcatcctgagctacctgccctggttcgaggtgttctacaagctgctgaacatcctggccgactacaccaccaagagacaggagaaccagtggaacgagctgctggagaccctgcacaagctgcccatccccgaccccggcgtgagcgtgcacctgagcgtgcacagctacttcaccgtgcccgacaccagagagctgcccagcatccccgagaacagaaacctgaccgagtacttcgtggccgtggacgtgaacaacatgctgcacctgtacgccagcatgctgtacgagagaagaatcctgatcatctgcagcaagctgagcaccctgaccgcctgcatccacggcagcgccgccatgctgtaccccatgtactggcagcacgtgtacatccccgtgctgcccccccacctgctggactactgctgcgcccccatgccctacctgatcggcatccacctgagcctgatggagaaggtgagaaacatggccctggacgacgtggtgatcctgaacgtggacaccaacaccctggagacccccttcgacgacctgcagagcctgcccaacgacgtgatcagcagcctgaagaacagactgaagaaggtgagcaccaccaccggcgacggcgtggccagagccttcctgaaggcccaggccgccttcttcggcagctacagaaacgccctgaagatcgagcccgaggagcccatcaccttctgcgaggaggccttcgtgagccactacagaagcggcgccatgagacagttcctgcagaacgccacccagctgcagctgttcaagcagttcatcgacggcagactggacctgctgaacagcggcgagggcttcagcgacgtgttcgaggaggagatcaacatgggcgagtacgccggcagcgacaagctgtaccaccagtggctgagcaccgtgagaaagggcagcggcgccatcctgaacaccgtgaagaccaaggccaaccccgccatgaagaccgtgtacaagttcgccaaggaccacgccaagatgggcatcaaggaggtgaagaacagactgaagcagaaggacatcgccgagaacggctgcgcccccacccccgaggagcagctgcccaagaccgcccccagccccctggtggaggccaaggaccccaagctgagagaggacagaagacccatcaccgtgcacttcggccaggtgagaccccccagaccccacgtggtgaagagacccaagagcaacatcgccgtggagggcagaagaaccagcgtgcccagccccgagcagaacaccatcgccacccccgccaccctgcacatcctgcagaagagcatcacccacttcgccgccaagttccccaccagaggctggaccagcagcagccactag

SEQ ID NO: 78979 - DNA, 3063 bp, Artificial Sequence
  Description of Artificial Sequence: Synthetic coding sequence
atgagaagacccggcgaccacggcctgcaggaccaggaggtgctgcagaccctgaccaagttctgcttccccttctacgtggacagcctgaccgtgagccaggtgggccagaacttcaccttcgtgctgaccgacatcgacagcaagcagagattcggcttctgcagactgagcagcggcgccaagagctgcttctgcatcctgagctacctgccctggttcgaggtgttctacaagctgctgaacatcctggccgactacaccaccaagagacaggagaaccagtggaacgagctgctggagaccctgcacaagctgcccatccccgaccccggcgtgagcgtgcacctgagcgtgcacagctacttcaccgtgcccgacaccagagagctgcccagcatccccgagaacagaaacctgaccgagtacttcgtggccgtggacgtgaacaacatgctgcacctgtacgccagcatgctgtacgagagaagaatcctgatcatctgcagcaagctgagcaccctgaccgcctgcatccacggcagcgccgccatgctgtaccccatgtactggcagcacgtgtacatccccgtgctgcccccccacctgctggactactgctgcgcccccatgccctacctgatcggcatccacctgagcctgatggagaaggtgagaaacatggccctggacgacgtggtgatcctgaacgtggacaccaacaccctggagacccccttcgacgacctgcagagcctgcccaacgacgtgatcagcagcctgaagaacagactgaagaaggtgagcaccaccaccggcgacggcgtggccagagccttcctgaaggcccaggccgccttcttcggcagctacagaaacgccctgaagatcgagcccgaggagcccatcaccttctgcgaggaggccttcgtgagccactacagaagcggcgccatgagacagttcctgcagaacgccacccagctgcagctgttcaagcagttcatcgacggcagactggacctgctgaacagcggcgagggcttcagcgacgtgttcgaggaggagatcaacatgggcgagtacgccggcagcgacaagctgtaccaccagtggctgagcaccgtgagaaagggcagcggcgccatcctgaacaccgtgaagaccaaggccaaccccgccatgaagaccgtgtacaagttcgccaaggaccacgccaagatgggcatcaaggaggtgaagaacagactgaagcagaaggacatcgccgagaacggctgcgcccccacccccgaggagcagctgcccaagaccgcccccagccccctggtggaggccaaggaccccaagctgagagaggacagaagacccatcaccgtgcacttcggccaggtgagaccccccagaccccacgtggtgaagagacccaagagcaacatcgccgtggagggcagaagaaccagcgtgcccagccccgagcacctggtgaagcccctgagacactacgccgtgttcctgagcgaggacagcagcgacgacgagtgccagagagaggagggccccagcagcggcttcaccgagagcttcttcttcagcgcccccttcgagtggccccagccctacagaaccctgagagagagcgacagcgccgagggcgacgaggccgagagccccgagcagcaggtgagaaagagcaccggccccgtgcccgccccccccgacagagccgccagcatcgacctgctggaggacgtgttcagcaacctggacatggaggccgccctgcagcccctgggccaggccaagagcctggaggacctgagagcccccaaggacctgagagagcagcccggcaccttcgactaccagagactggacctgggcggcagcgagagaagcagaggcgtgaccgtggccctgaagctgacccacccctacaacaagctgtggagcctgggccaggacgacatggccatccccagcaagccccccgccgccagccccgagaagcccagcgccctgctgggcaacagcctggccctgcccagaagaccccagaacagagacagcatcctgaaccccagcgacaaggaggaggtgcccacccccaccctgggcagcatcaccatccccagaccccagggcagaaagacccccgagctgggcatcgtgccccccccccccatccccagacccgccaagctgcaggccgccggcgccgccctgggcgacgtgagcgagagactgcagaccgacagagacagaagagccgccctgagccccggcctgctgcccggcgtggtgccccagggccccaccgagctgctgcagcccctgagccccggccccggcgccgccggcaccagcagcgacgccctgctggccctgctggaccccctgagcaccgcctggagcggcagcaccctgcccagcagacccgccacccccaacgtggccacccccttcaccccccagttcagcttcccccccgccggcacccccacccccttcccccagccccccctgaaccccttcgtgcccagcatgcccgccgccccccccaccctgcccctggtgagcacccccgccggccccttcggcgccccccccgccagcctgggccccgccttcgccagcggcctgctgctgagcagcgccggcttctgcgccccccacagaagccagcccaacctgagcgccctgagcatgcccaacctgttcggccagatgcccatgggcacccacaccagccccctgcagcccctgggcccccccgccgtggcccccagcagaatcagaaccctgcccctggccagaagcagcgccagagccgccgagaccaagcagggcctggccctgagacccggcgacccccccctgctgccccccagacccccccagggcctggagcccaccctgcagcccagcgccccccagcaggccagagaccccttcgaggacctgctgcagaagaccaagcaggacgtgagccccagccccgccctggcccccgcccccgacagcgtggagcagctgagaaagcagtgggagaccttcgagtag

SEQ ID NO: 78980 - DNA, 2385 bp, Artificial Sequence
  Description of Artificial Sequence: Synthetic coding sequence
atgctgtaccccatgtactggcagcacgtgtacatccccgtgctgcccccccacctgctggactactgctgcgcccccatgccctacctgatcggcatccacctgagcctgatggagaaggtgagaaacatggccctggacgacgtggtgatcctgaacgtggacaccaacaccctggagacccccttcgacgacctgcagagcctgcccaacgacgtggaggagcccatcaccttctgcgaggaggccttcgtgagccactacagaagcggcgccatgagacagttcctgcagaacgccacccagctgcagctgttcaagcagttcatcgacggcagactggacctgctgaacagcggcgagggcttcagcgacgtgttcgaggaggagatcaacatgggcgagtacgccggcagcgacaagctgtaccaccagtggctgagcaccgtgagaaagggcagcggcgccatcctgaacaccgtgaagaccaaggccaaccccgccatgaagaccgtgtacaagttcgccaaggaccacgccaagatgggcatcaaggaggtgaagaacagactgaagcagaaggacatcgccgagaacggctgcgcccccacccccgaggagcagctgcccaagaccgcccccagccccctggtggaggccaaggaccccaagctgagagaggacagaagacccatcaccgtgcacttcggccaggtgagaccccccagaccccacgtggtgaagagacccaagagcaacatcgccgtggagggcagaagaaccagcgtgcccagccccgagcacctggtgaagcccctgagacactacgccgtgttcctgagcgaggacagcagcgacgacgagtgccagagagaggagggccccagcagcggcttcaccgagagcttcttcttcagcgcccccttcgagtggccccagccctacagaaccctgagagagagcgacagcgccgagggcgacgaggccgagagccccgagcagcaggtgagaaagagcaccggccccgtgcccgccccccccgacagagccgccagcatcgacctgctggaggacgtgttcagcaacctggacatggaggccgccctgcagcccctgggccaggccaagagcctggaggacctgagagcccccaaggacctgagagagcagcccggcaccttcgactaccagagactggacctgggcggcagcgagagaagcagaggcgtgaccgtggccctgaagctgacccacccctacaacaagctgtggagcctgggccaggacgacatggccatccccagcaagccccccgccgccagccccgagaagcccagcgccctgctgggcaacagcctggccctgcccagaagaccccagaacagagacagcatcctgaaccccagcgacaaggaggaggtgcccacccccaccctgggcagcatcaccatccccagaccccagggcagaaagacccccgagctgggcatcgtgccccccccccccatccccagacccgccaagctgcaggccgccggcgccgccctgggcgacgtgagcgagagactgcagaccgacagagacagaagagccgccctgagccccggcctgctgcccggcgtggtgccccagggccccaccgagctgctgcagcccctgagccccggccccggcgccgccggcaccagcagcgacgccctgctggccctgctggaccccctgagcaccgcctggagcggcagcaccctgcccagcagacccgccacccccaacgtggccacccccttcaccccccagttcagcttcccccccgccggcacccccacccccttcccccagccccccctgaaccccttcgtgcccagcatgcccgccgccccccccaccctgcccctggtgagcacccccgccggccccttcggcgccccccccgccagcctgggccccgccttcgccagcggcctgctgctgagcagcgccggcttctgcgccccccacagaagccagcccaacctgagcgccctgagcatgcccaacctgttcggccagatgcccatgggcacccacaccagccccctgcagcccctgggcccccccgccgtggcccccagcagaatcagaaccctgcccctggccagaagcagcgccagagccgccgagaccaagcagggcctggccctgagacccggcgacccccccctgctgccccccagacccccccagggcctggagcccaccctgcagcccagcgccccccagcaggccagagaccccttcgaggacctgctgcagaagaccaagcaggacgtgagccccagccccgccctggcccccgcccccgacagcgtggagcagctgagaaagcagtgggagaccttcgagtag

SEQ ID NO: 78981 - DNA, 1191 bp, Artificial Sequence
  Description of Artificial Sequence: Synthetic coding sequence
atggccgccgcccccagagaggagaagagatggccccagcccgtgttcagcaaccccgtggtgctgtggaagttccccgaggacttcggcgaccaggagatcctgcagagcgtgcccaagttctgcttccccttcgacgtggagagagtgagccagaaccaggtgggccagcacttcaccttcgtgctgaccgacatcgagagcaagcagagattcggcttctgcagactgaccagcggcggcaccatctgcctgtgcatcctgagctacctgccctggttcgaggtgtactacaagctgctgaacaccctggccgactacctggccaaggagctggagaacgacctgaacgagaccctgagaagcctgtacaaccaccccgtgcccaaggccaacacccccgtgaacctgagcgtgcacagctacttcatcgcccccgacgtgaccggcctgcccaccatccccgagagcagaaacctgaccgagtacttcgtggccgtggacgtgaacaacatgctgcagctgtacgccagcatgctgcacgagagaagaatcgtgatcatcagcagcaagctgagcaccctgaccgcctgcatccacggcagcgccgccctgctgtaccccatgtactggcagcacatctacatccccgtgctgcccccccacctgctggactactgctgcgcccccatgccctacctgatcggcatccacagcagcctgatcgagagagtgaagaacaagagcctggaggacgtggtgatgctgaacgtggacaccaacaccctggagagccccttcagcgacctgaacaacctgcccagcgacgtggtgagcgccctgaagaacaagctgaagaagcagagcaccgccaccggcgacggcgtggccagagccttcctgagagcccaggccgccctgttcggcagctacagagacgccctgagatacaagcccggcgagcccatcaccttctgcgaggagagcttcgtgaagcacagaagcagcgtgatgaagcagttcctggagaccgccatcaacctgcagctgttcaagcagttcatcgacggcagactggccaagctgaacgccggcagaggcttcagcgacgtgttcgaggaggagatcaccagcggcggcttctgcggcggcaaggacaagctgcagtacgactaccccttcagccagtag

SEQ ID NO: 78982 - DNA, 1281 bp, Artificial Sequence
  Description of Artificial Sequence: Synthetic coding sequence
atggactgcagaaccaaggccaaccccgacagaaccttcgacctggtgctgaaggtgaagtgccacgccagcgagaacgaggaccccgtggtgctgtggaagttccccgaggacttcggcgaccaggagatcctgcagagcgtgcccaagttctgcttccccttcgacgtggagagagtgagccagaaccaggtgggccagcacttcaccttcgtgctgaccgacatcgagagcaagcagagattcggcttctgcagactgaccagcggcggcaccatctgcctgtgcatcctgagctacctgccctggttcgaggtgtactacaagctgctgaacaccctggccgactacctggccaaggagctggagaacgacctgaacgagaccctgagaagcctgtacaaccaccccgtgcccaaggccaacacccccgtgaacctgagcgtgaaccaggagatcttcatcgcctgcgagcaggtgctgaaggaccagcccgccctggtgccccacagctacttcatcgcccccgacgtgaccggcctgcccaccatccccgagagcagaaacctgaccgagtacttcgtggccgtggacgtgaacaacatgctgcagctgtacgccagcatgctgcacgagagaagaatcgtgatcatcagcagcaagctgagcaccctgaccgcctgcatccacggcagcgccgccctgctgtaccccatgtactggcagcacatctacatccccgtgctgcccccccacctgctggactactgctgcgcccccatgccctacctgatcggcatccacagcagcctgatcgagagagtgaagaacaagagcctggaggacgtggtgatgctgaacgtggacaccaacaccctggagagccccttcagcgacctgaacaacctgcccagcgacgtggtgagcgccctgaagaacaagctgaagaagcagagcaccgccaccggcgacggcgtggccagagccttcctgagagcccaggccgccctgttcggcagctacagagacgccctgagatacaagcccggcgagcccatcaccttctgcgaggagagcttcgtgaagcacagaagcagcgtgatgaagcagttcctggagaccgccatcaacctgcagctgttcaagcagttcatcgacggcagactggccaagctgaacgccggcagaggcttcagcgacgtgttcgaggaggagatcaccagcggcggcttctgcggcggcaaggacaagctgcagtacgactaccccttcagccagtag

SEQ ID NO: 78983 - DNA, 1191 bp, Artificial Sequence; identical to SEQ ID NO: 78981
  Description of Artificial Sequence: Synthetic coding sequence

SEQ ID NO: 78984 - DNA, 2268 bp, Artificial Sequence
  Description of Artificial Sequence: Synthetic coding sequence
atcgagaccaagaccagagccaaccccgacagaaccttcgacctggtgctgaaggtgaagtgccacgccagcgagaacgaggaccccgtggtgctgtggaagttccccgaggacttcggcgaccaggagatcctgcagagcgtgcccaagttctgcttccccttcgacgtggagagagtgagccagaaccaggtgggccagcacttcaccttcgtgctgaccgacatcgagagcaagcagagattcggcttctgcagactgaccagcggcggcaccatctgcctgtgcatcctgagctacctgccctggttcgaggtgtactacaagctgctgaacaccctggccgactacctggccaaggagctggagaacgacctgaacgagaccctgagaagcctgtacaaccaccccgtgcccaaggccaacacccccgtgaacctgagcgtgcacagctacttcatcgcccccgacgtgaccggcctgcccaccatccccgagagcagaaacctgaccgagtacttcgtggccgtggacgtgaacaacatgctgcagctgtacgccagcatgctgcacgagagaagaatcgtgatcatcagcagcaagctgagcaccctgaccgcctgcatccacggcagcgccgccctgctgtaccccatgtactggcagcacatctacatccccgtgctgcccccccacctgctggactactgctgcgcccccatgccctacctgatcggcatccacagcagcctgatcgagagagtgaagaacaagagcctggaggacgtggtgatgctgaacgtggacaccaacaccctggagagccccttcagcgacctgaacaacctgcccagcgacgtggtgagcgccctgaagaacaagctgaagaagcagagcaccgccaccggcgacggcgtggccagagccttcctgagagcccaggccgccctgttcggcagctacagagacgccctgagatacaagcccggcgagcccatcaccttctgcgaggagagcttcgtgaagcacagaagcagcgtgatgaagcagttcctggagaccgccatcaacctgcagctgttcaagcagttcatcgacggcagactggccaagctgaacgccggcagaggcttcagcgacgtgttcgaggaggagatcaccagcggcggcttctgcggcggcaaccccagaagctaccagcagtgggtgcacaccgtgaagaagggcggcgccctgttcaacaccgccatgaccaaggccacccccgccgtgagaaccgcctacaagttcgccaagaaccacgccaagctgggcctgaaggaggtgaagagcaagctgaagcacaaggagaacgaggaggactacggcacctgcagcagcagcgtgcagtacacccccgtgtacaagctgcacaacgagaagggcggcaacagcgagaagagaaagctggcccaggccagactgaagagacccctgaagagcctggacggcgccctgtacgacgacgaggacgacgacgacatcgagagagccagcaagctgagcagcgaggacggcgaggaggccagcgcctacctgtacgagagcgacgacagcgtggagaccagagtgaagaccccctacagcggcgagatggacctgctgggcgagatcctggacaccctgagcacccacagcagcgaccagggcaagctggccgccgccaagagcctggacttcttcagaagcatggacgacatcgactacaagcccaccaacaagagcaacgcccccagcgagaacaacctggccttcctgtgcggcggcagcggcgaccaggccgagtggaacctgggccaggacgacagcgccctgcacggcaagcacctgccccccagccccagaaagagagtgagcagcagcggcctgaccgacagcctgttcatcctgaaggaggagaacagcaacaagcacctgggcgccgacaacgtgagcgaccccaccagcggcctggacttccagctgaccagccccgaggtgagccagaccgacaagggcaagaccgagaagagagagaccctgagccagatcagcgacgacctgctgatccccggcctgggcagacacagcagcaccttcgtgccctgggagaaggagggcaaggaggccaaggagaccagcgaggacatcggcctgctgcacgaggtggtgagcctgtgccacatgaccagcgacttccagcagagcctgaacatcagcgacaagaacaccaacggcaaccagacctag

SEQ ID NO: 78985 - DNA, 2328 bp, Artificial Sequence
  Description of Artificial Sequence: Synthetic coding sequence
atcgagaccaagaccagagccaaccccgacagaaccttcgacctggtgctgaaggtgaagtgccacgccagcgagaacgaggaccccgtggtgctgtggaagttccccgaggacttcggcgaccaggagatcctgcagagcgtgcccaagttctgcttccccttcgacgtggagagagtgagccagaaccaggtgggccagcacttcaccttcgtgctgaccgacatcgagagcaagcagagattcggcttctgcagactgaccagcggcggcaccatctgcctgtgcatcctgagctacctgccctggttcgaggtgtactacaagctgctgaacaccctggccgactacctggccaaggagctggagaacgacctgaacgagaccctgagaagcctgtacaaccaccccgtgcccaaggccaacacccccgtgaacctgagcgtgaaccaggagatcttcatcgcctgcgagcaggtgctgaaggaccagcccgccctggtgccccacagctacttcatcgcccccgacgtgaccggcctgcccaccatccccgagagcagaaacctgaccgagtacttcgtggccgtggacgtgaacaacatgctgcagctgtacgccagcatgctgcacgagagaagaatcgtgatcatcagcagcaagctgagcaccctgaccgcctgcatccacggcagcgccgccctgctgtaccccatgtactggcagcacatctacatccccgtgctgcccccccacctgctggactactgctgcgcccccatgccctacctgatcggcatccacagcagcctgatcgagagagtgaagaacaagagcctggaggacgtggtgatgctgaacgtggacaccaacaccctggagagccccttcagcgacctgaacaacctgcccagcgacgtggtgagcgccctgaagaacaagctgaagaagcagagcaccgccaccggcgacggcgtggccagagccttcctgagagcccaggccgccctgttcggcagctacagagacgccctgagatacaagcccggcgagcccatcaccttctgcgaggagagcttcgtgaagcacagaagcagcgtgatgaagcagttcctggagaccgccatcaacctgcagctgttcaagcagttcatcgacggcagactggccaagctgaacgccggcagaggcttcagcgacgtgttcgaggaggagatcaccagcggcggcttctgcggcggcaaccccagaagctaccagcagtgggtgcacaccgtgaagaagggcggcgccctgttcaacaccgccatgaccaaggccacccccgccgtgagaaccgcctacaagttcgccaagaaccacgccaagctgggcctgaaggaggtgaagagcaagctgaagcacaaggagaacgaggaggactacggcacctgcagcagcagcgtgcagtacacccccgtgtacaagctgcacaacgagaagggcggcaacagcgagaagagaaagctggcccaggccagactgaagagacccctgaagagcctggacggcgccctgtacgacgacgaggacgacgacgacatcgagagagccagcaagctgagcagcgaggacggcgaggaggccagcgcctacctgtacgagagcgacgacagcgtggagaccagagtgaagaccccctacagcggcgagatggacctgctgggcgagatcctggacaccctgagcacccacagcagcgaccagggcaagctggccgccgccaagagcctggacttcttcagaagcatggacgacatcgactacaagcccaccaacaagagcaacgcccccagcgagaacaacctggccttcctgtgcggcggcagcggcgaccaggccgagtggaacctgggccaggacgacagcgccctgcacggcaagcacctgccccccagccccagaaagagagtgagcagcagcggcctgaccgacagcctgttcatcctgaaggaggagaacagcaacaagcacctgggcgccgacaacgtgagcgaccccaccagcggcctggacttccagctgaccagccccgaggtgagccagaccgacaagggcaagaccgagaagagagagaccctgagccagatcagcgacgacctgctgatccccggcctgggcagacacagcagcaccttcgtgccctgggagaaggagggcaaggaggccaaggagaccagcgaggacatcggcctgctgcacgaggtggtgagcctgtgccacatgaccagcgacttccagcagagcctgaacatcagcgacaagaacaccaacggcaaccagacctag

SEQ ID NO: 78986 - DNA, 1248 bp, Artificial Sequence
  Description of Artificial Sequence: Synthetic coding sequence
gtgaagcacagaagcagcgtgatgaagcagttcctggagaccgccatcaacctgcagctgttcaagcagttcatcgacggcagactggccaagctgaacgccggcagaggcttcagcgacgtgttcgaggaggagatcaccagcggcggcttctgcggcggcaaccccagaagctaccagcagtgggtgcacaccgtgaagaagggcggcgccctgttcaacaccgccatgaccaaggccacccccgccgtgagaaccgcctacaagttcgccaagaaccacgccaagctgggcctgaaggaggtgaagagcaagctgaagcacaaggagaacgaggaggactacggcacctgcagcagcagcgtgcagtacacccccgtgtacaagctgcacaacgagaagggcggcaacagcgagaagagaaagctggcccaggccagactgaagagacccctgaagagcctggacggcgccctgtacgacgacgaggacgacgacgacatcgagagagccagcaagctgagcagcgaggacggcgaggaggccagcgcctacctgtacgagagcgacgacagcgtggagaccagagtgaagaccccctacagcggcgagatggacctgctgggcgagatcctggacaccctgagcacccacagcagcgaccagggcaagctggccgccgccaagagcctggacttcttcagaagcatggacgacatcgactacaagcccaccaacaagagcaacgcccccagcgagaacaacctggccttcctgtgcggcggcagcggcgaccaggccgagtggaacctgggccaggacgacagcgccctgcacggcaagcacctgccccccagccccagaaagagagtgagcagcagcggcctgaccgacagcctgttcatcctgaaggaggagaacagcaacaagcacctgggcgccgacaacgtgagcgaccccaccagcggcctggacttccagctgaccagccccgaggtgagccagaccgacaagggcaagaccgagaagagagagaccctgagccagatcagcgacgacctgctgatccccggcctgggcagacacagcagcaccttcgtgccctgggagaaggagggcaaggaggccaaggagaccagcgaggacatcggcctgctgcacgaggtggtgagcctgtgccacatgaccagcgacttccagcagagcctgaacatcagcgacaagaacaccaacggcaaccagacctag

SEQ ID NO: 78987 - DNA, 2406 bp, Artificial Sequence
  Description of Artificial Sequence: Synthetic coding sequence
atggagagcagagccgagggcggcagccccgccgtgttcgactggttcttcgaggccgcctgccccgccagcctgcaggaggacccccccatcctgagacagttcccccccgacttcagagaccaggaggccatgcagatggtgcccaagttctgcttccccttcgacgtggagagagagccccccagccccgccgtgcagcacttcaccttcgccctgaccgacctggccggcaacagaagattcggcttctgcagactgagagccggcacccagagctgcctgtgcatcctgagccacctgccctggttcgaggtgttctacaagctgctgaacaccgtgggcgacctgctggcccaggaccaggtgaccgaggccgaggagctgctgcagaacctgttccagcagagcctgagcggcccccaggccagcgtgggcctggagctgggcagcggcgtgaccgtgagcagcggccagggcatccccccccccaccagaggcaacagcaagcccctgagctgcttcgtggcccccgacagcggcagactgcccagcatccccgagaacagaaacctgaccgagctggtggtggccgtgaccgacgagaacatcgtgggcctgttcgccgccctgctggccgagagaagagtgctgctgaccgccagcaagctgagcaccctgaccagctgcgtgcacgccagctgcgccctgctgtaccccatgagatgggagcacgtgctgatccccaccctgcccccccacctgctggactactgctgcgcccccatgccctacctgatcggcgtgcacgccagcctggccgagagagtgagagagaaggccctggaggacgtggtggtgctgaacgtggacgccaacaccctggagaccaccttcaacgacgtgcaggccctgccccccgacgtggtgagcctgctgagactgagactgagaaaggtggccctggcccccggcgagggcgtgagcagactgttcctgaaggcccaggccctgctgttcggcggctacagagacgccctggtgtgcagccccggccagcccgtgaccttcagcgaggaggtgttcctggcccagaagcccggcgcccccctgcaggccttccacagaagagccgtgcacctgcagctgttcaagcagttcatcgaggccagactggagaagctgaacaagggcgagggcttcagcgaccagttcgagcaggagatcaccggctgcggcgccagcagcggcgccctgagaagctaccagctgtgggccgacaacctgaagaagggcggcggcgccctgctgcacagcgtgaaggccaagacccagcccgccgtgaagaacatgtacagaagcgccaagagcggcctgaagggcgtgcagagcctgctgatgtacaaggacggcgacagcgtgctgcagagaggcggcagcctgagagcccccgccctgcccagcagaagcgacagactgcagcagagactgcccatcacccagcacttcggcaagaacagacccctgagacccagcagaagaagacagctggaggagggcaccagcgagccccccggcgccggcaccccccccctgagccccgaggacgagggctgcccctgggccgaggaggccctggacagcagcttcctgggcagcggcgaggagctggacctgctgagcgagatcctggacagcctgagcatgggcgccaagagcgccggcagcctgagacccagccagagcctggactgctgccacagaggcgacctggacagctgcttcagcctgcccaacatccccagatggcagcccgacgacaagaagctgcccgagcccgagccccagcccctgagcctgcccagcctgcagaacgccagcagcctggacgccaccagcagcagcaaggacagcagaagccagctgatccccagcgagagcgaccaggaggtgaccagccccagccagagcagcaccgccagcgccgaccccagcatctggggcgaccccaagcccagccccctgaccgagcccctgatcctgcacctgacccccagccacaaggccgccgaggacagcaccgcccaggagaaccccaccccctggctgagcaccgcccccaccgagcccagcccccccgagagcccccagatcctggcccccaccaagcccaacttcgacatcgcctggaccagccagcccctggaccccagcagcgaccccagcagcctggaggaccccagagccagaccccccaaggccctgctggccgagagagcccacctgcagcccagagaggagcccggcgccctgaacagccccgccacccccaccagcaactgccagaagagccagcccagcagcagacccagagtggccgacctgaagaagtgcttcgagggctag

SEQ ID NO: 78988 - DNA, 2274 bp, Artificial Sequence
  Description of Artificial Sequence: Synthetic coding sequence
atgcagatggtgcccaagttctgcttccccttcgacgtggagagagagccccccagccccgccgtgcagcacttcaccttcgccctgaccgacctggccggcaacagaagattcggcttctgcagactgagagccggcacccagagctgcctgtgcatcctgagccacctgccctggttcgaggtgttctacaagctgctgaacaccgtgggcgacctgctggcccaggaccaggtgaccgaggccgaggagctgctgcagaacctgttccagcagagcctgagcggcccccaggccagcgtgggcctggagctgggcagcggcgtgaccgtgagcagcggccagggcatccccccccccaccagaggcaacagcaagcccctgagctgcttcgtggcccccgacagcggcagactgcccagcatccccgagaacagaaacctgaccgagctggtggtggccgtgaccgacgagaacatcgtgggcctgttcgccgccctgctggccgagagaagagtgctgctgaccgccagcaagctgagcaccctgaccagctgcgtgcacgccagctgcgccctgctgtaccccatgagatgggagcacgtgctgatccccaccctgcccccccacctgctggactactgctgcgcccccatgccctacctgatcggcgtgcacgccagcctggccgagagagtgagagagaaggccctggaggacgtggtggtgctgaacgtggacgccaacaccctggagaccaccttcaacgacgtgcaggccctgccccccgacgtggtgagcctgctgagactgagactgagaaaggtggccctggcccccggcgagggcgtgagcagactgttcctgaaggcccaggccctgctgttcggcggctacagagacgccctggtgtgcagccccggccagcccgtgaccttcagcgaggaggtgttcctggcccagaagcccggcgcccccctgcaggccttccacagaagagccgtgcacctgcagctgttcaagcagttcatcgaggccagactggagaagctgaacaagggcgagggcttcagcgaccagttcgagcaggagatcaccggctgcggcgccagcagcggcgccctgagaagctaccagctgtgggccgacaacctgaagaagggcggcggcgccctgctgcacagcgtgaaggccaagacccagcccgccgtgaagaacatgtacagaagcgccaagagcggcctgaagggcgtgcagagcctgctgatgtacaaggacggcgacagcgtgctgcagagaggcggcagcctgagagcccccgccctgcccagcagaagcgacagactgcagcagagactgcccatcacccagcacttcggcaagaacagacccctgagacccagcagaagaagacagctggaggagggcaccagcgagccccccggcgccggcaccccccccctgagccccgaggacgagggctgcccctgggccgaggaggccctggacagcagcttcctgggcagcggcgaggagctggacctgctgagcgagatcctggacagcctgagcatgggcgccaagagcgccggcagcctgagacccagccagagcctggactgctgccacagaggcgacctggacagctgcttcagcctgcccaacatccccagatggcagcccgacgacaagaagctgcccgagcccgagccccagcccctgagcctgcccagcctgcagaacgccagcagcctggacgccaccagcagcagcaaggacagcagaagccagctgatccccagcgagagcgaccaggaggtgaccagccccagccagagcagcaccgccagcgccgaccccagcatctggggcgaccccaagcccagccccctgaccgagcccctgatcctgcacctgacccccagccacaaggccgccgaggacagcaccgcccaggagaaccccaccccctggctgagcaccgcccccaccgagcccagcccccccgagagcccccagatcctggcccccaccaagcccaacttcgacatcgcctggaccagccagcccctggaccccagcagcgaccccagcagcctggaggaccccagagccagaccccccaaggccctgctggccgagagagcccacctgcagcccagagaggagcccggcgccctgaacagccccgccacccccaccagcaactgccagaagagccagcccagcagcagacccagagtggccgacctgaagaagtgcttcgagggctag

SEQ ID NO: 78989 - DNA, 2193 bp, Artificial Sequence
  Description of Artificial Sequence: Synthetic coding sequence
atgctgttcaacagcgtgctgagacagccccagctgggcgtgctgagaaacggctggagcagccagtaccccctgcagagcctgctgaccggctaccagtgcagcggcaacgacgagcacaccagctacggcgagaccggcgtgcccgtgccccccttcggctgcaccttcagcagcgcccccaacatggagcacgtgctggccgtggccaacgaggagggcttcgtgagactgtacaacaccgagagccagagcttcagaaagaagtgcttcaaggagtggatggcccactggaacgccgtgttcgacctggcctgggtgcccggcgagctgaagctggtgaccgccgccggcgaccagaccgccaagttctgggacgtgaaggccggcgagctgatcggcacctgcaagggccaccagtgcagcctgaagagcgtggccttcagcaagttcgagaaggccgtgttctgcaccggcggcagagacggcaacatcatggtgtgggacaccagatgcaacaagaaggacggcttctacagacaggtgaaccagatcagcggcgcccacaacaccagcgacaagcagacccccagcaagcccaagaagaagcagaacagcaagggcctggcccccagcgtggacttccagcagagcgtgaccgtggtgctgttccaggacgagaacaccctggtgagcgccggcgccgtggacggcatcatcaaggtgtgggacctgagaaagaactacaccgcctacagacaggagcccatcgccagcaagagcttcctgtaccccggcagcagcaccagaaagctgggctacagcagcctgatcctggacagcaccggcagcaccctgttcgccaactgcaccgacgacaacatctacatgttcaacatgaccggcctgaagaccagccccgtggccatcttcaacggccaccagaacagcaccttctacgtgaagagcagcctgagccccgacgaccagttcctggtgagcggcagcagcgacgaggccgcctacatctggaaggtgagcaccccctggcagccccccaccgtgctgctgggccacagccaggaggtgaccagcgtgtgctggtgccccagcgacttcaccaagatcgccacctgcagcgacgacaacaccctgaagatctggagactgaacagaggcctggaggagaagcccggcggcgacaagctgagcaccgtgggctgggccagccagaagaagaaggagagcagacccggcctggtgaccgtgaccagcagccagagcacccccgccaaggcccccagagccaagtgcaaccccagcaacagcagccccagcagcgccgcctgcgcccccagctgcgccggcgacctgcccctgcccagcaacacccccaccttcagcatcaagaccagccccgccaaggccagaagccccatcaacagaagaggcagcgtgagcagcgtgagccccaagccccccagcagcttcaagatgagcatcagaaactgggtgaccagaacccccagcagcagcccccccatcaccccccccgccagcgagaccaagatcatgagccccagaaaggccctgatccccgtgagccagaagagcagccaggccgaggcctgcagcgagagcagaaacagagtgaagagaagactggacagcagctgcctggagagcgtgaagcagaagtgcgtgaagagctgcaactgcgtgaccgagctggacggccaggtggagaacctgcacctggacctgtgctgcctggccggcaaccaggaggacctgagcaaggacagcctgggccccaccaagagcagcaagatcgagggcgccggcaccagcatcagcgagccccccagccccatcagcccctacgccagcgagagctgcggcaccctgcccctgcccctgagaccctgcggcgagggcagcgagatggtgggcaaggagaacagcagccccgagaacaagaactggctgctggccatggccgccaagagaaaggccgagaaccccagccccagaagccccagcagccagacccccaacagcagaagacagagcggcaagaagctgcccagccccgtgaccatcacccccagcagcatgagaaagatctgcacctacttccacagaaagagccaggaggacttctgcggccccgagcacagcaccgagctgtag

SEQ ID NO: 78990 - DNA, 1230 bp, Artificial Sequence
  Description of Artificial Sequence: Synthetic coding sequence
atgctgttcaacagcgtgctgagacagccccagctgggcgtgctgagaaacggctggagcagccagtaccccctgcagagcctgctgaccggctaccagtgcagcggcaacgacgagcacaccagctacggcgagaccggcgtgcccgtgccccccttcggctgcaccttcagcagcgacgacaacaccctgaagatctggagactgaacagaggcctggaggagaagcccggcggcgacaagctgagcaccgtgggctgggccagccagaagaagaaggagagcagacccggcctggtgaccgtgaccagcagccagagcacccccgccaaggcccccagagccaagtgcaaccccagcaacagcagccccagcagcgccgcctgcgcccccagctgcgccggcgacctgcccctgcccagcaacacccccaccttcagcatcaagaccagccccgccaaggccagaagccccatcaacagaagaggcagcgtgagcagcgtgagccccaagccccccagcagcttcaagatgagcatcagaaactgggtgaccagaacccccagcagcagcccccccatcaccccccccgccagcgagaccaagatcatgagccccagaaaggccctgatccccgtgagccagaagagcagccaggccgaggcctgcagcgagagcagaaacagagtgaagagaagactggacagcagctgcctggagagcgtgaagcagaagtgcgtgaagagctgcaactgcgtgaccgagctggacggccaggtggagaacctgcacctggacctgtgctgcctggccggcaaccaggaggacctgagcaaggacagcctgggccccaccaagagcagcaagatcgagggcgccggcaccagcatcagcgagccccccagccccatcagcccctacgccagcgagagctgcggcaccctgcccctgcccctgagaccctgcggcgagggcagcgagatggtgggcaaggagaacagcagccccgagaacaagaactggctgctggccatggccgccaagagaaaggccgagaaccccagccccagaagccccagcagccagacccccaacagcagaagacagagcggcaagaagctgcccagccccgtgaccatcacccccagcagcatgagaaagatctgcacctacttccacagaaagagccaggaggacttctgcggccccgagcacagcaccgagctgtag

SEQ ID NO: 78991 - DNA, 2067 bp, Artificial Sequence
  Description of Artificial Sequence: Synthetic coding sequence
atgctgttcaacagcgtgctgagacagccccagctgggcgtgctgagaaacgcccccaacatggagcacgtgctggccgtggccaacgaggagggcttcgtgagactgtacaacaccgagagccagagcttcagaaagaagtgcttcaaggagtggatggcccactggaacgccgtgttcgacctggcctgggtgcccggcgagctgaagctggtgaccgccgccggcgaccagaccgccaagttctgggacgtgaaggccggcgagctgatcggcacctgcaagggccaccagtgcagcctgaagagcgtggccttcagcaagttcgagaaggccgtgttctgcaccggcggcagagacggcaacatcatggtgtgggacaccagatgcaacaagaaggacggcttctacagacaggtgaaccagatcagcggcgcccacaacaccagcgacaagcagacccccagcaagcccaagaagaagcagaacagcaagggcctggcccccagcgtggacttccagcagagcgtgaccgtggtgctgttccaggacgagaacaccctggtgagcgccggcgccgtggacggcatcatcaaggtgtgggacctgagaaagaactacaccgcctacagacaggagcccatcgccagcaagagcttcctgtaccccggcagcagcaccagaaagctgggctacagcagcctgatcctggacagcaccggcagcaccctgttcgccaactgcaccgacgacaacatctacatgttcaacatgaccggcctgaagaccagccccgtggccatcttcaacggccaccagaacagcaccttctacgtgaagagcagcctgagccccgacgaccagttcctggtgagcggcagcagcgacgaggccgcctacatctggaaggtgagcaccccctggcagccccccaccgtgctgctgggccacagccaggaggtgaccagcgtgtgctggtgccccagcgacttcaccaagatcgccacctgcagcgacgacaacaccctgaagatctggagactgaacagaggcctggaggagaagcccggcggcgacaagctgagcaccgtgggctgggccagccagaagaagaaggagagcagacccggcctggtgaccgtgaccagcagccagagcacccccgccaaggcccccagagccaagtgcaaccccagcaacagcagccccagcagcgccgcctgcgcccccagctgcgccggcgacctgcccctgcccagcaacacccccaccttcagcatcaagaccagccccgccaaggccagaagccccatcaacagaagaggcagcgtgagcagcgtgagccccaagccccccagcagcttcaagatgagcatcagaaactgggtgaccagaacccccagcagcagcccccccatcaccccccccgccagcgagaccaagatcatgagccccagaaaggccctgatccccgtgagccagaagagcagccaggccgaggcctgcagcgagagcagaaacagagtgaagagaagactggacagcagctgcctggagagcgtgaagcagaagtgcgtgaagagctgcaactgcgtgaccgagctggacggccaggtggagaacctgcacctggacctgtgctgcctggccggcaaccaggaggacctgagcaaggacagcctgggccccaccaagagcagcaagatcgagggcgccggcaccagcatcagcgagccccccagccccatcagcccctacgccagcgagagctgcggcaccctgcccctgcccctgagaccctgcggcgagggcagcgagatggtgggcaaggagaacagcagccccgagaacaagaactggctgctggccatggccgccaagagaaaggccgagaaccccagccccagaagccccagcagccagacccccaacagcagaagacagagcggcaagaagctgcccagccccgtgaccatcacccccagcagcatgagaaagatctgcacctacttccacagaaagagccaggaggacttctgcggccccgagcacagcaccgagctgtag

SEQ ID NO: 78992 - DNA, 1494 bp, Artificial Sequence
  Description of Artificial Sequence: Synthetic coding sequence
atgaagatcagcatcctgctgatgttcctgtggggcctgagctgcgccctgcccgtgaccagataccagaacaacgagagcgaggacagcgaggagtggaagggccacctggcccaggcccccaccccccccctggccaacgaggaccccagcgacagcacccagagcgaggagggcctgggcagcgacgaccaccagtacatctacagactggccggcggcttcagcagaagcaccggcaagggcggcgacgacaaggacgacgacgaggacgacagcggcgacgacaccttcggcgacgacgacagcggccccggccccaaggacagacaggagggcggcaacagcagactgggcagcgacgaggacagcgacgacaccatccaggccagcgaggagagcgccccccagggccaggacagcgcccaggacaccaccagcgagagcagagagctggacaacgaggacagagtggacagcaagcccgagggcggcgacagcacccaggagagcgagagcgaggagcactgggtgggcggcggcagcgacggcgagagcagccacggcgacggcagcgagctggacgacgagggcatgcagagcgacgaccccgagagcatcagaagcgagagaggcaacagcagaatgaacagcgccggcatgaagagcaaggagagcggcgagaacagcgagcaggccaacacccaggacagcggcggcagccagctgctggagcaccccagcagaaagatcttcagaaagagcagaatcagcgaggaggacgacagaagcgagctggacgacaacaacaccatggaggaggtgaagagcgacagcaccgagaacagcaacagcagagacaccggcctgagccagcccagaagagacagcaagggcgacagccaggaggacagcaaggagaacctgagccaggaggagagccagaacgtggacggccccagcagcgagagcagccaggaggccaacctgagcagccaggagaacagcagcgagagccaggaggaggtggtgagcgagagcagaggcgacaaccccgaccccaccaccagctacgtggaggaccaggaggacagcgacagcagcgaggaggacagcagccacaccctgagccacagcaagagcgagagcagagaggagcaggccgacagcgagagcagcgagagcctgaacttcagcgaggagagccccgagagccccgaggacgagaacagcagcagccaggagggcctgcagagccacagcagcagcgccgagagccagagcgaggagagccacagcgaggaggacgacagcgacagccaggacagcagcagaagcaaggaggacagcaacagcaccgagagcaagagcagcagcgaggaggacggccagctgaagaacatcgagatcgagagcagaaagctgaccgtggacgcctaccacaacaagcccatcggcgaccaggacgacaacgactgccaggacggctactag

SEQ ID NO: 78993 - DNA, 1542 bp, Artificial Sequence
  Description of Artificial Sequence: Synthetic coding sequence
atgaagatcagcatcctgctgatgttcctgtggggcctgagctgcgccctgcccgtgaccagataccagaacaacgagagcgaggacagcgaggagtggaagggccacctggcccaggcccccaccccccccctggagagcagcgagagcagcgagggcagcaaggtgagcagcgaggagcaggccaacgaggaccccagcgacagcacccagagcgaggagggcctgggcagcgacgaccaccagtacatctacagactggccggcggcttcagcagaagcaccggcaagggcggcgacgacaaggacgacgacgaggacgacagcggcgacgacaccttcggcgacgacgacagcggccccggccccaaggacagacaggagggcggcaacagcagactgggcagcgacgaggacagcgacgacaccatccaggccagcgaggagagcgccccccagggccaggacagcgcccaggacaccaccagcgagagcagagagctggacaacgaggacagagtggacagcaagcccgagggcggcgacagcacccaggagagcgagagcgaggagcactgggtgggcggcggcagcgacggcgagagcagccacggcgacggcagcgagctggacgacgagggcatgcagagcgacgaccccgagagcatcagaagcgagagaggcaacagcagaatgaacagcgccggcatgaagagcaaggagagcggcgagaacagcgagcaggccaacacccaggacagcggcggcagccagctgctggagcaccccagcagaaagatcttcagaaagagcagaatcagcgaggaggacgacagaagcgagctggacgacaacaacaccatggaggaggtgaagagcgacagcaccgagaacagcaacagcagagacaccggcctgagccagcccagaagagacagcaagggcgacagccaggaggacagcaaggagaacctgagccaggaggagagccagaacgtggacggccccagcagcgagagcagccaggaggccaacctgagcagccaggagaacagcagcgagagccaggaggaggtggtgagcgagagcagaggcgacaaccccgaccccaccaccagctacgtggaggaccaggaggacagcgacagcagcgaggaggacagcagccacaccctgagccacagcaagagcgagagcagagaggagcaggccgacagcgagagcagcgagagcctgaacttcagcgaggagagccccgagagccccgaggacgagaacagcagcagccaggagggcctgcagagccacagcagcagcgccgagagccagagcgaggagagccacagcgaggaggacgacagcgacagccaggacagcagcagaagcaaggaggacagcaacagcaccgagagcaagagcagcagcgaggaggacggccagctgaagaacatcgagatcgagagcagaaagctgaccgtggacgcctaccacaacaagcccatcggcgaccaggacgacaacgactgccaggacggctactag

SEQ ID NO: 78994 - DNA, 3906 bp, Artificial Sequence
  Description of Artificial Sequence: Synthetic coding sequence
atgaagatcatcacctacttctgcatctgggccgtggcctgggccatccccgtgccccagagcaagcccctggagagacacgtggagaagagcatgaacctgcacctgctggccagaagcaacgtgagcgtgcaggacgagctgaacgccagcggcaccatcaaggagagcggcgtgctggtgcacgagggcgacagaggcagacaggagaacacccaggacggccacaagggcgagggcaacggcagcaagtgggccgaggtgggcggcaagagcttcagcacctacagcaccctggccaacgaggagggcaacatcgagggctggaacggcgacaccggcaaggccgagacctacggccacgacggcatccacggcaaggaggagaacatcaccgccaacggcatccagggccaggtgagcatcatcgacaacgccggcgccaccaacagaagcaacaccaacggcaacaccgacaagaacacccagaacggcgacgtgggcgacgccggccacaacgaggacgtggccgtggtgcaggaggacggcccccaggtggccggcagcaacaacagcaccgacaacgaggacgagatcatcgagaacagctgcagaaacgagggcaacaccagcgagatcaccccccagatcaacagcaagagaaacggcaccaaggaggccgaggtgacccccggcaccggcgaggacgccggcctggacaacagcgacggcagccccagcggcaacggcgccgacgaggacgaggacgagggcagcggcgacgacgaggacgaggaggccggcaacggcaaggacagcagcaacaacagcaagggccaggagggccaggaccacggcaaggaggacgaccacgacagcagcatcggccagaacagcgacagcaaggagtactacgaccccgagggcaaggaggacccccacaacgaggtggacggcgacaagaccagcaagagcgaggagaacagcgccggcatccccgaggacaacggcagccagagaatcgaggacacccagaagctgaaccacagagagagcaagagagtggagaacagaatcaccaaggagagcgagacccacgccgtgggcaagagccaggacaagggcatcgagatcaagggccccagcagcggcaacagaaacatcaccaaggaggtgggcaagggcaacgagggcaaggaggacaagggccagcacggcatgatcctgggcaagggcaacgtgaagacccagggcgaggtggtgaacatcgagggccccggccagaagagcgagcccggcaacaaggtgggccacagcaacaccggcagcgacagcaacagcgacggctacgacagctacgacttcgacgacaagagcatgcagggcgacgaccccaacagcagcgacgagagcaacggcaacgacgacgccaacagcgagagcgacaacaacagcagcagcagaggcgacgccagctacaacagcgacgagagcaaggacaacggcaacggcagcgacagcaagggcgccgaggacgacgacagcgacagcaccagcgacaccaacaacagcgacagcaacggcaacggcaacaacggcaacgacgacaacgacaagagcgacagcggcaagggcaagagcgacagcagcgacagcgacagcagcgacagcagcaacagcagcgacagcagcgacagcagcgacagcgacagcagcgacagcaacagcagcagcgacagcgacagcagcgacagcgacagcagcgacagcagcgacagcgacagcagcgacagcagcaacagcagcgacagcagcgacagcagcgacagcagcgacagcagcgacagcagcgacagcagcgacagcaagagcgacagcagcaagagcgagagcgacagcagcgacagcgacagcaagagcgacagcagcgacagcaacagcagcgacagcagcgacaacagcgacagcagcgacagcagcaacagcagcaacagcagcgacagcagcgacagcagcgacagcagcgacagcagcagcagcagcgacagcagcaacagcagcgacagcagcgacagcagcgacagcagcaacagcagcgagagcagcgacagcagcgacagcagcgacagcgacagcagcgacagcagcgacagcagcaacagcaacagcagcgacagcgacagcagcaacagcagcgacagcagcgacagcagcaacagcagcgacagcagcgacagcagcgacagcagcaacagcagcgacagcagcgacagcagcgacagcagcaacagcagcgacagcagcgacagcagcgacagcagcgacagcagcgacagcagcaacagcagcgacagcaacgacagcagcaacagcagcgacagcagcgacagcagcaacagcagcgacagcagcaacagcagcgacagcagcgacagcagcgacagcagcgacagcgacagcagcaacagcagcgacagcagcaacagcagcgacagcagcgacagcagcaacagcagcgacagcagcgacagcagcgacagcagcgacggcagcgacagcgacagcagcaacagaagcgacagcagcaacagcagcgacagcagcgacagcagcgacagcagcaacagcagcgacagcagcgacagcagcgacagcaacgagagcagcaacagcagcgacagcagcgacagcagcaacagcagcgacagcgacagcagcgacagcagcaacagcagcgacagcagcgacagcagcaacagcagcgacagcagcgagagcagcaacagcagcgacaacagcaacagcagcgacagcagcaacagcagcgacagcagcgacagcagcgacagcagcaacagcagcgacagcagcaacagcagcgacagcagcaacagcagcgacagcagcgacagcaacagcagcgacagcagcgacagcagcaacagcagcgacagcagcgacagcagcgacagcagcgacagcagcgacagcagcgacagcagcaacagcagcgacagcagcgacagcagcgacagcagcgacagcagcaacagcagcgacagcagcaacagcagcgacagcagcaacagcagcgacagcagcgacagcagcgacagcagcgacagcagcgacagcagcgacagcagcgacagcagcgacagcagcaacagcagcgacagcagcgacagcagcgacagcagcgacagcagcgacagcagcgacagcagcgacagcagcgacagcagcgagagcagcgacagcagcgacagcagcaacagcagcgacagcagcgacagcagcgacagcagcgacagcagcgacagcagcgacagcagcgacagcagcgacagcagcgacagcagcaacagcagcgacagcagcgacagcagcgacagcagcgacagcagcgacagcagcaacagcagcgacagcagcgacagcagcgagagcagcgacagcagcgacagcagcgacagcagcgacagcagcgacagcagcgacagcagcgacagcagcgacagcagcgacagcagcaacagcagcgacagcagcgacagcagcgacagcagcgacagcagcgacagcagcgacagcagcgacagcagcgacagcagcgacagcagcgacagcagcgacagcagcgacagcagcgacagcagcgacagcagcgacagcagcgacagcagcgacagcaacgagagcagcgacagcagcgacagcagcgacagcagcgacagcagcaacagcagcgacagcagcgacagcagcgacagcagcgacagcaccagcgacagcaacgacgagagcgacagccagagcaagagcggcaacggcaacaacaacggcagcgacagcgacagcgacagcgagggcagcgacagcaaccacagcaccagcgacgactag

SEQ ID NO: 78995 - DNA, 3906 bp, Artificial Sequence; identical to SEQ ID NO: 78994
  Description of Artificial Sequence: Synthetic coding sequence

SEQ ID NO: 78996 - DNA, 783 bp, Artificial Sequence
  Description of Artificial Sequence: Synthetic coding sequence
atggccaccccccccaagagaagctgccccagcttcagcgccagcagcgagggcaccagaatcaagaagatcagcatcgagggcaacatcgccgccggcaagagcaccttcgtgaacatcctgaagcagctgtgcgaggactgggaggtggtgcccgagcccgtggccagatggtgcaacgtgcagagcacccaggacgagttcgaggagctgaccatgagccagaagaacggcggcaacgtgctgcagatgatgtacgagaagcccgagagatggagcttcaccttccagacctacgcctgcctgagcagaatcagagcccagctggccagcctgaacggcaagctgaaggacgccgagaagcccgtgctgttcttcgagagaagcgtgtacagcgacagatacatcttcgccagcaacctgtacgagagcgagtgcatgaacgagaccgagtggaccatctaccaggactggcacgactggatgaacaaccagttcggccagagcctggagctggacggcatcatctacctgcaggccacccccgagacctgcctgcacagaatctacctgagaggcagaaacgaggagcagggcatccccctggagtacctggagaagctgcactacaagcacgagagctggctgctgcacagaaccctgaagaccaacttcgactacctgcaggaggtgcccatcctgaccctggacgtgaacgaggacttcaaggacaagtacgagagcctggtggagaaggtgaaggagttcctgagcaccctgtag

SEQ ID NO: 78997 - DNA, 48 bp, Artificial Sequence
  Description of Artificial Sequence: Synthetic coding sequence
atggccaccccccccaagagaagctgccccagcttcagcgccagctag

SEQ ID NO: 78998 - DNA, 834 bp, Artificial Sequence
  Description of Artificial Sequence: Synthetic coding sequence
atggccgccggcagactgttcctgagcagactgagagcccccttcagcagcatggccaagagccccctggagggcgtgagcagcagcagaggcctgcacgccggcagaggccccagaagactgagcatcgagggcaacatcgccgtgggcaagagcaccttcgtgaagctgctgaccaagacctaccccgagtggcacgtggccaccgagcccgtggccacctggcagaacatccaggccgccggcacccagaaggcctgcaccgcccagagcctgggcaacctgctggacatgatgtacagagagcccgccagatggagctacaccttccagaccttcagcttcctgagcagactgaaggtgcagctggagcccttccccgagaagctgctgcaggccagaaagcccgtgcagatcttcgagagaagcgtgtacagcgacagatacatcttcgccaagaacctgttcgagaacggcagcctgagcgacatcgagtggcacatctaccaggactggcacagcttcctgctgtgggagttcgccagcagaatcaccctgcacggcttcatctacctgcaggccagcccccaggtgtgcctgaagagactgtaccagagagccagagaggaggagaagggcatcgagctggcctacctggagcagctgcacggccagcacgaggcctggctgatccacaagaccaccaagctgcacttcgaggccctgatgaacatccccgtgctggtgctggacgtgaacgacgacttcagcgaggaggtgaccaagcaggaggacctgatgagagaggtgaacaccttcgtgaagaacctgtag

SEQ ID NO: 78999 - DNA, 720 bp, Artificial Sequence
  Description of Artificial Sequence: Synthetic coding sequence
atggccgccggcagactgttcctgagcagactgagagcccccttcagcagcatggccaagagccccctggagggcgtgagcagcagcagaggcctgcacgccggcagaggccccagaagactgagcatcgagggcaacatcgcctgcaccgcccagagcctgggcaacctgctggacatgatgtacagagagcccgccagatggagctacaccttccagaccttcagcttcctgagcagactgaaggtgcagctggagcccttccccgagaagctgctgcaggccagaaagcccgtgcagatcttcgagagaagcgtgtacagcgacagatacatcttcgccaagaacctgttcgagaacggcagcctgagcgacatcgagtggcacatctaccaggactggcacagcttcctgctgtgggagttcgccagcagaatcaccctgcacggcttcatctacctgcaggccagcccccaggtgtgcctgaagagactgtaccagagagccagagaggaggagaagggcatcgagctggcctacctggagcagctgcacggccagcacgaggcctggctgatccacaagaccaccaagctgcacttcgaggccctgatgaacatccccgtgctggtgctggacgtgaacgacgacttcagcgaggaggtgaccaagcaggaggacctgatgagagaggtgaacaccttcgtgaagaacctgtag

SEQ ID NO: 79000 - DNA, 570 bp, Artificial Sequence
  Description of Artificial Sequence: Synthetic coding sequence
atggccgccggcagactgttcctgagcagactgagagcccccttcagcagcatggccaagagccccctggagggcgtgagcagcagcagaggcctgcacgccggcagaggccccagaagactgagcatcgagggcaacatcgccgtgggcaagagcaccttcgtgaagctgctgaccaagacctaccccgagtggcacgtggccaccgagcccgtggccacctggcagaacatccaggccgccggcacccagaaggcctgcaccgcccagagcctgggcaacctgctggacatgatgtacagagagcccgccagatggagctacaccttccagaccttcagcttcctgagcagactgaaggtgcagctggagcccttccccgagaagctgctgcaggccagaaagcccgtgcagatcttcgagagaagcgtgtacagcgacagactgcacttcgaggccctgatgaacatccccgtgctggtgctggacgtgaacgacgacttcagcgaggaggtgaccaagcaggaggacctgatgagagaggtgaacaccttcgtgaagaacctgtag

SEQ ID NO: 79001 - DNA, 768 bp, Artificial Sequence
  Description of Artificial Sequence: Synthetic coding sequence
atggccgccggcagactgttcctgagcagactgagagcccccttcagcagcatggccaagagccccctggagggcgtgagcagcagcagaggcctgcacgccggcagaggccccagaagactgagcatcgagggcaacatcggcaacatcctgaagcagatcagaatgagagcccccatccaggagaccgcctgcaccgcccagagcctgggcaacctgctggacatgatgtacagagagcccgccagatggagctacaccttccagaccttcagcttcctgagcagactgaaggtgcagctggagcccttccccgagaagctgctgcaggccagaaagcccgtgcagatcttcgagagaagcgtgtacagcgacagatacatcttcgccaagaacctgttcgagaacggcagcctgagcgacatcgagtggcacatctaccaggactggcacagcttcctgctgtgggagttcgccagcagaatcaccctgcacggcttcatctacctgcaggccagcccccaggtgtgcctgaagagactgtaccagagagccagagaggaggagaagggcatcgagctggcctacctggagcagctgcacggccagcacgaggcctggctgatccacaagaccaccaagctgcacttcgaggccctgatgaacatccccgtgctggtgctggacgtgaacgacgacttcagcgaggaggtgaccaagcaggaggacctgatgagagaggtgaacaccttcgtgaagaacctgtag

SEQ ID NO: 79002 - DNA, 1416 bp, Artificial Sequence
  Description of Artificial Sequence: Synthetic coding sequence
atggccaagaaggtggccgtgatcggcgccggcgtgagcggcctgatcagcctgaagtgctgcgtggacgagggcctggagcccacctgcttcgagagaaccgaggacatcggcggcgtgtggagattcaaggagaacgtggaggacggcagagccagcatctaccagagcgtggtgaccaacaccagcaaggagatgagctgcttcagcgacttccccatgcccgaggacttccccaacttcctgcacaacagcaagctgctggagtacttcagaatcttcgccaagaagttcgacctgctgaagtacatccagttccagaccaccgtgctgagcgtgagaaagtgccccgacttcagcagcagcggccagtggaaggtggtgacccagagcaacggcaaggagcagagcgccgtgttcgacgccgtgatggtgtgcagcggccaccacatcctgccccacatccccctgaagagcttccccggcatggagagattcaagggccagtacttccacagcagacagtacaagcaccccgacggcttcgagggcaagagaatcctggtgatcggcatgggcaacagcggcagcgacatcgccgtggagctgagcaagaacgccgcccaggtgttcatcagcaccagacacggcacctgggtgatgagcagaatcagcgaggacggctacccctgggacagcgtgttccacaccagattcagaagcatgctgagaaacgtgctgcccagaaccgccgtgaagtggatgatcgagcagcagatgaacagatggttcaaccacgagaactacggcctggagccccagaacaagtacatcatgaaggagcccgtgctgaacgacgacgtgcccagcagactgctgtgcggcgccatcaaggtgaagagcaccgtgaaggagctgaccgagaccagcgccatcttcgaggacggcaccgtggaggagaacatcgacgtgatcatcttcgccaccggctacagcttcagcttccccttcctggaggacagcctggtgaaggtggagaacaacatggtgagcctgtacaagtacatcttccccgcccacctggacaagagcaccctggcctgcatcggcctgatccagcccctgggcagcatcttccccaccgccgagctgcaggccagatgggtgaccagagtgttcaagggcctgtgcagcctgcccagcgagagaaccatgatgatggacatcatcaagagaaacgagaagagaatcgacctgttcggcgagagccagagccagaccctgcagaccaactacgtggactacctggacgagctggccctggagatcggcgccaagcccgacttctgcagcctgctgttcaaggaccccaagctggccgtgagactgtacttcggcccctgcaacagctactag

SEQ ID NO: 79003 - DNA, 969 bp, Artificial Sequence
  Description of Artificial Sequence: Synthetic coding sequence
atggagggcagcctggagagagaggcccccgccggcgccctggccgccgtgctgaagcacagcagcaccctgccccccgagagcacccaggtgagaggctacgacttcaacagaggcgtgaactacagagccctgctggaggccttcggcaccaccggcttccaggccaccaacttcggcagagccgtgcagcaggtgaacgccatgatcgagaagaagctggagcccctgagccaggacgaggaccagcacgccgacctgacccagagcagaagacccctgaccagctgcaccatcttcctgggctacaccagcaacctgatcagcagcggcatcagagagaccatcagatacctggtgcagcacaacatggtggacgtgctggtgaccaccgccggcggcgtggaggaggacctgatcaagtgcctggcccccacctacctgggcgagttcagcctgagaggcaaggagctgagagagaacggcatcaacagaatcggcaacctgctggtgcccaacgagaactactgcaagttcgaggactggctgatgcccatcctggaccagatggtgatggagcagaacaccgagggcgtgaagtggacccccagcaagatgatcgccagactgggcaaggagatcaacaaccccgagagcgtgtactactgggcccagaagaaccacatccccgtgttcagccccgccctgaccgacggcagcctgggcgacatgatcttcttccacagctacaagaaccccggcctggtgctggacatcgtggaggcccaggagttcgacggcagcgacagcggcgccagacccgacgaggccgtgagctggggcaagatcagagtggacgcccagcccgtgaaggtgtacgccgacgccagcctggtgttccccctgctggtggccgagaccttcgcccagaagatggacgccttcatgcacgagaagaacgaggactag

SEQ ID NO: 79004 - DNA, 984 bp, Artificial Sequence
  Description of Artificial Sequence: Synthetic coding sequence
atgcccatcatccccgccttctgggaggccgaggccggcggcagcagagaggaggagttcgagaccagcctggccaacatgatcgagaagaagctggagcccctgagccaggacgaggaccagcacgccgacctgacccagagcagaagacccctgaccagctgcaccatcttcctgggctacaccagcaacctgatcagcagcggcatcagagagaccatcagatacctggtgcagcacaacatggtggacgtgctggtgaccaccgccggcggcgtggaggaggacctgatcaagtgcctggcccccacctacctgggcgagttcagcctgagaggcaaggagctgagagagaacggcatcaacagaatcggcaacctgctggtgcccaacgagaactactgcaagttcgaggactggctgatgcccatcctggaccagatggtgatggagcagaacaccgagggcgtgaagtggacccccagcaagatgatcgccagactgggcaaggagatcaacaaccccgagagcgtgtactactgggcccagaagaaccacatccccgtgttcagccccgccctgaccgacggcagcctgggcgacatgatcttcttccacagctacaagaaccccggcctggtgctggacatcgtggaggacctgagactgatcaacacccaggccatcttcgccaagtgcaccggcatgatcatcctgggcggcggcgtggtgaagcaccacatcgccaacgccaacctgatgagaaacggcgccgactacgccgtgtacatcaacaccgcccaggagttcgacggcagcgacagcggcgccagacccgacgaggccgtgagctggggcaagatcagagtggacgcccagcccgtgaaggtgtacgccgacgccagcctggtgttccccctgctggtggccgagaccttcgcccagaagatggacgccttcatgcacgagaagaacgaggactag

SEQ ID NO: 79005 - DNA, 462 bp, Artificial Sequence
  Description of Artificial Sequence: Synthetic coding sequence
atgccccagctgtgcaccagagccagcagcagcgagatccccggcagactgctgaccaccctgcagagcgcccagggccagaagttcctgcacttcgccaagagcgacagcttcctggacgacatcttcgccgcctggatggcccagagactgaagacccacctgctgaccgagacctggcagagaaagagacaggagctgcccagcaactgcagcctgccctaccacgtgtacaacatcaaggccatcaagctgagcagacacagctacttcagcagctaccaggaccacgccaagtggtgcatcagccagaagggcaccaagaacagatggacctgcatcggcgacctgaacagaagcccccaccaggccttcagaagcggcggcttcatctgcacccagaactggcagatctaccaggccttccagggcctggtgctgtactacgagagctgcaagtag

SEQ ID NO: 79006 - DNA, 1086 bp, Artificial Sequence
  Description of Artificial Sequence: Synthetic coding sequence
atgaagcagaagatgatggccagactgctgagaaccagcttcgccctgctgttcctgggcctgttcggcgtgctgggcgccgccaccatcagctgcagaaacgaggagggcaaggccgtggactggttcaccttctacaagctgcccaagagacagaacaaggagagcggcgagaccggcctggagtacctgtacctggacagcaccaccagaagctggagaaagagcgagcagctgatgaacgacaccaagagcgtgctgggcagaaccctgcagcagctgtacgaggcctacgccagcaagagcaacaacaccgcctacctgatctacaacgacggcgtgcccaagcccgtgaactacagcagaaagtacggccacaccaagggcctgctgctgtggaacagagtgcagggcttctggctgatccacagcatcccccagttcccccccatccccgaggagggctacgactacccccccaccggcagaagaaacggccagagcggcatctgcatcaccttcaagtacaaccagtacgaggccatcgacagccagctgctggtgtgcaaccccaacgtgtacagctgcagcatccccgccaccttccaccaggagctgatccacatgccccagctgtgcaccagagccagcagcagcgagatccccggcagactgctgaccaccctgcagagcgcccagggccagaagttcctgcacttcgccaagagcgacagcttcctggacgacatcttcgccgcctggatggcccagagactgaagacccacctgctgaccgagacctggcagagaaagagacaggagctgcccagcaactgcagcctgccctaccacgtgtacaacatcaaggccatcaagctgagcagacacagctacttcagcagctaccaggaccacgccaagtggtgcatcagccagaagggcaccaagaacagatggacctgcatcggcgacctgaacagaagcccccaccaggccttcagaagcggcggcttcatctgcacccagaactggcagatctaccaggccttccagggcctggtgctgtactacgagagctgcaagtag

SEQ ID NO: 79007 - DNA, 1317 bp, Artificial Sequence
  Description of Artificial Sequence: Synthetic coding sequence
atggccctgagaggcgtgagcgtgagactgctgagcagaggccccggcctgcacgtgctgagaacctgggtgagcagcgccgcccagaccgagaagggcggcagaacccagagccagctggccaagagcagcagacccgagttcgactggcaggaccccctggtgctggaggagcagctgaccaccgacgagatcctgatcagagacaccttcagaacctactgccaggagagactgatgcccagaatcctgctggccaacagaaacgaggtgttccacagagagatcatcagcgagatgggcgagctgggcgtgctgggccccaccatcaagggctacggctgcgccggcgtgagcagcgtggcctacggcctgctggccagagagctggagagagtggacagcggctacagaagcgccatgagcgtgcagagcagcctggtgatgcaccccatctacgcctacggcagcgaggagcagagacagaagtacctgccccagctggccaagggcgagctgctgggctgcttcggcctgaccgagcccaacagcggcagcgaccccagcagcatggagaccagagcccactacaacagcagcaacaagagctacaccctgaacggcaccaagacctggatcaccaacagccccatggccgacctgttcgtggtgtgggccagatgcgaggacggctgcatcagaggcttcctgctggagaagggcatgagaggcctgagcgcccccagaatccagggcaagttcagcctgagagccagcgccaccggcatgatcatcatggacggcgtggaggtgcccgaggagaacgtgctgcccggcgccagcagcctgggcggccccttcggctgcctgaacaacgccagatacggcatcgcctggggcgtgctgggcgccagcgagttctgcctgcacaccgccagacagtacgccctggacagaatgcagttcggcgtgcccctggccagaaaccagctgatccagaagaagctggccgacatgctgaccgagatcaccctgggcctgcacgcctgcctgcagctgggcagactgaaggaccaggacaaggccgcccccgagatggtgagcctgctgaagagaaacaactgcggcaaggccctggacatcgccagacaggccagagacatgctgggcggcaacggcatcagcgacgagtaccacgtgatcagacacgccatgaacctggaggccgtgaacacctacgagggcacccacgacatccacgccctgatcctgggcagagccatcaccggcatccaggccttcaccgccagcaagtag

SEQ ID NO: 79008 - DNA, 918 bp, Artificial Sequence
  Description of Artificial Sequence: Synthetic coding sequence
atgatccccctgctgctggccgccctgctgtgcgtgcccgccggcgccctgacctgctacggcgacagcggccagcccgtggactggttcgtggtgtacaagctgcccgccctgagaggcagcggcgaggccgcccagagaggcctgcagtacaagtacctggacgagagcagcggcggctggagagacggcagagccctgatcaacagccccgagggcgccgtgggcagaagcctgcagcccctgtacagaagcaacaccagccagctggccttcctgctgtacaacgaccagcccccccagcccagcaaggcccaggacagcagcatgagaggccacaccaagggcaagcagctgacctacacctacccctgggtgtacaactaccagctggagggcatcttcgcccaggagttccccgacctggagaacgtggtgaagggccaccacgtgagccaggagccctggaacagcagcatcaccctgaccagccaggccggcgccgtgttccagagcttcgccaagttcagcaagttcggcgacgacctgtacagcggctggctggccgccgccctgggcaccaacctgcaggtgcagttctggcacaagaccgtgggcatcctgcccagcaactgcagcgacatctggcaggtgctgaacgtgaaccagatcgccttccccggccccgccggccccagcttcaacagcaccgaggaccacagcaagtggtgcgtgagccccaagggcccctggacctgcgtgggcgacatgaacagaaaccagggcgaggagcagagaggcggcggcaccctgtgcgcccagctgcccgccctgtggaaggccttccagcccctggtgaagaactaccagccctgcaacggcatggccagaaagcccagcagagcctacaagatctag

SEQ ID NO: 79009 - DNA, 909 bp, Artificial Sequence
  Description of Artificial Sequence: Synthetic coding sequence
atgcactaccccaccgccctgctgttcctgatcctggccaacggcgcccaggccttcagaatctgcgccttcaacgcccagagactgaccctggccaaggtggccagagagcaggtgatggacaccctggtgagaatcctggccagatgcgacatcatggtgctgcaggaggtggtggacagcagcggcagcgccatccccctgctgctgagagagctgaacagattcgacggcagcggcccctacagcaccctgagcagcccccagctgggcagaagcacctacatggagacctacgtgtacttctacagaagccacaagacccaggtgctgagcagctacgtgtacaacgacgaggacgacgtgttcgccagagagcccttcgtggcccagttcagcctgcccagcaacgtgctgcccagcctggtgctggtgcccctgcacaccacccccaaggccgtggagaaggagctgaacgccctgtacgacgtgttcctggaggtgagccagcactggcagagcaaggacgtgatcctgctgggcgacttcaacgccgactgcgccagcctgaccaagaagagactggacaagctggagctgagaaccgagcccggcttccactgggtgatcgccgacggcgaggacaccaccgtgagagccagcacccactgcacctacgacagagtggtgctgcacggcgagagatgcagaagcctgctgcacaccgccgccgccttcgacttccccaccagcttccagctgaccgaggaggaggccctgaacatcagcgaccactaccccgtggaggtggagctgaagctgagccaggcccacagcgtgcagcccctgagcctgaccgtgctgctgctgctgagcctgctgagcccccagctgtgccccgccgcctag

SEQ ID NO: 79010 - DNA, 909 bp, Artificial Sequence; identical to SEQ ID NO: 79009
  Description of Artificial Sequence: Synthetic coding sequence

SEQ ID NO: 79011 - DNA, 909 bp, Artificial Sequence; identical to SEQ ID NO: 79009
  Description of Artificial Sequence: Synthetic coding sequence

SEQ ID NO: 79012 - DNA, 909 bp, Artificial Sequence; identical to SEQ ID NO: 79009
  Description of Artificial Sequence: Synthetic coding sequence

SEQ ID NO: 79013 - DNA, 909 bp, Artificial Sequence; identical to SEQ ID NO: 79009
  Description of Artificial Sequence: Synthetic coding sequence

SEQ ID NO: 79014 - DNA, 909 bp, Artificial Sequence; identical to SEQ ID NO: 79009
  Description of Artificial Sequence: Synthetic coding sequence

SEQ ID NO: 79015 - DNA, 315 bp, Artificial Sequence
  Description of Artificial Sequence: Synthetic coding sequence
atgcactaccccaccgccctgctgttcctgatcctggccaacggcgcccaggccttcagaatctgcgccttcaacgcccagagactgaccctggccaaggtggccagagagcaggtgatggacaccctggtgagaatcctggccagatgcgacatcatggtgctgcaggaggtggtggacagcagcggcagcgccatccccctgctgctgagagagctgaacagattcgacggcagcggcccctacagcaccctgagcagcccccagctgggcagaagcacctacatggagacctacgtgtacttctacagatag

SEQ ID NO: 79016 - DNA, 81 bp, Artificial Sequence
  Description of Artificial Sequence: Synthetic coding sequence
atgcactaccccaccgccctgctgttcctgatcctggccaacggcgcccaggccttcagaatctgcgccttcaacgcctag

SEQ ID NO: 79017 - DNA, 627 bp, Artificial Sequence
  Description of Artificial Sequence: Synthetic coding sequence
atgcactaccccaccgccctgctgttcctgatcctggccaacggcgcccaggccttcagaatctgcgccttcaacgcccagagactgaccctggccaaggtggccagagagcaggtgatggacaccctggtgagaatcctggccagatgcgacatcatggtgctgcaggaggtggtggacagcagcggcagcgccatccccctgctgctgagagagctgaacagattcgacggcagcggcccctacagcaccctgagcagcccccagctgggcagaagcacctacatggagacctacgtgtacttctacagaagccacaagacccaggtgctgagcagctacgtgtacaacgacgaggacgacgtgttcgccagagagcccttcgtggcccagttcagcctgcccagcaacgtgctgcccagcctggtgctggtgcccctgcacaccacccccaaggccgtggagaaggagctgaacgccctgtacgacgtgttcctggaggtgagccagcactggcagagcaaggacgtgatcctgctgggcgacttcaacgccgactgcgccagcctgaccaagaagagactggacaagctggagctgagaaccgagcccggcttccactggtag

SEQ ID NO: 79018 - DNA, 918 bp, Artificial Sequence
  Description of Artificial Sequence: Synthetic coding sequence
atgagcagagagctggcccccctgctgctgctgctgctgagcatccacagcgccctggccatgagaatctgcagcttcaacgtgagaagcttcggcgagagcaagcaggaggacaagaacgccatggacgtgatcgtgaaggtgatcaagagatgcgacatcatcctggtgatggagatcaaggacagcaacaacagaatctgccccatcctgatggagaagctgaacagaaacagcagaagaggcatcacctacaactacgtgatcagcagcagactgggcagaaacacctacaaggagcagtacgccttcctgtacaaggagaagctggtgagcgtgaagagaagctaccactaccacgactaccaggacggcgacgccgacgtgttcagcagagagcccttcgtggtgtggttccagagcccccacaccgccgtgaaggacttcgtgatcatccccctgcacaccacccccgagaccagcgtgaaggagatcgacgagctggtggaggtgtacaccgacgtgaagcacagatggaaggccgagaacttcatcttcatgggcgacttcaacgccggctgcagctacgtgcccaagaaggcctggaagaacatcagactgagaaccgaccccagattcgtgtggctgatcggcgaccaggaggacaccaccgtgaagaagagcaccaactgcgcctacgacagaatcgtgctgagaggccaggagatcgtgagcagcgtggtgcccaagagcaacagcgtgttcgacttccagaaggcctacaagctgaccgaggaggaggccctggacgtgagcgaccacttccccgtggagttcaagctgcagagcagcagagccttcaccaacagcaagaagagcgtgaccctgagaaagaagaccaagagcaagagaagctag

SEQ ID NO: 79019 - DNA, 918 bp, Artificial Sequence; identical to SEQ ID NO: 79018
  Description of Artificial Sequence: Synthetic coding sequence

SEQ ID NO: 79020 - DNA, 867 bp, Artificial Sequence
  Description of Artificial Sequence: Synthetic coding sequence
atgagcagagagctggcccccctgctgctgctgctgctgagcatccacagcgccctggccatgagaatctgcagcttcaacgtgagaagcttcggcgagagcaagcaggaggacaagaacgccatggacgtgatcgtgaaggtgatcaagagatgcgacatcatcctggtgatggagatcaaggacagcaacaacagaatctgccccatcctgatggagaagctgaacagaaacagcagaagaggcatcacctacaactacgtgatcagcagcagactgggcagaaacacctacaaggagcagtacgccttcctgtacaaggagaagctggtgagcgtgaagagaagctaccactaccacgactaccaggacggcgacgccgacgtgttcagcagagagcccttcgtggtgtggttccagagcccccacaccgccgtgaaggacttcgtgatcatccccctgcacaccacccccgagaccagcgtgaaggagatcgacgagctggtggaggtgtacaccgacgtgaagcacagatggaaggccgagaacttcatcttcatgggcgacttcaacgccggctgcagctacgtgcccaagaaggcctggaagaacatcagactgagaaccgaccccagattcgtgtggctgatcggcgaccaggaggacaccaccgtgaagaagagcaccaactgcgcctacgacagaatcgtgctgagaggccaggagatcgtgagcagcgtggtgcccaagagcaacagcgtgttcgacttccagaaggcctacaagctgaccgaggaggaggtgagactgcccagctgcctgagcatgcccctgagctggaaggacgagctggcctgggccacctag

SEQ ID NO: 79021 - DNA, 303 bp, Artificial Sequence
  Description of Artificial Sequence: Synthetic coding sequence
atgagcagagagctggcccccctgctgctgctgctgctgagcatccacagcgccctggccatgagaatctgcagcttcaacgtgagaagcttcggcgagagcaagcaggaggacaagaacgccatggacgtgatcgtgaaggtgatcaagagatgcgacatcatcctggtgatggagatcaaggacagcaacaacagaatctgccccatcctgatggagaagctgaacagaaacagcagaagaggcatcacctacaactacgtgatcagcagcagactgggcagaaacacctacaaggagtag

SEQ ID NO: 79022 - DNA, 828 bp, Artificial Sequence
  Description of Artificial Sequence: Synthetic coding sequence
atgagcagagagctggcccccctgctgctgctgctgctgagcatccacagcgccctggccatgagaatctgcagcttcaacgtgagaagcttcggcgagagcaagcaggaggacaagaacgccatggacgtgatcgtgaaggtgatcaagagatgcgacatcatcctggtgatggagatcaaggacagcaacaacagaatctgccccatcctgatggagaagctgaacagagagaagctggtgagcgtgaagagaagctaccactaccacgactaccaggacggcgacgccgacgtgttcagcagagagcccttcgtggtgtggttccagagcccccacaccgccgtgaaggacttcgtgatcatccccctgcacaccacccccgagaccagcgtgaaggagatcgacgagctggtggaggtgtacaccgacgtgaagcacagatggaaggccgagaacttcatcttcatgggcgacttcaacgccggctgcagctacgtgcccaagaaggcctggaagaacatcagactgagaaccgaccccagattcgtgtggctgatcggcgaccaggaggacaccaccgtgaagaagagcaccaactgcgcctacgacagaatcgtgctgagaggccaggagatcgtgagcagcgtggtgcccaagagcaacagcgtgttcgacttccagaaggcctacaagctgaccgaggaggaggccctggacgtgagcgaccacttccccgtggagttcaagctgcagagcagcagagccttcaccaacagcaagaagagcgtgaccctgagaaagaagaccaagagcaagagaagctag

SEQ ID NO: 79023 - DNA, 753 bp, Artificial Sequence
  Description of Artificial Sequence: Synthetic coding sequence
atgacccccctgtgccccagacccgccctgtgctaccacttcctgaccagcctgctgagaagcgccatgcagaacgccagaaccgccgagggcagaagcagaggcaccctgagagccagacccgcccccagacccgccgcccagcacggcatccccagacccctgagcagcgccggcagactgagccagggctgcagaggcgccagcaccgtgggcgccgccggctggaagggcgagctgcccaaggccggcggcagccccgcccccggccccgagacccccgccatcagccccagcaagagagccagacccgccgaggtgggcggcatgcagctgagattcgccagactgagcgagcacgccaccgcccccaccagaggcagcgccagagccgccggctacgacctgtacagcgcctacgactacaccatcccccccatggagaaggccgtggtgaagaccgacatccagatcgccctgcccagcggctgctacggcagagtggcccccagaagcggcctggccgccaagcacttcatcgacgtgggcgccggcgtgatcgacgaggactacagaggcaacgtgggcgtggtgctgttcaacttcggcaaggagaagttcgaggtgaagaagggcgacagaatcgcccagctgatctgcgagagaatcttctaccccgagatcgaggaggtgcaggccctggacgacaccgagagaggcagcggcggcttcggcagcaccggcaagaactag

SEQ ID NO: 79024 - DNA, 759 bp, Artificial Sequence
  Description of Artificial Sequence: Synthetic coding sequence
atgacccccctgtgccccagacccgccctgtgctaccacttcctgaccagcctgctgagaagcgccatgcagaacgccagaggcgccagacagagagccgaggccgccgtgctgagcggccccggcccccccctgggcagagccgcccagcacggcatccccagacccctgagcagcgccggcagactgagccagggctgcagaggcgccagcaccgtgggcgccgccggctggaagggcgagctgcccaaggccggcggcagccccgcccccggccccgagacccccgccatcagccccagcaagagagccagacccgccgaggtgggcggcatgcagctgagattcgccagactgagcgagcacgccaccgcccccaccagaggcagcgccagagccgccggctacgacctgtacagcgcctacgactacaccatcccccccatggagaaggccgtggtgaagaccgacatccagatcgccctgcccagcggctgctacggcagagtggcccccagaagcggcctggccgccaagcacttcatcgacgtgggcgccggcgtgatcgacgaggactacagaggcaacgtgggcgtggtgctgttcaacttcggcaaggagaagttcgaggtgaagaagggcgacagaatcgcccagctgatctgcgagagaatcttctaccccgagatcgaggaggtgcaggccctggacgacaccgagagaggcagcggcggcttcggcagcaccggcaagaactag

SEQ ID NO: 79025 - DNA, 495 bp, Artificial Sequence
  Description of Artificial Sequence: Synthetic coding sequence
atgccctgcagcgaggagacccccgccatcagccccagcaagagagccagacccgccgaggtgggcggcatgcagctgagattcgccagactgagcgagcacgccaccgcccccaccagaggcagcgccagagccgccggctacgacctgtacagcgcctacgactacaccatcccccccatggagaaggccgtggtgaagaccgacatccagatcgccctgcccagcggctgctacggcagagtggcccccagaagcggcctggccgccaagcacttcatcgacgtgggcgccggcgtgatcgacgaggactacagaggcaacgtgggcgtggtgctgttcaacttcggcaaggagaagttcgaggtgaagaagggcgacagaatcgcccagctgatctgcgagagaatcttctaccccgagatcgaggaggtgcaggccctggacgacaccgagagaggcagcggcggcttcggcagcaccggcaagaactag

SEQ ID NO: 79026 - DNA, 426 bp, Artificial Sequence
  Description of Artificial Sequence: Synthetic coding sequence
atgcagctgagattcgccagactgagcgagcacgccaccgcccccaccagaggcagcgccagagccgccggctacgacctgtacagcgcctacgactacaccatcccccccatggagaaggccgtggtgaagaccgacatccagatcgccctgcccagcggctgctacggcagagtggcccccagaagcggcctggccgccaagcacttcatcgacgtgggcgccggcgtgatcgacgaggactacagaggcaacgtgggcgtggtgctgttcaacttcggcaaggagaagttcgaggtgaagaagggcgacagaatcgcccagctgatctgcgagagaatcttctaccccgagatcgaggaggtgcaggccctggacgacaccgagagaggcagcggcggcttcggcagcaccggcaagaactag

SEQ ID NO: 79027 - DNA, 1056 bp, Artificial Sequence
  Description of Artificial Sequence: Synthetic coding sequence
atgcccctgagaaagcacagacagcacttcaagaagtacggcaactgcttcaccgccggcgaggccgtggactggctgtacgacctgctgagaaacaacagcaacttcggccccgaggtgaccagacagcagaccatccagctgctgagaaagttcctgaagaaccacgtgatcgaggacatcaagggcagatggggcagcgagaacgtggacgacaacaaccagctgttcagattccccgccaccagccccctgaagaccctgcccagaagaacccccaagagacacggcctgcacctgagccaggagaacggcgagaagatcaagcacgagatcatcaacgaggaccaggagaacgccatcgacaacagagagctgagccaggaggacgtggaggaggtgtggagatacgtgatcctgatctacctgcagaccatcctgggcgtgcccagcctggaggaggtgatcaaccccaagcaggtgatcccccagtacatcatgtacaacatggccaacaccagcaagagaggcgtggtgatcctgcagaacaagagcgacgacctgccccactgggtgctgagcgccatgaagtgcctggccaactggcccagaagcaacgacatgaacaaccccacctacgtgggcttcgagagagacgtgttcagaaccatcgccgactacttcctggacctgcccgagcccctgctgaccttcgagtactacgagctgttcgtgaacatcctgggcaacttcaaggacttcagaagcagcatccccgtggtgtgcggctacatcaccgtgagcgacagaagcagcggcatccacaagatccaggacgacccccagagcagcaagttcctgcacctgaacaacctgaacagcttcaagagcaccgagtgcctgctgctgagcctgctgcacagagagaagaacaaggaggagagcgacagcaccgagagactgcagatcagcaaccccggcttccaggagagatgcgccaagaagatgcagctggtgaacctgagaaacagaagagcctgctgcaacctgatctag

SEQ ID NO: 79028 - DNA, 1584 bp, Artificial Sequence
  Description of Artificial Sequence: Synthetic coding sequence
atggagagccagggcgtgccccccggcccctacagagccaccaagctgtggaacgaggtgaccaccagcttcagagccggcatgcccctgagaaagcacagacagcacttcaagaagtacggcaactgcttcaccgccggcgaggccgtggactggctgtacgacctgctgagaaacaacagcaacttcggccccgaggtgaccagacagcagaccatccagctgctgagaaagttcctgaagaaccacgtgatcgaggacatcaagggcagatggggcagcgagaacgtggacgacaacaaccagctgttcagattccccgccaccagccccctgaagaccctgcccagaagataccccgagctgagaaagaacaacatcgagaacttcagcaaggacaaggacagcatcttcaagctgagaaacctgagcagaagaacccccaagagacacggcctgcacctgagccaggagaacggcgagaagatcaagcacgagatcatcaacgaggaccaggagaacgccatcgacaacagagagctgagccaggaggacgtggaggaggtgtggagatacgtgatcctgatctacctgcagaccatcctgggcgtgcccagcctggaggaggtgatcaaccccaagcaggtgatcccccagtacatcatgtacaacatggccaacaccagcaagagaggcgtggtgatcctgcagaacaagagcgacgacctgccccactgggtgctgagcgccatgaagtgcctggccaactggcccagaagcaacgacatgaacaaccccacctacgtgggcttcgagagagacgtgttcagaaccatcgccgactacttcctggacctgcccgagcccctgctgaccttcgagtactacgagctgttcgtgaacatcctgggcctgctgcagccccacctggagagagtggccatcgacgccctgcagctgtgctgcctgctgctgcccccccccaacagaagaaagctgcagctgctgatgagaatgatcagcagaatgagccagaacgtggacatgcccaagctgcacgacgccatgggcaccagaagcctgatgatccacaccttcagcagatgcgtgctgtgctgcgccgaggaggtggacctggacgagctgctggccggcagactggtgagcttcctgatggaccaccaccaggagatcctgcaggtgcccagctacctgcagaccgccgtggagaagcacctggactacctgaagaagggccacatcgagaaccccggcgacggcctgttcgcccccctgcccacctacagctactgcaagcagatcagcgcccaggagttcgacgagcagaaggtgagcaccagccaggccgccatcgccgagctgctggagaacatcatcaagaacagaagcctgcccctgaaggagaagagaaagaagctgaagcagttccagaaggagtaccccctgatctaccagaagagattccccaccaccgagagcgaggccgccctgttcggcgacaagcccaccatcaagcagcccatgctgatcctgagaaagcccaagttcagaagcctgagatag

SEQ ID NO: 79029 - DNA, 2436 bp, Artificial Sequence
  Description of Artificial Sequence: Synthetic coding sequence
atggagagccagggcgtgccccccggcccctacagagccaccaagctgtggaacgaggtgaccaccagcttcagagccggcatgcccctgagaaagcacagacagcacttcaagaagtacggcaactgcttcaccgccggcgaggccgtggactggctgtacgacctgctgagaaacaacagcaacttcggccccgaggtgaccagacagcagaccatccagctgctgagaaagttcctgaagaaccacgtgatcgaggacatcaagggcagatggggcagcgagaacgtggacgacaacaaccagctgttcagattccccgccaccagccccctgaagaccctgcccagaagataccccgagctgagaaagaacaacatcgagaacttcagcaaggacaaggacagcatcttcaagctgagaaacctgagcagaagaacccccaagagacacggcctgcacctgagccaggagaacggcgagaagatcaagcacgagatcatcaacgaggaccaggagaacgccatcgacaacagagagctgagccaggaggacgtggaggaggtgtggagatacgtgatcctgatctacctgcagaccatcctgggcgtgcccagcctggaggaggtgatcaaccccaagcaggtgatcccccagtacatcatgtacaacatggccaacaccagcaagagaggcgtggtgatcctgcagaacaagagcgacgacctgccccactgggtgctgagcgccatgaagtgcctggccaactggcccagaagcaacgacatgaacaaccccacctacgtgggcttcgagagagacgtgttcagaaccatcgccgactacttcctggacctgcccgagcccctgctgaccttcgagtactacgagctgttcgtgaacatcctggtggtgtgcggctacatcaccgtgagcgacagaagcagcggcatccacaagatccaggacgacccccagagcagcaagttcctgcacctgaacaacctgaacagcttcaagagcaccgagtgcctgctgctgagcctgctgcacagagagaagaacaaggaggagagcgacagcaccgagagactgcagatcagcaaccccggcttccaggagagatgcgccaagaagatgcagctggtgaacctgagaaacagaagagtgagcgccaacgacatcatgggcggcagctgccacaacctgatcggcctgagcaacatgcacgacctgagcagcaacagcaagcccagatgctgcagcctggagggcatcgtggacgtgcccggcaacagcagcaaggaggccagcagcgtgttccaccagagcttccccaacatcgagggccagaacaacaagctgttcctggagagcaagcccaagcaggagttcctgctgaacctgcacagcgaggagaacatccagaagcccttcagcgccggcttcaagagaaccagcaccctgaccgtgcaggaccaggaggagctgtgcaacggcaagtgcaagagcaagcagctgtgcagaagccagagcctgctgctgagaagcagcaccagaagaaacagctacatcaacacccccgtggccgagatcatcatgaagcccaacgtgggccagggcagcaccagcgtgcagaccgccatggagagcgagctgggcgagagcagcgccaccatcaacaagagactgtgcaagagcaccatcgagctgagcgagaacagcctgctgcccgccagcagcatgctgaccggcacccagagcctgctgcagccccacctggagagagtggccatcgacgccctgcagctgtgctgcctgctgctgcccccccccaacagaagaaagctgcagctgctgatgagaatgatcagcagaatgagccagaacgtggacatgcccaagctgcacgacgccatgggcaccagaagcctgatgatccacaccttcagcagatgcgtgctgtgctgcgccgaggaggtggacctggacgagctgctggccggcagactggtgagcttcctgatggaccaccaccaggagatcctgcaggtgcccagctacctgcagaccgccgtggagaagcacctggactacctgaagaagggccacatcgagaaccccggcgacggcctgttcgcccccctgcccacctacagctactgcaagcagatcagcgcccaggagttcgacgagcagaaggtgagcaccagccaggccgccatcgccgagctgctggagaacatcatcaagaacagaagcctgcccctgaaggagaagagaaagaagctgaagcagttccagaaggagtaccccctgatctaccagaagagattccccaccaccgagagcgaggccgccctgttcggcgacaagcccaccatcaagcagcccatgctgatcctgagaaagcccaagttcagaagcctgagatag

SEQ ID NO: 79030 - DNA, 1590 bp, Artificial Sequence
  Description of Artificial Sequence: Synthetic coding sequence
atggagcacagaatcgtgggccccggcccctacagagccaccagactgtggaacgagaccgtggagctgttcagagccaagatgcccctgagaaagcacagatgcagattcaagagctacgagcactgcttcaccgccgccgaggccgtggactggctgcacgagctgctgagatgcagccagaacttcggccccgaggtgaccagaaagcagaccgtgcagctgctgaagaagttcctgaagaaccacgtgatcgaggacatcaagggcaagtggggcgaggaggacttcgaggacaacagacacctgtacagattcccccccagcagccccctgaagccctaccccaagaagccccccaaccagaaggacgtgatcaagttccccgagtggaacgacctgccccccggcaccagccaggagaacatccccgtgagacccgtggtgatgaacagcgagatgtggtacaagagacacagcatcgccatcggcgaggtgcccgcctgcagactggtgcacagaagacagctgaccgaggccaacgtggaggagatctggaagagcatgaccctgagctacctgcagaagatcctgggcctggacagcctggaggaggtgctggacgtgaagctggtgaacagcaagttcatcatccacaacgtgtacagcgtgagcaagcagggcgtggtgatcctggacgacaagagcaaggagctgccccactgggtgctgagcgccatgaagtgcctggccaactggcccaactgcagcgacctgaagcagcccatgtacctgggcttcgagaaggacgtgttcaagaccatcgccgactactacggccacctgaaggagcccctgctgaccttccacctgttcgacgccttcgtgagcgtgctgggcctgctgcagaaggagaaggtggccgtggaggccttccagatctgctgcctgctgctgccccccgagaacagaagaaagctgcagctgctgatgagaatgatggccagaatctgcctgaacaaggagatgccccccctgtgcgacggcttcggcaccagaaccctgatggtgcagaccttcagcagatgcatcctgtgcagcaaggacgaggtggacctggacgagctgctggccgccagactggtgaccttcctgatggacaactaccaggagatcctgaaggtgcccctggccctgcagaccagcatcgaggagagagtggcccacctgagaagagtgcagatcaagtaccccggcgccgacatggacatcaccctgagcgcccccagcttctgcagacagatcagccccgaggagttcgagtaccagagaagctacggcagccaggagcccctggccgccctgctggaggaggtgatcaccgacgccaagctgagcaacaaggagaagaagaagaagctgaagcagttccagaagagctaccccgaggtgtaccaggagagattccccacccccgagagcgccgccctgctgttccccgagaagcccaagcccaagccccagctgctgatgtgggccctgaagaagcccttccagcccttccagagaaccagaagcttcagaatgtag

SEQ ID NO: 79031 - DNA, 1404 bp, Artificial Sequence
  Description of Artificial Sequence: Synthetic coding sequence
atggagcacagaatcgtgggccccggcccctacagagccaccagactgtggaacgagaccgtggagctgttcagagccaagatgcccctgagaaagcacagatgcagattcaagagctacgagcactgcttcaccgccgccgaggccgtggactggctgcacgagctgctgagatgcagccagaacttcggccccgaggtgaccagaaagcagaccgtgcagctgctgaagaagttcctgaagaaccacgtgatcgaggacatcaagggcaagtggggcgaggaggacttcgaggacaacagacacctgtacagattcccccccagcagccccctgaagccctaccccaagaagccccccaaccagaaggacgtgatcaagttccccgagtggaacgacctgccccccggcaccagccaggagaacatccccgtgagacccgtggtgatgaacagcgagatgtggtacaagagacacagcatcgccatcggcgaggtgcccgcctgcagactggtgcacagaagacagctgaccgaggccaacgtggaggagatctggaagagcatgaccctgagctacctgcagaagatcctgggcctggacagcctggaggaggtgctggacgtgaagctggtgaacagcaagttcatcatccacaacgtgtacagcgtgagcaagcagggcgtggtgatcctggacgacaagagcaaggagctgccccactgggtgctgagcgccatgaagtgcctggccaactggcccaactgcagcgacctgaagcagcccatgtacctgggcttcgagaaggacgtgttcaagaccatcgccgactactacggccacctgaaggagcccctgctgaccttccacctgttcgacgccttcgtgagcgtgctgggcctgctgcagaaggagaaggtggccgtggaggccttccagatctgctgcctgctgctgccccccgagaacagaagaaagctgcagctgctgatgagaatgatggccagaatctgcctgaacaaggagatgccccccctgtgcgacggcttcggcaccagaaccctgatggtgcagaccttcagcagatgcatcctgtgcagcaaggacgaggtggacctggacgagctgctggccgccagactggtgaccttcctgatggacaactaccaggagatcctgaaggtgcccctggccctgcagaccagcatcgaggagagagtggcccacctgagaagagtgcagttccagaagagctaccccgaggtgtaccaggagagattccccacccccgagagcgccgccctgctgttccccgagaagcccaagcccaagccccagctgctgatgtgggccctgaagaagcccttccagcccttccagagaaccagaagcttcagaatgtag

SEQ ID NO: 79032 - DNA, 1323 bp, Artificial Sequence
  Description of Artificial Sequence: Synthetic coding sequence
atgcccctgagaaagcacagatgcagattcaagagctacgagcactgcttcaccgccgccgaggccgtggactggctgcacgagctgctgagatgcagccagaacttcggccccgaggtgaccagaaagcagaccgtgcagctgctgaagaagttcctgaagaaccacgtgatcgaggacatcaagggcaagtggggcgaggaggacttcgaggacaacagacacctgtacagattcccccccagcagccccctgaagccctaccccaagaagccccccaaccagaaggacgtgatcaagttccccgagtggaacgacctgccccccggcaccagccaggagaacatccccgtgagacccgtggtgatgaacagcgagatgtggtacaagagacacagcatcgccatcggcgaggtgcccgcctgcagactggtgcacagaagacagctgaccgaggccaacgtggaggagatctggaagagcatgaccctgagctacctgcagaagatcctgggcctggacagcctggaggaggtgctggacgtgaagctggtgaacagcaagttcatcatccacaacgtgtacagcgtgagcaagcagggcgtggtgatcctggacgacaagagcaaggagctgccccactgggtgctgagcgccatgaagtgcctggccaactggcccaactgcagcgacctgaagcagcccatgtacctgggcttcgagaaggacgtgttcaagaccatcgccgactactacggccacctgaaggagcccctgctgaccttccacctgttcgacgccttcgtgagcgtgctgggcctgctgcagaaggagaaggtggccgtggaggccttccagatctgctgcctgctgctgccccccgagaacagaagaaagctgcagctgctgatgagaatgatggccagaatctgcctgaacaaggagatgccccccctgtgcgacggcttcggcaccagaaccctgatggtgcagaccttcagcagatgcatcctgtgcagcaaggacgaggtggacctggacgagctgctggccgccagactggtgaccttcctgatggacaactaccaggagatcctgaaggtgcccctggccctgcagaccagcatcgaggagagagtggcccacctgagaagagtgcagttccagaagagctaccccgaggtgtaccaggagagattccccacccccgagagcgccgccctgctgttccccgagaagcccaagcccaagccccagctgctgatgtgggccctgaagaagcccttccagcccttccagagaaccagaagcttcagaatgtag

SEQ ID NO: 79033 - DNA, 4746 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtgggccccagcggcgaggccatccagatccaccaccagaccagacagaacatggccgagctgcagggcagcggccagagagaccccacccacagcagcgccgagctgctggagctggcctaccacgaggccgccggcagacacagcaacagcagacagcccggcgacggcatgagcttcctgaacttcagcggcaccgaggagctgagcgtgggcctgctgagcaacagcggcgccggcatgaaccccagaacccagaacaaggacagcctggaggacagcgtgagcaccagccccgaccccatcctgaccctgagcgccccccccgtggtgcccggcttctgctgcaccgtgggcgtggactggaagagcctgaccacccccgcctgcctgcccctgaccaccgactacttccccgacagacagggcctgcagaacgactacaccgagggctgctacgacctgctgcccgaggccgacatcgacagaagagacgaggacggcgtgcagatgaccgcccagcaggtgttcgaggagttcatctgccagagactgatgcagggctaccagatcatcgtgcagcccaagacccagaagcccaaccccgccgtgcccccccccctgagcagcagccccctgtacagcagaggcctggtgagcagaaacagacccgaggaggaggaccagtactggctgagcatgggcagaaccttccacaaggtgaccctgaaggacaagatgatcaccgtgaccagatacctgcccaagtacccctacgagagcgcccagatccactacacctacagcctgtgccccagccacagcgacagcgagttcgtgagctgctgggtggagttcagccacgagagactggaggagtacaagtggaactacctggaccagtacatctgcagcgccggcagcgaggacttcagcctgatcgagagcctgaagttctggagaaccagattcctgctgctgcccgcctgcgtgaccgccaccaagagaatcaccgagggcgaggcccactgcgacatctacggcgacagacccagagccgacgaggacgagtggcagctgctggacggcttcgtgagattcgtggagggcctgaacagaatcagaagaagacacagaagcgacagaatgatgagaaagggcaccgccatgaagggcctgcagatgaccggccccatcagcacccacagcctggagagcaccgccccccccgtgggcaagaagggcaccagcgccctgagcgccctgctggagatggaggccagccagaagtgcctgggcgagcagcaggccgccgtgcacggcggcaagagcagcgcccagagcgccgagagcagcagcgtggccatgacccccacctacatggacagccccagaaaggtgagcgtggaccagaccgccacccccatgctggacggcaccagcctgggcatctgcaccggccagagcatggacagaggcaacagccagaccttcggcaacagccagaacatcggcgagcagggctacagcagcaccaacagcagcgacagcagcagccagcagctggtggccagcagcctgaccagcagcagcaccctgaccgagatcctggaggccatgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagaagatgctggaggagcagctgatcacccacgccagcggcgaggcctggagaaccttcatctacggcttctacttctacaagatcgtgaccgacaaggagcccgacagagtggccatgcagcagcccgccaccacctggcacaccgccggcgtggacgacttcgccagcttccagagaaagtggttcgaggtggccttcgtggccgaggagctggtgcacagcgagatccccgccttcctgctgccctggctgcccagcagacccgccagctacgccagcagacacagcagcttcagcagaagcttcggcggcagaagccaggccgccgccctgctggccgccaccgtgcccgagcagagaaccgtgaccctggacgtggacgtgaacaacagaaccgacagactggagtggtgcagctgctactaccacggcaacttcagcctgaacgccgccttcgagatcaagctgcactggatggccgtgaccgccgccgtgctgttcgagatggtgcagggctggcacagaaaggccaccagctgcggcttcctgctggtgcccgtgctggagggccccttcgccctgcccagctacctgtacggcgaccccctgagagcccagctgttcatccccctgaacatcagctgcctgctgaaggagggcagcgagcacctgttcgacagcttcgagcccgagacctactgggacagaatgcacctgttccaggaggccatcgcccacagattcggcttcgtgcaggacaagtacagcgccagcgccttcaacttccccgccgagaacaagccccagtacatccacgtgaccggcaccgtgttcctgcagctgccctacagcaagagaaagttcagcggccagcagagaagaagaagaaacagcaccagcagcaccaaccagaacatgttctgcgaggagagagtgggctacaactgggcctacaacaccatgctgaccaagacctggagaagcagcgccaccggcgacgagaagttcgccgacagactgctgaaggacttcaccgacttctgcatcaacagagacaacagactggtgaccttctggaccagctgcctggagaagatgcacgccagcgccccctag

SEQ ID NO: 79034 - DNA, 3690 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtgggcatgaaccccagaacccagaacaaggacagcctggaggacagcgtgagcaccagccccgaccccatcctgaccctgagcgccccccccgtggtgcccggcttctgctgcaccgtgggcgtggactggaagagcctgaccacccccgcctgcctgcccctgaccaccgactacttccccgacagacagggcctgcagaacgactacaccgagggctgctacgacctgctgcccgaggccgacatcgacagaagagacgaggacggcgtgcagatgaccgcccagcaggtgttcgaggagttcatctgccagagactgatgcagggctaccagatcatcgtgcagcccaagacccagaagcccaaccccgccgtgcccccccccctgagcagcagccccctgtacagcagaggcctggtgagcagaaacagacccgaggaggaggaccagtactggctgagcatgggcagaaccttccacaaggtgaccctgaaggacaagatgatcaccgtgaccagatacctgcccaagtacccctacgagagcgcccagatccactacacctacagcctgtgccccagccacagcgacagcgagttcgtgagctgctgggtggagttcagccacgagagactggaggagtacaagtggaactacctggaccagtacatctgcagcgccggcagcgaggacttcagcctgatcgagagcctgaagttctggagaaccagattcctgctgctgcccgcctgcgtgaccgccaccaagagaatcaccgagggcgaggcccactgcgacatctacggcgacagacccagagccgacgaggacgagtggcagctgctggacggcttcgtgagattcgtggagggcctgaacagaatcagaagaagacacagaagcgacagaatgatgagaaagggcaccgccatgaagggcctgcagatgaccggccccatcagcacccacagcctggagagcaccgccccccccgtgggcaagaagggcaccagcgccctgagcgccctgctggagatggaggccagccagaagtgcctgggcgagcagcaggccgccgtgcacggcggcaagagcagcgcccagagcgccgagagcagcagcgtggccatgacccccacctacatggacagccccagaaaggacggcgccttcttcatggagttcgtgagaagccccagaaccgccagcagcgccttctacccccaggtgagcgtggaccagaccgccacccccatgctggacggcaccagcctgggcatctgcaccggccagagcatggacagaggcaacagccagaccttcggcaacagccagaacatcggcgagcagggctacagcagcaccaacagcagcgacagcagcagccagcagctggtggccagcagcctgaccagcagcagcaccctgaccgagatcctggaggccatgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagtggccctgcagcagcccccccccccccggcacccagcaggagtggaccaccagccccgccagcagcgccagcggcctgagatggcccctgtggcagaagagcagctgcaccctgagattcctgcccttcagctgccccggctgcctggccggccagccccccatgcaggtgggcaccgcccccctggccgaggtgctggaggacggcgccagaagacagcacttctag

SEQ ID NO: 79035 - DNA, 4512 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtggagaccagctgcttctacctgagcatcggcatgaaccccagaacccagaacaaggacagcctggaggacagcgtgagcaccagccccgaccccatgcccggcttctgctgcaccgtgggcgtggactggaagagcctgaccacccccgcctgcctgcccctgaccaccgactacttccccgacagacagggcctgcagaacgactacaccgagggctgctacgacctgctgcccgaggccgacatcgacagaagagacgaggacggcgtgcagatgaccgcccagcaggtgttcgaggagttcatctgccagagactgatgcagggctaccagatcatcgtgcagcccaagacccagaagcccaaccccgccgtgcccccccccctgagcagcagccccctgtacagcagaggcctggtgagcagaaacagacccgaggaggaggaccagtactggctgagcatgggcagaaccttccacaaggtgaccctgaaggacaagatgatcaccgtgaccagatacctgcccaagtacccctacgagagcgcccagatccactacacctacagcctgtgccccagccacagcgacagcgagttcgtgagctgctgggtggagttcagccacgagagactggaggagtacaagtggaactacctggaccagtacatctgcagcgccggcagcgaggacttcagcctgatcgagagcctgaagttctggagaaccagattcctgctgctgcccgcctgcgtgaccgccaccaagagaatcaccgagggcgaggcccactgcgacatctacggcgacagacccagagccgacgaggacgagtggcagctgctggacggcttcgtgagattcgtggagggcctgaacagaatcagaagaagacacagaagcgacagaatgatgagaaagggcaccgccatgaagggcctgcagatgaccggccccatcagcacccacagcctggagagcaccgccccccccgtgggcaagaagggcaccagcgccctgagcgccctgctggagatggaggccagccagaagtgcctgggcgagcagcaggccgccgtgcacggcggcaagagcagcgcccagagcgccgagagcagcagcgtggccatgacccccacctacatggacagccccagaaaggtgagcgtggaccagaccgccacccccatgctggacggcaccagcctgggcatctgcaccggccagagcatggacagaggcaacagccagaccttcggcaacagccagaacatcggcgagcagggctacagcagcaccaacagcagcgacagcagcagccagcagctggtggccagcagcctgaccagcagcagcaccctgaccgagatcctggaggccatgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagaagatgctggaggagcagctgatcacccacgccagcggcgaggcctggagaaccttcatctacggcttctacttctacaagatcgtgaccgacaaggagcccgacagagtggccatgcagcagcccgccaccacctggcacaccgccggcgtggacgacttcgccagcttccagagaaagtggttcgaggtggccttcgtggccgaggagctggtgcacagcgagatccccgccttcctgctgccctggctgcccagcagacccgccagctacgccagcagacacagcagcttcagcagaagcttcggcggcagaagccaggccgccgccctgctggccgccaccgtgcccgagcagagaaccgtgaccctggacgtggacgtgaacaacagaaccgacagactggagtggtgcagctgctactaccacggcaacttcagcctgaacgccgccttcgagatcaagctgcactggatggccgtgaccgccgccgtgctgttcgagatggtgcagggctggcacagaaaggccaccagctgcggcttcctgctggtgcccgtgctggagggccccttcgccctgcccagctacctgtacggcgaccccctgagagcccagctgttcatccccctgaacatcagctgcctgctgaaggagggcagcgagcacctgttcgacagcttcgagcccgagacctactgggacagaatgcacctgttccaggaggccatcgcccacagattcggcttcgtgcaggacaagtacagcgccagcgccttcaacttccccgccgagaacaagccccagtacatccacgtgaccggcaccgtgttcctgcagctgccctacagcaagagaaagttcagcggccagcagagaagaagaagaaacagcaccagcagcaccaaccagaacatgttctgcgaggagagagtgggctacaactgggcctacaacaccatgctgaccaagacctggagaagcagcgccaccggcgacgagaagttcgccgacagactgctgaaggacttcaccgacttctgcatcaacagagacaacagactggtgaccttctggaccagctgcctggagaagatgcacgccagcgccccctag

SEQ ID NO: 79036 - DNA, 1680 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagagcacctgggctag

SEQ ID NO: 79037 - DNA, 4659 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtgggccccagcggcgaggccatccagatccaccaccagaccagacagaacatggccgagctgcagggcagcggccagagagaccccacccacagcagcgccgagctgctggagctggcctaccacgaggccgccggcagacacagcaacagcagacagcccggcgacggcatgagcttcctgaacttcagcggcaccgaggagctgagcgtgggcctgctgagcaacagcggcgccggcatgaaccccagaacccagaacaaggacagcctggaggacagcgtgagcaccagccccgaccccatcctgaccctgagcgccccccccgtggtgcccggcttctgctgcaccgtgggcgtggactggaagagcctgaccacccccgcctgcctgcccctgaccaccgactacttccccgacagacagggcctgcagaacgactacaccgagggctgctacgacctgctgcccgaggccgacatcgacagaagagacgaggacggcgtgcagatgaccgcccagcaggtgttcgaggagttcatctgccagagactgatgcagggctaccagatcatcgtgcagcccaagacccagaagcccaaccccgccgtgcccccccccctgagcagcagccccctgtacagcagaggcctggtgagcagaaacagacccgaggaggaggaccagtactggctgagcatgggcagaaccttccacaaggtgaccctgaaggacaagatgatcaccgtgaccagatacctgcccaagtacccctacgagagcgcccagatccactacacctacagcctgtgccccagccacagcgacagcgagttcgtgagctgctgggtggagttcagccacgagagactggaggagtacaagtggaactacctggaccagtacatctgcagcgccggcagcgaggacttcagcctgatcgagagcctgaagttctggagaaccagattcctgctgctgcccgcctgcgtgaccgccaccaagagaatcaccgagggcgaggcccactgcgacatctacggcgacagacccagagccgacgaggacgagtggcagctgctggacggcttcgtgagattcgtggagggcctgaacagaatcagaagaagacacagaagcgacagaatgatgagaaagggcaccgccatgaagggcctgcagatgaccggccccatcagcacccacagcctggagagcaccgccccccccgtgggcaagaagggcaccagcgccctgagcgccctgctggagatggaggccagccagaagtgcctgggcgagcagcaggccgccgtgcacggcggcaagagcagcgcccagagcgccgagagcagcagcgtggccatgacccccacctacatggacagccccagaaaggacggcgccttcttcatggagttcgtgagaagccccagaaccgccagcagcgccttctacccccaggtgagcgtggaccagaccgccacccccatgctggacggcaccagcctgggcatctgcaccggccagagcatggacagaggcaacagccagaccttcggcaacagccagaacatcggcgagcagggctacagcagcaccaacagcagcgacagcagcagccagcagctggtggccagcagcctgaccagcagcagcaccctgaccgagatcctggaggccatgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagaagatgctggaggagcagctgatcacccacgccagcggcgaggcctggagaaccttcatctacggcttctacttctacaagatcgtgaccgacaaggagcccgacagagtggccatgcagcagcccgccaccacctggcacaccgccggcgtggacgacttcgccagcttccagagaaagtggttcgaggtggccttcgtggccgaggagctggtgcacagcgagatccccgccttcctgctgccctggctgcccagcagacccgccagctacgccagcagacacagcagcttcagcagaagcttcggcggcagaagccaggccgccgccctgctggccgccaccgtgcccgagcagagaaccgtgaccctggacgtggacgtgaacaacagaaccgacagactggagtggtgcagctgctactaccacggcaacttcagcctgaacgccgccttcgagatcaagctgcactggatggccgtgaccgccgccgtgctgttcgagatggtgcagggctggcacagaaaggccaccagctgcggcttcctgctggtgcccgtgctggagggccccttcgccctgcccagctacctgtacggcgaccccctgagagcccagctgttcatccccctgaacatcagctgcctgctgaaggagggcagcgagcacctgttcgacagcctgggcctgtacaagatcaacatcctgcccctgctgctgaccagcctgctgagaaccagcctgagcatcagcaccctgcaggagcagtgcttctgcagctgccccacccccagcgccagcagccagggcagcagcggcggcggcggcaccccccccgccccccccaccagaacctgcagcgccagaagcggcagcgccaccaccggccccaccaccccctgcagccccaagcacggcgcccccgccccccagggcatgaagagcctgctgatcggctgctag

SEQ ID NO: 79038 - DNA, 4719 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtgggccccagcggcgaggccatccagatccaccaccagaccagacagaacatggccgagctgcagggcagcggccagagagaccccacccacagcagcgccgagctgctggagctggcctaccacgaggccgccggcagacacagcaacagcagacagcccggcgacggcatgagcttcctgaacttcagcggcaccgaggagctgagcgtgggcctgctgagcaacagcggcgccggcatgaaccccagaacccagaacaaggacagcctggaggacagcgtgagcaccagccccgaccccatgcccggcttctgctgcaccgtgggcgtggactggaagagcctgaccacccccgcctgcctgcccctgaccaccgactacttccccgacagacagggcctgcagaacgactacaccgagggctgctacgacctgctgcccgaggccgacatcgacagaagagacgaggacggcgtgcagatgaccgcccagcaggtgttcgaggagttcatctgccagagactgatgcagggctaccagatcatcgtgcagcccaagacccagaagcccaaccccgccgtgcccccccccctgagcagcagccccctgtacagcagaggcctggtgagcagaaacagacccgaggaggaggaccagtactggctgagcatgggcagaaccttccacaaggtgaccctgaaggacaagatgatcaccgtgaccagatacctgcccaagtacccctacgagagcgcccagatccactacacctacagcctgtgccccagccacagcgacagcgagttcgtgagctgctgggtggagttcagccacgagagactggaggagtacaagtggaactacctggaccagtacatctgcagcgccggcagcgaggacttcagcctgatcgagagcctgaagttctggagaaccagattcctgctgctgcccgcctgcgtgaccgccaccaagagaatcaccgagggcgaggcccactgcgacatctacggcgacagacccagagccgacgaggacgagtggcagctgctggacggcttcgtgagattcgtggagggcctgaacagaatcagaagaagacacagaagcgacagaatgatgagaaagggcaccgccatgaagggcctgcagatgaccggccccatcagcacccacagcctggagagcaccgccccccccgtgggcaagaagggcaccagcgccctgagcgccctgctggagatggaggccagccagaagtgcctgggcgagcagcaggccgccgtgcacggcggcaagagcagcgcccagagcgccgagagcagcagcgtggccatgacccccacctacatggacagccccagaaaggtgagcgtggaccagaccgccacccccatgctggacggcaccagcctgggcatctgcaccggccagagcatggacagaggcaacagccagaccttcggcaacagccagaacatcggcgagcagggctacagcagcaccaacagcagcgacagcagcagccagcagctggtggccagcagcctgaccagcagcagcaccctgaccgagatcctggaggccatgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagaagatgctggaggagcagctgatcacccacgccagcggcgaggcctggagaaccttcatctacggcttctacttctacaagatcgtgaccgacaaggagcccgacagagtggccatgcagcagcccgccaccacctggcacaccgccggcgtggacgacttcgccagcttccagagaaagtggttcgaggtggccttcgtggccgaggagctggtgcacagcgagatccccgccttcctgctgccctggctgcccagcagacccgccagctacgccagcagacacagcagcttcagcagaagcttcggcggcagaagccaggccgccgccctgctggccgccaccgtgcccgagcagagaaccgtgaccctggacgtggacgtgaacaacagaaccgacagactggagtggtgcagctgctactaccacggcaacttcagcctgaacgccgccttcgagatcaagctgcactggatggccgtgaccgccgccgtgctgttcgagatggtgcagggctggcacagaaaggccaccagctgcggcttcctgctggtgcccgtgctggagggccccttcgccctgcccagctacctgtacggcgaccccctgagagcccagctgttcatccccctgaacatcagctgcctgctgaaggagggcagcgagcacctgttcgacagcttcgagcccgagacctactgggacagaatgcacctgttccaggaggccatcgcccacagattcggcttcgtgcaggacaagtacagcgccagcgccttcaacttccccgccgagaacaagccccagtacatccacgtgaccggcaccgtgttcctgcagctgccctacagcaagagaaagttcagcggccagcagagaagaagaagaaacagcaccagcagcaccaaccagaacatgttctgcgaggagagagtgggctacaactgggcctacaacaccatgctgaccaagacctggagaagcagcgccaccggcgacgagaagttcgccgacagactgctgaaggacttcaccgacttctgcatcaacagagacaacagactggtgaccttctggaccagctgcctggagaagatgcacgccagcgccccctag

SEQ ID NO: 79039 - DNA, 4719 bp, Artificial Sequence; identical to SEQ ID NO: 79038
  Description of Artificial Sequence: Synthetic coding sequence

SEQ ID NO: 79040 - DNA, 138 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaactag

SEQ ID NO: 79041 - DNA, 4512 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtgggcatgaaccccagaacccagaacaaggacagcctggaggacagcgtgagcaccagccccgaccccatcctgaccctgagcgccccccccgtggtgcccggcttctgctgcaccgtgggcgtggactggaagagcctgaccacccccgcctgcctgcccctgaccaccgactacttccccgacagacagggcctgcagaacgactacaccgagggctgctacgacctgctgcccgaggccgacatcgacagaagagacgaggacggcgtgcagatgaccgcccagcaggtgttcgaggagttcatctgccagagactgatgcagggctaccagatcatcgtgcagcccaagacccagaagcccaaccccgccgtgcccccccccctgagcagcagccccctgtacagcagaggcctggtgagcagaaacagacccgaggaggaggaccagtactggctgagcatgggcagaaccttccacaaggtgaccctgaaggacaagatgatcaccgtgaccagatacctgcccaagtacccctacgagagcgcccagatccactacacctacagcctgtgccccagccacagcgacagcgagttcgtgagctgctgggtggagttcagccacgagagactggaggagtacaagtggaactacctggaccagtacatctgcagcgccggcagcgaggacttcagcctgatcgagagcctgaagttctggagaaccagattcctgctgctgcccgcctgcgtgaccgccaccaagagaatcaccgagggcgaggcccactgcgacatctacggcgacagacccagagccgacgaggacgagtggcagctgctggacggcttcgtgagattcgtggagggcctgaacagaatcagaagaagacacagaagcgacagaatgatgagaaagggcaccgccatgaagggcctgcagatgaccggccccatcagcacccacagcctggagagcaccgccccccccgtgggcaagaagggcaccagcgccctgagcgccctgctggagatggaggccagccagaagtgcctgggcgagcagcaggccgccgtgcacggcggcaagagcagcgcccagagcgccgagagcagcagcgtggccatgacccccacctacatggacagccccagaaaggtgagcgtggaccagaccgccacccccatgctggacggcaccagcctgggcatctgcaccggccagagcatggacagaggcaacagccagaccttcggcaacagccagaacatcggcgagcagggctacagcagcaccaacagcagcgacagcagcagccagcagctggtggccagcagcctgaccagcagcagcaccctgaccgagatcctggaggccatgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagaagatgctggaggagcagctgatcacccacgccagcggcgaggcctggagaaccttcatctacggcttctacttctacaagatcgtgaccgacaaggagcccgacagagtggccatgcagcagcccgccaccacctggcacaccgccggcgtggacgacttcgccagcttccagagaaagtggttcgaggtggccttcgtggccgaggagctggtgcacagcgagatccccgccttcctgctgccctggctgcccagcagacccgccagctacgccagcagacacagcagcttcagcagaagcttcggcggcagaagccaggccgccgccctgctggccgccaccgtgcccgagcagagaaccgtgaccctggacgtggacgtgaacaacagaaccgacagactggagtggtgcagctgctactaccacggcaacttcagcctgaacgccgccttcgagatcaagctgcactggatggccgtgaccgccgccgtgctgttcgagatggtgcagggctggcacagaaaggccaccagctgcggcttcctgctggtgcccgtgctggagggccccttcgccctgcccagctacctgtacggcgaccccctgagagcccagctgttcatccccctgaacatcagctgcctgctgaaggagggcagcgagcacctgttcgacagcttcgagcccgagacctactgggacagaatgcacctgttccaggaggccatcgcccacagattcggcttcgtgcaggacaagtacagcgccagcgccttcaacttccccgccgagaacaagccccagtacatccacgtgaccggcaccgtgttcctgcagctgccctacagcaagagaaagttcagcggccagcagagaagaagaagaaacagcaccagcagcaccaaccagaacatgttctgcgaggagagagtgggctacaactgggcctacaacaccatgctgaccaagacctggagaagcagcgccaccggcgacgagaagttcgccgacagactgctgaaggacttcaccgacttctgcatcaacagagacaacagactggtgaccttctggaccagctgcctggagaagatgcacgccagcgccccctag

SEQ ID NO: 79042 - DNA, 1995 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtgggcatgaaccccagaacccagaacaaggacagcctggaggacagcgtgagcaccagccccgaccccagcaagagaggccagctgaccggcgagagaggcagacagggcgtgtggggcggccagagcatgagaaagcaggaggaggccctgtgggaggtgagcggccccgaggtgcacatccccctgggctacggcaaggccatgtggtag

SEQ ID NO: 79043 - DNA, 1263 bp, Artificial Sequence
  Description of Artificial Sequence: Synthetic coding sequence
atgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagaagatgctggaggagcagctgatcacccacgccagcggcgaggcctggagaaccttcatctacggcttctacttctacaagatcgtgaccgacaaggagcccgacagagtggccatgcagcagcccgccaccacctggcacaccgccggcgtggacgacttcgccagcttccagagaaagtggttcgaggtggccttcgtggccgaggagctggtgcacagcgagatccccgccttcctgctgccctggctgcccagcagacccgccagctacgccagcagacacagcagcttcagcagaagcttcggcggcagaagccaggccgccgccctgctggccgccaccgtgcccgagcagagaaccgtgaccctggacgtggacgtgaacaacagaaccgacagactggagtggtgcagctgctactaccacggcaacttcagcctgaacgccgccttcgagatcaagctgcactggatggccgtgaccgccgccgtgctgttcgagatggtgcagggctggcacagaaaggccaccagctgcggcttcctgctggtgcccgtgctggagggccccttcgccctgcccagctacctgtacggcgaccccctgagagcccagctgttcatccccctgaacatcagctgcctgctgaaggagggcagcgagcacctgttcgacagcttcgagcccgagacctactgggacagaatgcacctgttccaggaggccatcgcccacagattcggcttcgtgcaggacaagtacagcgccagcgccttcaacttccccgccgagaacaagccccagtacatccacgtgaccggcaccgtgttcctgcagctgccctacagcaagagaaagttcagcggccagcagagaagaagaagaaacagcaccagcagcaccaaccagaacatgttctgcgaggagagagtgggctacaactgggcctacaacaccatgctgaccaagacctggagaagcagcgccaccggcgacgagaagttcgccgacagactgctgaaggacttcaccgacttctgcatcaacagagacaacagactggtgaccttctggaccagctgcctggagaagatgcacgccagcgccccctag

SEQ ID NO: 79044 - DNA, 4785 bp, Artificial Sequence
  Description of Artificial Sequence: Synthetic coding sequence
atgagaaccaccaaggtgtacaagctggtgatccacaagaagggcttcggcggcagcgacgacgagctggtggtgaaccccaaggtgttcccccacatcaagctgggcgacatcgtggagatcgcccaccccaacgacgagtacagccccctgctgctgcaggtgaagagcctgaaggaggacctgcagaaggagaccatcagcgtggaccagaccgtgacccaggtgttcagactgagaccctaccaggacgtgtacgtgaacgtggtggaccccaaggacgtgaccctggacctggtggagctgaccttcaaggaccagtacatcggcagaggcgacatgtggagactgaagaagagcctggtgagcacctgcgcctacatcacccagaaggtggagttcgccggcatcagagcccaggccggcgagctgtgggtgaagaacgagaaggtgatgtgcggctacatcagcgaggacaccagagtggtgttcagaagcaccagcgccatggtgtacatcttcatccagatgagctgcgagatgtgggacttcgacatctacggcgacctgtacttcgagaaggccgtgaacggcttcctggccgacctgttcaccaagtggaaggagaagaactgcagccacgaggtgaccgtggtgctgttcagcagaaccttctacgacgccaagagcgtggacgagttccccgagatcaacagagccagcatcagacaggaccacaagggcagattctacgaggacttctacaaggtggtggtgcagaacgagagaagagaggagtggaccagcctgctggtgaccatcaagaagctgttcatccagtaccccgtgctggtgagactggagcaggccgagggcttcccccagggcgacaacagcaccagcgcccagggcaactacctggaggccatcaacctgagcttcaacgtgttcgacaagcactacatcaacagaaacttcgacagaaccggccagatgagcgtggtgatcacccccggcgtgggcgtgttcgaggtggacagactgctgatgatcctgaccaagcagagaatgatcgacaacggcatcggcgtggacctggtgtgcatgggcgagcagcccctgcacgccgtgcccctgttcaagctgcacaacagaagcgcccccagagacagcagactgggcgacgactacaacatcccccactggatcaaccacagcttctacaccagcaagagccagctgttctgcaacagcttcacccccagaatcaagctggccggcaagaagcccgccagcgagaaggccaagaacggcagagacaccagcctgggcagccccaaggagagcgagaacgccctgcccatccaggtggactacgacgcctacgacgcccaggtgttcagactgcccggccccagcagagcccagtgcctgaccacctgcagaagcgtgagagagagagagagccacagcagaaagagcgccagcagctgcgacgtgagcagcagccccagcctgcccagcagaaccctgcccaccgaggaggtgagaagccaggccagcgacgacagcagcctgggcaagagcgccaacatcctgatgatcccccacccccacctgcaccagtacgaggtgagcagcagcctgggctacaccagcaccagagacgtgctggagaacatgatggagcccccccagagagacagcagcgcccccggcagattccacgtgggcagcgccgagagcatgctgcacgtgagacccggcggctacaccccccagagagccctgatcaaccccttcgcccccagcagaatgcccatgaagctgaccagcaacagaagaagatggatgcacaccttccccgtgggccccagcggcgaggccatccagatccaccaccagaccagacagaacatggccgagctgcagggcagcggccagagagaccccacccacagcagcgccgagctgctggagctggcctaccacgaggccgccggcagacacagcaacagcagacagcccggcgacggcatgagcttcctgaacttcagcggcaccgaggagctgagcgtgggcctgctgagcaacagcggcgccggcatgaaccccagaacccagaacaaggacagcctggaggacagcgtgagcaccagccccgaccccatgcccggcttctgctgcaccgtgggcgtggactggaagagcctgaccacccccgcctgcctgcccctgaccaccgactacttccccgacagacagggcctgcagaacgactacaccgagggctgctacgacctgctgcccgaggccgacatcgacagaagagacgaggacggcgtgcagatgaccgcccagcaggtgttcgaggagttcatctgccagagactgatgcagggctaccagatcatcgtgcagcccaagacccagaagcccaaccccgccgtgcccccccccctgagcagcagccccctgtacagcagaggcctggtgagcagaaacagacccgaggaggaggaccagtactggctgagcatgggcagaaccttccacaaggtgaccctgaaggacaagatgatcaccgtgaccagatacctgcccaagtacccctacgagagcgcccagatccactacacctacagcctgtgccccagccacagcgacagcgagttcgtgagctgctgggtggagttcagccacgagagactggaggagtacaagtggaactacctggaccagtacatctgcagcgccggcagcgaggacttcagcctgatcgagagcctgaagttctggagaaccagattcctgctgctgcccgcctgcgtgaccgccaccaagagaatcaccgagggcgaggcccactgcgacatctacggcgacagacccagagccgacgaggacgagtggcagctgctggacggcttcgtgagattcgtggagggcctgaacagaatcagaagaagacacagaagcgacagaatgatgagaaagggcaccgccatgaagggcctgcagatgaccggccccatcagcacccacagcctggagagcaccgccccccccgtgggcaagaagggcaccagcgccctgagcgccctgctggagatggaggccagccagaagtgcctgggcgagcagcaggccgccgtgcacggcggcaagagcagcgcccagagcgccgagagcagcagcgtggccatgacccccacctacatggacagccccagaaaggacggcgccttcttcatggagttcgtgagaagccccagaaccgccagcagcgccttctacccccaggtgagcgtggaccagaccgccacccccatgctggacggcaccagcctgggcatctgcaccggccagagcatggacagaggcaacagccagaccttcggcaacagccagaacatcggcgagcagggctacagcagcaccaacagcagcgacagcagcagccagcagctggtggccagcagcctgaccagcagcagcaccctgaccgagatcctggaggccatgaagcaccccagcaccggcgtgcagctgctgagcgagcagaagggcctgagcccctactgcttcatcagcgccgaggtggtgcactggctggtgaaccacgtggagggcatccagacccaggccatggccatcgacatcatgcagaagatgctggaggagcagctgatcacccacgccagcggcgaggcctggagaaccttcatctacggcttctacttctacaagatcgtgaccgacaaggagcccgacagagtggccatgcagcagcccgccaccacctggcacaccgccggcgtggacgacttcgccagcttccagagaaagtggttcgaggtggccttcgtggccgaggagctggtgcacagcgagatccccgccttcctgctgccctggctgcccagcagacccgccagctacgccagcagacacagcagcttcagcagaagcttcggcggcagaagccaggccgccgccctgctggccgccaccgtgcccgagcagagaaccgtgaccctggacgtggacgtgaacaacagaaccgacagactggagtggtgcagctgctactaccacggcaacttcagcctgaacgccgccttcgagatcaagctgcactggatggccgtgaccgccgccgtgctgttcgagatggtgcagggctggcacagaaaggccaccagctgcggcttcctgctggtgcccgtgctggagggccccttcgccctgcccagctacctgtacggcgaccccctgagagcccagctgttcatccccctgaacatcagctgcctgctgaaggagggcagcgagcacctgttcgacagcttcgagcccgagacctactgggacagaatgcacctgttccaggaggccatcgcccacagattcggcttcgtgcaggacaagtacagcgccagcgccttcaacttccccgccgagaacaagccccagtacatccacgtgaccggcaccgtgttcctgcagctgccctacagcaagagaaagttcagcggccagcagagaagaagaagaaacagcaccagcagcaccaaccagaacatgttctgcgaggagagagtgggctacaactgggcctacaacaccatgctgaccaagacctggagaagcagcgccaccggcgacgagaagttcgccgacagactgctgaaggacttcaccgacttctgcatcaacagagacaacagactggtgaccttctggaccagctgcctggagaagatgcacgccagcgccccctag

SEQ ID NO: 79045 - DNA, 1536 bp, Artificial Sequence
  Description of Artificial Sequence: Synthetic coding sequence
atggccaccgtgcaggagaaggccgccgccctgaacctgagcgccctgcacagccccgcccacagaccccccggcttcagcgtggcccagaagcccttcggcgccacctacgtgtggagcagcatcatcaacaccctgcagacccaggtggaggtgaagaagagaagacacagactgaagagacacaacgactgcttcgtgggcagcgaggccgtggacgtgatcttcagccacctgatccagaacaagtacttcggcgacgtggacatccccagagccaaggtggtgagagtgtgccaggccctgatggactacaaggtgttcgaggccgtgcccaccaaggtgttcggcaaggacaagaagcccaccttcgaggacagcagctgcagcctgtacagattcaccaccatccccaaccaggacagccagctgggcaaggagaacaagctgtacagccccgccagatacgccgacgccctgttcaagagcagcgacatcagaagcgccagcctggaggacctgtgggagaacctgagcctgaagcccgccaacagcccccacgtgaacatcagcgccaccctgagcccccaggtgatcaacgaggtgtggcaggaggagaccatcggcagactgctgcagctggtggacctgcccctgctggacagcctgctgaagcagcaggaggccgtgcccaagatcccccagcccaagagacagagcaccatggtgaacagcagcaactacctggacagaggcatcctgaaggcctacagcgacagccaggaggacgagtggctgagcgccgccatcgactgcctggagtacctgcccgaccagatggtggtggagatcagcagaagcttccccgagcagcccgacagaaccgacctggtgaaggagctgctgttcgacgccatcggcagatactacagcagcagagagcccctgctgaaccacctgagcgacgtgcacaacggcatcgccgagctgctggtgaacggcaagaccgagatcgccctggaggccacccagctgctgctgaagctgctggacttccagaacagagaggagttcagaagactgctgtacttcatggccgtggccgccaaccccagcgagttcaagctgcagaaggagagcgacaacagaatggtggtgaagagaatcttcagcaaggccatcgtggacaacaagaacctgagcaagggcaagaccgacctgctggtgctgttcctgatggaccaccagaaggacgtgttcaagatccccggcaccctgcacaagatcgtgagcgtgaagctgatggccatccagaacggcagagaccccaacagagacgccggctacatctactgccagagaatcgaccagagagactacagcaacaacaccgagaagaccaccaaggacgagctgctgaacctgctgaagaccctggacgaggacagcaagctgagcgccaaggagaagaagaagctgctgggccagttctacaagtgccaccccgacatcttcatcgagcacttcggcgactag

SEQ ID NO: 79046 - DNA, 1509 bp, Artificial Sequence
  Description of Artificial Sequence: Synthetic coding sequence
atgagaggcctgtgcgagttctactggcaggagttcggcatcaagggcttcagcgtggcccagaagcccttcggcgccacctacgtgtggagcagcatcatcaacaccctgcagacccaggtggaggtgaagaagagaagacacagactgaagagacacaacgactgcttcgtgggcagcgaggccgtggacgtgatcttcagccacctgatccagaacaagtacttcggcgacgtggacatccccagagccaaggtggtgagagtgtgccaggccctgatggactacaaggtgttcgaggccgtgcccaccaaggtgttcggcaaggacaagaagcccaccttcgaggacagcagctgcagcctgtacagattcaccaccatccccaaccaggacagccagctgggcaaggagaacaagctgtacagccccgccagatacgccgacgccctgttcaagagcagcgacatcagaagcgccagcctggaggacctgtgggagaacctgagcctgaagcccgccaacagcccccacgtgaacatcagcgccaccctgagcccccaggtgatcaacgaggtgtggcaggaggagaccatcggcagactgctgcagctggtggacctgcccctgctggacagcctgctgaagcagcaggaggccgtgcccaagatcccccagcccaagagacagagcaccatggtgaacagcagcaactacctggacagaggcatcctgaaggcctacagcgacagccaggaggacgagtggctgagcgccgccatcgactgcctggagtacctgcccgaccagatggtggtggagatcagcagaagcttccccgagcagcccgacagaaccgacctggtgaaggagctgctgttcgacgccatcggcagatactacagcagcagagagcccctgctgaaccacctgagcgacgtgcacaacggcatcgccgagctgctggtgaacggcaagaccgagatcgccctggaggccacccagctgctgctgaagctgctggacttccagaacagagaggagttcagaagactgctgtacttcatggccgtggccgccaaccccagcgagttcaagctgcagaaggagagcgacaacagaatggtggtgaagagaatcttcagcaaggccatcgtggacaacaagaacctgagcaagggcaagaccgacctgctggtgctgttcctgatggaccaccagaaggacgtgttcaagatccccggcaccctgcacaagatcgtgagcgtgaagctgatggccatccagaacggcagagaccccaacagagacgccggctacatctactgccagagaatcgaccagagagactacagcaacaacaccgagaagaccaccaaggacgagctgctgaacctgctgaagaccctggacgaggacagcaagctgagcgccaaggagaagaagaagctgctgggccagttctacaagtgccaccccgacatcttcatcgagcacttcggcgactag

SEQ ID NO: 79047 - DNA, 1230 bp, Artificial Sequence
  Description of Artificial Sequence: Synthetic coding sequence
atggaggagggcggcagcaccggcagcgccggcagcgacagcagcaccagcggcagcggcggcgcccagcagagagagctggagagaatggccgaggtgctggtgaccggcgagcagctgagactgagactgcacgaggagaaggtgatcaaggacagaagacaccacctgaagacctaccccaactgcttcgtggccaaggagctgatcgactggctgatcgagcacaaggaggccagcgacagagagaccgccatcaagctgatgcagaagctggccgacagaggcatcatccaccacgtgtgcgacgagcacaaggagttcaaggacgtgaagctgttctacagattcagaaaggacgacggcaccttccccctggacaacgaggtgaaggccttcatgagaggccagagactgtacgagaagctgatgagccccgagaacaccctgctgcagcccagagaggaggagggcgtgaagtacgagagaaccttcatggccagcgagttcctggactggctggtgcaggagggcgaggccaccaccagaaaggaggccgagcagctgtgccacagactgatggagcacggcatcatccagcacgtgagcaacaagcaccccttcgtggacagcaacctgctgtaccagttcagaatgaacttcagaagaagaagaagactgatggagctgctgaacgagaagagccccagcagccaggagacccacgacagccccttctgcctgagaaagcagagccacgacaacagaaagagcaccagcttcatgagcgtgagccccagcaaggagatcaagatcgtgagcgccgtgagaagaagcagcatgagcagctgcggcagcagcggctacttcagcagcagccccaccctgagcagcagcccccccgtgctgtgcaaccccaagagcgtgctgaagagacccgtgaccagcgaggagctgctgacccccggcgccccctacgccagaaagaccttcaccatcgtgggcgacgccgtgggctggggcttcgtggtgagaggcagcaagccctgccacatccaggccgtggaccccagcggccccgccgccgccgccggcatgaaggtgtgccagttcgtggtgagcgtgaacggcctgaacgtgctgcacgtggactacagaaccgtgagcaacctgatcctgaccggccccagaaccatcgtgatggaggtgatggaggagctggagtgctag

SEQ ID NO: 79048 - DNA, 2877 bp, Artificial Sequence
  Description of Artificial Sequence: Synthetic coding sequence
atgagaacccacaccagaggcgcccccagcgtgttcttcatctacctgctgtgcttcgtgagcgcctacatcaccgacgagaaccccgaggtgatgatccccttcaccaacgccaactacgacagccaccccatgctgtacttcagcagagccgaggtggccgagctgcagctgagagccgccagcagccacgagcacatcgccgccagactgaccgaggccgtgcacaccatgctgagcagccccctggagtacctgcccccctgggaccccaaggactacagcgccagatggaacgagatcttcggcaacaacctgggcgccctggccatgttctgcgtgctgtaccccgagaacatcgaggccagagacatggccaaggactacatggagagaatggccgcccagcccagctggctggtgaaggacgccccctgggacgaggtgcccctggcccacagcctggtgggcttcgccaccgcctacgacttcctgtacaactacctgagcaagacccagcaggagaagttcctggaggtgatcgccaacgccagcggctacatgtacgagaccagctacagaagaggctggggcttccagtacctgcacaaccaccagcccaccaactgcatggccctgctgaccggcagcctggtgctgatgaaccagggctacctgcaggaggcctacctgtggaccaagcaggtgctgaccatcatggagaagagcctggtgctgctgagagaggtgaccgacggcagcctgtacgagggcgtggcctacggcagctacaccaccagaagcctgttccagtacatgttcctggtgcagagacacttcaacatcaaccacttcggccacccctggctgaagcagcacttcgccttcatgtacagaaccatcctgcccggcttccagagaaccgtggccatcgccgacagcaactacaactggttctacggccccgagagccagctggtgttcctggacaagttcgtgatgagaaacggcagcggcaactggctggccgaccagatcagaagaaacagagtggtggagggccccggcacccccagcaagggccagagatggtgcaccctgcacaccgagttcctgtggtacgacggcagcctgaagagcgtgcccccccccgacttcggcacccccaccctgcactacttcgaggactggggcgtggtgacctacggcagcgccctgcccgccgagatcaacagaagcttcctgagcttcaagagcggcaagctgggcggcagagccatctacgacatcgtgcacagaaacaagtacaaggactggatcaagggctggagaaacttcaacgccggccacgagcaccccgaccagaacagcttcaccttcgcccccaacggcgtgcccttcatcaccgaggccctgtacggccccaagtacaccttcttcaacaacgtgctgatgttcagccccgccgtgagcaagagctgcttcagcccctgggtgggccaggtgaccgaggactgcagcagcaagtggagcaagtacaagcacgacctggccgccagctgccagggcagagtggtggccgccgaggagaagaacggcgtggtgttcatcagaggcgagggcgtgggcgcctacaacccccagctgaacctgaagaacgtgcagagaaacctgatcctgctgcacccccagctgctgctgctggtggaccagatccacctgggcgaggagagccccctggagaccgccgccagcttcttccacaacgtggacgtgcccttcgaggagaccgtggtggacggcgtgcacggcgccttcatcagacagagagacggcctgtacaagatgtactggatggacgacaccggctacagcgagaaggccaccttcgccagcgtgacctaccccagaggctacccctacaacggcaccaactacgtgaacgtgaccatgcacctgagaagccccatcaccagagccgcctacctgttcatcggccccagcatcgacgtgcagagcttcaccgtgcacggcgacagccagcagctggacgtgttcatcgccaccagcaagcacgcctacgccacctacctgtggaccggcgaggccaccggccagagcgccttcgcccaggtgatcgccgacagacacaagatcctgttcgacagaaacagcgccatcaagagcagcatcgtgcccgaggtgaaggactacgccgccatcgtggagcagaacctgcagcacttcaagcccgtgttccagctgctggagaagcagatcctgagcagagtgagaaacaccgccagcttcagaaagaccgccgagagactgctgagattcagcgacaagagacagaccgaggaggccatcgacagaatcttcgccatcagccagcagcagcagcagcagagcaagagcaagaagaacagaagagccggcaagagatacaagttcgtggacgccgtgcccgacatcttcgcccagatcgaggtgaacgagaagaagatcagacagaaggcccagatcctggcccagaaggagctgcccatcgacgaggacgaggagatgaaggacctgctggacttcgccgacgtgacctacgagaagcacaagaacggcggcctgatcaagggcagattcggccaggccagaatggtgaccaccacccacagcagagcccccagcctgagcgccagctacaccagactgttcctgatcctgaacatcgccatcttcttcgtgatgctggccatgcagctgacctacttccagagagcccagagcctgcacggccagagatgcctgtacgccgtgctgctgatcgacagctgcatcctgctgtggctgtacagcagctgcagccagagccagtgctag

SEQ ID NO: 79049 - DNA, 2877 bp, Artificial Sequence; identical to SEQ ID NO: 79048
  Description of Artificial Sequence: Synthetic coding sequence

SEQ ID NO: 79050 - DNA, 501 bp, Artificial Sequence
  Description of Artificial Sequence: Synthetic coding sequence
atgagaacccacaccagaggcgcccccagcgtgttcttcatctacctgctgtgcttcgtgagcgcctacatcaccgacgagaaccccgaggtgatgatccccttcaccaacgccaactacgacagccaccccatgctgtacttcagcagagccgaggtggccgagctgcagctgagagccgccagcagccacgagcacatcgccgccagactgaccgaggccgtgcacaccatgctgagcagccccctggagtacctgcccccctgggaccccaaggactacagcgccagatggaacgagatcttcggcaacaacctgggcgccctggccatgttctgcgtgctgtaccccgagaacatcgaggccagagacatggccaaggactacatggagagaatggccgcccagcccagctggctggtgaaggacgccccctgggacgaggtgcccctggcccacagcctggtgggcttcgccaccgcctacgacttcctgtactag

SEQ ID NO: 79051 - DNA, 2877 bp, Artificial Sequence; identical to SEQ ID NO: 79048
  Description of Artificial Sequence: Synthetic coding sequence

SEQ ID NO: 79052 - DNA, 2934 bp, Artificial Sequence
  Description of Artificial Sequence: Synthetic coding sequence
atgggcagcttcgaggacggcctggccgccctggagatctggagaagcgacgccaccatgagaacccacaccagaggcgcccccagcgtgttcttcatctacctgctgtgcttcgtgagcgcctacatcaccgacgagaaccccgaggtgatgatccccttcaccaacgccaactacgacagccaccccatgctgtacttcagcagagccgaggtggccgagctgcagctgagagccgccagcagccacgagcacatcgccgccagactgaccgaggccgtgcacaccatgctgagcagccccctggagtacctgcccccctgggaccccaaggactacagcgccagatggaacgagatcttcggcaacaacctgggcgccctggccatgttctgcgtgctgtaccccgagaacatcgaggccagagacatggccaaggactacatggagagaatggccgcccagcccagctggctggtgaaggacgccccctgggacgaggtgcccctggcccacagcctggtgggcttcgccaccgcctacgacttcctgtacaactacctgagcaagacccagcaggagaagttcctggaggtgatcgccaacgccagcggctacatgtacgagaccagctacagaagaggctggggcttccagtacctgcacaaccaccagcccaccaactgcatggccctgctgaccggcagcctggtgctgatgaaccagggctacctgcaggaggcctacctgtggaccaagcaggtgctgaccatcatggagaagagcctggtgctgctgagagaggtgaccgacggcagcctgtacgagggcgtggcctacggcagctacaccaccagaagcctgttccagtacatgttcctggtgcagagacacttcaacatcaaccacttcggccacccctggctgaagcagcacttcgccttcatgtacagaaccatcctgcccggcttccagagaaccgtggccatcgccgacagcaactacaactggttctacggccccgagagccagctggtgttcctggacaagttcgtgatgagaaacggcagcggcaactggctggccgaccagatcagaagaaacagagtggtggagggccccggcacccccagcaagggccagagatggtgcaccctgcacaccgagttcctgtggtacgacggcagcctgaagagcgtgcccccccccgacttcggcacccccaccctgcactacttcgaggactggggcgtggtgacctacggcagcgccctgcccgccgagatcaacagaagcttcctgagcttcaagagcggcaagctgggcggcagagccatctacgacatcgtgcacagaaacaagtacaaggactggatcaagggctggagaaacttcaacgccggccacgagcaccccgaccagaacagcttcaccttcgcccccaacggcgtgcccttcatcaccgaggccctgtacggccccaagtacaccttcttcaacaacgtgctgatgttcagccccgccgtgagcaagagctgcttcagcccctgggtgggccaggtgaccgaggactgcagcagcaagtggagcaagtacaagcacgacctggccgccagctgccagggcagagtggtggccgccgaggagaagaacggcgtggtgttcatcagaggcgagggcgtgggcgcctacaacccccagctgaacctgaagaacgtgcagagaaacctgatcctgctgcacccccagctgctgctgctggtggaccagatccacctgggcgaggagagccccctggagaccgccgccagcttcttccacaacgtggacgtgcccttcgaggagaccgtggtggacggcgtgcacggcgccttcatcagacagagagacggcctgtacaagatgtactggatggacgacaccggctacagcgagaaggccaccttcgccagcgtgacctaccccagaggctacccctacaacggcaccaactacgtgaacgtgaccatgcacctgagaagccccatcaccagagccgcctacctgttcatcggccccagcatcgacgtgcagagcttcaccgtgcacggcgacagccagcagctggacgtgttcatcgccaccagcaagcacgcctacgccacctacctgtggaccggcgaggccaccggccagagcgccttcgcccaggtgatcgccgacagacacaagatcctgttcgacagaaacagcgccatcaagagcagcatcgtgcccgaggtgaaggactacgccgccatcgtggagcagaacctgcagcacttcaagcccgtgttccagctgctggagaagcagatcctgagcagagtgagaaacaccgccagcttcagaaagaccgccgagagactgctgagattcagcgacaagagacagaccgaggaggccatcgacagaatcttcgccatcagccagcagcagcagcagcagagcaagagcaagaagaacagaagagccggcaagagatacaagttcgtggacgccgtgcccgacatcttcgcccagatcgaggtgaacgagaagaagatcagacagaaggcccagatcctggcccagaaggagctgcccatcgacgaggacgaggagatgaaggacctgctggacttcgccgacgtgacctacgagaagcacaagaacggcggcctgatcaagggcagattcggccaggccagaatggtgaccaccacccacagcagagcccccagcctgagcgccagctacaccagactgttcctgatcctgaacatcgccatcttcttcgtgatgctggccatgcagctgacctacttccagagagcccagagcctgcacggccagagatgcctgtacgccgtgctgctgatcgacagctgcatcctgctgtggctgtacagcagctgcagccagagccagtgctag

SEQ ID NO: 79053 - DNA, 570 bp, Artificial Sequence
  Description of Artificial Sequence: Synthetic coding sequence
atggccgccctgaagggcagacaggtgtactgggccaccgccggcaagatcagcggctggacctggccccacgcccccagaagaccccacgtgctgctgctgaacggcatcggcgtgggcggcgccctgggcagcatcgacgagctgctgtgccaggccctgagcaacggcctgaacgtgcccgagggcagcctgaccagcacctgcgcccagcagcccgacggcctgatccacaccgccaagtggggccacgtgcacagcctgagcagccacagccccggcgcccccaacgcctgcggcgtgctgcccggcaccaccgtggacgacggcgtgcaccaggacctgcagagagtgctggcctgcgagcaggtgtacgacctggagggcatgctggacgacgcccacagccacgagctgctggccgtggtggccgccgtgcaccaccacggcgtgagcaaggccctgcacaacggcaccctgagcttcgtggaggccttcggcggcatccccccctgcaccgtgagaatcttcagaagatggttcggctgcctgggcgacctggagatctag

SEQ ID NO: 79054 - DNA, 3669 bp, Artificial Sequence
  Description of Artificial Sequence: Synthetic coding sequence
atgcccaagggcggcgcccccccctggatcatggccctgatgttcaccggccacctgctgttcctggccctgctgatgttcgccttcagcaccttcgaggagagcgtgagcaactacagcgagtgggccgtgttcaccgacgacatcgaccagttcaagacccagaaggtgcaggacttcagacccaaccagaagctgaagaagagcatgctgcaccccagcctgtacttcgacgccggcgagatccaggccatgagacagaagagcagagccagccacctgcacctgttcagagccatcagaagcgccgtgaccgtgatgctgagcaaccccacctactacctgcccccccccaagcacgccgacttcgccgccaagtggaacgagatctacggcaacaacctgccccccctggccctgtactgcctgctgtgccccgaggacaaggtggccttcgagttcgtgctggagtacatggacagaatggtgggctacaaggactggctggtggagaacgcccccggcgacgaggtgcccatcggccacagcctgaccggcttcgccaccgccttcgacttcctgtacaacctgctggacaaccacagaagacagaagtacctggagaagatctgggtgatcaccgaggagatgtacgagtacagcaaggtgagaagctggggcaagcagctgctgcacaaccaccaggccaccaacatgatcgccctgctgaccggcgccctggtgaccggcgtggacaagggcagcaaggccaacatctggaagcaggccgtggtggacgtgatggagaagaccatgttcctgctgaaccacatcgtggacggcagcctggacgagggcgtggcctacggcagctacaccgccaagagcgtgacccagtacgtgttcctggcccagagacacttcaacatcaacaacctggacaacaactggctgaagatgcacttctggttctactacgccaccctgctgcccggcttccagagaaccgtgggcatcgccgacagcaactacaactggttctacggccccgagagccagctggtgttcctggacaagttcatcctgaagaacggcgccggcaactggctggcccagcagatcagaaagcacagacccaaggacggccccatggtgcccagcaccgcccagagatggagcaccctgcacaccgagtacatctggtacgacccccagctgaccccccagccccccgccgactacggcaccgccaagatccacaccttccccaactggggcgtggtgacctacggcgccggcctgcccaacacccagaccaacaccttcgtgagcttcaagagcggcaagctgggcggcagagccgtgtacgacatcgtgcacttccagccctacagctggatcgacggctggagaagcttcaaccccggccacgagcaccccgaccagaacagcttcaccttcgcccccaacggccaggtgttcgtgagcgaggccctgtacggccccaagctgagccacctgaacaacgtgctggtgttcgcccccagccccagcagccagtgcaacaagccctgggagggccagctgggcgagtgcgcccagtggctgaagtggaccggcgaggaggtgggcgacgccgccggcgagatcatcaccgccagccagcacggcgagatggtgttcgtgagcggcgaggccgtgagcgcctacagcagcgccatgagactgaagagcgtgtacagagccctgctgctgctgaacagccagaccctgctggtggtggaccacatcgagagacaggaggacagccccatcaacagcgtgagcgccttcttccacaacctggacatcgacttcaagtacatcccctacaagttcatgaacagatacaacggcgccatgatggacgtgtgggacgcccactacaagatgttctggttcgaccaccacggcaacagccccatggccagcatccaggaggccgagcaggccgccgagttcaagaagagatggacccagttcgtgaacgtgaccttccagatggagcccaccatcaccagaatcgcctacgtgttctacggcccctacatcaacgtgagcagctgcagattcatcgacagcagcaaccccggcctgcagatcagcctgaacgtgaacaacaccgagcacgtggtgagcatcgtgaccgactaccacaacctgaagaccagattcaactacctgggcttcggcggcttcgccagcgtggccgaccagggccagatcaccagattcggcctgggcacccaggccatcgtgaagcccgtgagacacgacagaatcatcttccccttcggcttcaagttcaacatcgccgtgggcctgatcctgtgcatcagcctggtgatcctgaccttccagtggagattctacctgagcttcagaaagctgatgagatggatcctgatcctggtgatcgccctgtggttcatcgagctgctggacgtgtggagcacctgcagccagcccatctgcgccaagtggaccagaaccgaggccgagggcagcaagaagagcctgagcagcgagggccaccacatggacctgcccgacgtggtgatcaccagcctgcccggcagcggcgccgagatcctgaagcagctgttcttcaacagcagcgacttcctgtacatcagagtgcccaccgcctacatcgacatccccgagaccgagctggagatcgacagcttcgtggacgcctgcgagtggaaggtgagcgacatcagaagcggccacttcagactgctgagaggctggctgcagagcctggtgcaggacaccaagctgcacctgcagaacatccacctgcacgagcccaacagaggcaagctggcccagtacttcgccatgaacaaggacaagaagagaaagttcaagagaagagagagcctgcccgagcagagaagccagatgaagggcgccttcgacagagacgccgagtacatcagagccctgagaagacacctggtgtactaccccagcgccagacccgtgctgagcctgagcagcggcagctggaccctgaagctgcacttcttccaggaggtgctgggcgccagcatgagagccctgtacatcgtgagagaccccagagcctggatctacagcatgctgtacaacagcaagcccagcctgtacagcctgaagaacgtgcccgagcacctggccaagctgttcaagatcgagggcggcaagggcaagtgcaacctgaacagcggctacgccttcgagtacgagcccctgagaaaggagctgagcaagagcaagagcaacgccgtgagcctgctgagccacctgtggctggccaacaccgccgccgccctgagaatcaacaccgacctgctgcccaccagctaccagctggtgaagttcgaggacatcgtgcacttcccccagaagaccaccgagagaatcttcgccttcctgggcatccccctgagccccgccagcctgaaccagatcctgttcgccaccagcaccaacctgttctacctgccctacgagggcgagatcagccccaccaacaccaacgtgtggaagcagaacctgcccagagacgagatcaagctgatcgagaacatctgctggaccctgatggacagactgggctaccccaagttcatggactag

SEQ ID NO: 79055 - DNA, 3639 bp, Artificial Sequence
  Description of Artificial Sequence: Synthetic coding sequence
atggccctgatgttcaccggccacctgctgttcctggccctgctgatgttcgccttcagcaccttcgaggagagcgtgagcaactacagcgagtgggccgtgttcaccgacgacatcgaccagttcaagacccagaaggtgcaggacttcagacccaaccagaagctgaagaagagcatgctgcaccccagcctgtacttcgacgccggcgagatccaggccatgagacagaagagcagagccagccacctgcacctgttcagagccatcagaagcgccgtgaccgtgatgctgagcaaccccacctactacctgcccccccccaagcacgccgacttcgccgccaagtggaacgagatctacggcaacaacctgccccccctggccctgtactgcctgctgtgccccgaggacaaggtggccttcgagttcgtgctggagtacatggacagaatggtgggctacaaggactggctggtggagaacgcccccggcgacgaggtgcccatcggccacagcctgaccggcttcgccaccgccttcgacttcctgtacaacctgctggacaaccacagaagacagaagtacctggagaagatctgggtgatcaccgaggagatgtacgagtacagcaaggtgagaagctggggcaagcagctgctgcacaaccaccaggccaccaacatgatcgccctgctgaccggcgccctggtgaccggcgtggacaagggcagcaaggccaacatctggaagcaggccgtggtggacgtgatggagaagaccatgttcctgctgaaccacatcgtggacggcagcctggacgagggcgtggcctacggcagctacaccgccaagagcgtgacccagtacgtgttcctggcccagagacacttcaacatcaacaacctggacaacaactggctgaagatgcacttctggttctactacgccaccctgctgcccggcttccagagaaccgtgggcatcgccgacagcaactacaactggttctacggccccgagagccagctggtgttcctggacaagttcatcctgaagaacggcgccggcaactggctggcccagcagatcagaaagcacagacccaaggacggccccatggtgcccagcaccgcccagagatggagcaccctgcacaccgagtacatctggtacgacccccagctgaccccccagccccccgccgactacggcaccgccaagatccacaccttccccaactggggcgtggtgacctacggcgccggcctgcccaacacccagaccaacaccttcgtgagcttcaagagcggcaagctgggcggcagagccgtgtacgacatcgtgcacttccagccctacagctggatcgacggctggagaagcttcaaccccggccacgagcaccccgaccagaacagcttcaccttcgcccccaacggccaggtgttcgtgagcgaggccctgtacggccccaagctgagccacctgaacaacgtgctggtgttcgcccccagccccagcagccagtgcaacaagccctgggagggccagctgggcgagtgcgcccagtggctgaagtggaccggcgaggaggtgggcgacgccgccggcgagatcatcaccgccagccagcacggcgagatggtgttcgtgagcggcgaggccgtgagcgcctacagcagcgccatgagactgaagagcgtgtacagagccctgctgctgctgaacagccagaccctgctggtggtggaccacatcgagagacaggaggacagccccatcaacagcgtgagcgccttcttccacaacctggacatcgacttcaagtacatcccctacaagttcatgaacagatacaacggcgccatgatggacgtgtgggacgcccactacaagatgttctggttcgaccaccacggcaacagccccatggccagcatccaggaggccgagcaggccgccgagttcaagaagagatggacccagttcgtgaacgtgaccttccagatggagcccaccatcaccagaatcgcctacgtgttctacggcccctacatcaacgtgagcagctgcagattcatcgacagcagcaaccccggcctgcagatcagcctgaacgtgaacaacaccgagcacgtggtgagcatcgtgaccgactaccacaacctgaagaccagattcaactacctgggcttcggcggcttcgccagcgtggccgaccagggccagatcaccagattcggcctgggcacccaggccatcgtgaagcccgtgagacacgacagaatcatcttccccttcggcttcaagttcaacatcgccgtgggcctgatcctgtgcatcagcctggtgatcctgaccttccagtggagattctacctgagcttcagaaagctgatgagatggatcctgatcctggtgatcgccctgtggttcatcgagctgctggacgtgtggagcacctgcagccagcccatctgcgccaagtggaccagaaccgaggccgagggcagcaagaagagcctgagcagcgagggccaccacatggacctgcccgacgtggtgatcaccagcctgcccggcagcggcgccgagatcctgaagcagctgttcttcaacagcagcgacttcctgtacatcagagtgcccaccgcctacatcgacatccccgagaccgagctggagatcgacagcttcgtggacgcctgcgagtggaaggtgagcgacatcagaagcggccacttcagactgctgagaggctggctgcagagcctggtgcaggacaccaagctgcacctgcagaacatccacctgcacgagcccaacagaggcaagctggcccagtacttcgccatgaacaaggacaagaagagaaagttcaagagaagagagagcctgcccgagcagagaagccagatgaagggcgccttcgacagagacgccgagtacatcagagccctgagaagacacctggtgtactaccccagcgccagacccgtgctgagcctgagcagcggcagctggaccctgaagctgcacttcttccaggaggtgctgggcgccagcatgagagccctgtacatcgtgagagaccccagagcctggatctacagcatgctgtacaacagcaagcccagcctgtacagcctgaagaacgtgcccgagcacctggccaagctgttcaagatcgagggcggcaagggcaagtgcaacctgaacagcggctacgccttcgagtacgagcccctgagaaaggagctgagcaagagcaagagcaacgccgtgagcctgctgagccacctgtggctggccaacaccgccgccgccctgagaatcaacaccgacctgctgcccaccagctaccagctggtgaagttcgaggacatcgtgcacttcccccagaagaccaccgagagaatcttcgccttcctgggcatccccctgagccccgccagcctgaaccagatcctgttcgccaccagcaccaacctgttctacctgccctacgagggcgagatcagccccaccaacaccaacgtgtggaagcagaacctgcccagagacgagatcaagctgatcgagaacatctgctggaccctgatggacagactgggctaccccaagttcatggactag

SEQ ID NO: 79056 - DNA, 606 bp, Artificial Sequence
  Description of Artificial Sequence: Synthetic coding sequence
atggacctgagcctgctgtgggtgctgctgcccctggtgaccatggcctggggccagtacggcgactacggctacccctaccagcagtaccacgactacagcgacgacggctgggtgaacctgaacagacagggcttcagctaccagtgcccccagggccaggtgatcgtggccgtgagaagcatcttcagcaagaaggagggcagcgacagacagtggaactacgcctgcatgcccaccccccagagcctgggcgagcccaccgagtgctggtgggaggagatcaacagagccggcatggagtggtaccagacctgcagcaacaacggcctggtggccggcttccagagcagatacttcgagagcgtgctggacagagagtggcagttctactgctgcagatacagcaagagatgcccctacagctgctggctgaccaccgagtaccccggccactacggcgaggagatggacatgatcagctacaactacgactactacatcagaggcgccaccaccaccttcagcgccgtggagagagacagacagtggaagttcatcatgtgcagaatgaccgagtacgactgcgagttcgccaacgtgtag

SEQ ID NO: 79057 - DNA, 333 bp, Artificial Sequence
  Description of Artificial Sequence: Synthetic coding sequence
atgagattcatgaccctgctgttcctgaccgccctggccggcgccctggtgtgcgcctacgaccccgaggccgccagcgcccccggcagcggcaacccctgccacgaggccagcgccgcccagaaggagaacgccggcgaggaccccggcctggccagacaggcccccaagcccagaaagcagagaagcagcctgctggagaagggcctggacggcgccaagaaggccgtgggcggcctgggcaagctgggcaaggacgccgtggaggacctggagagcgtgggcaagggcgccgtgcacgacgtgaaggacgtgctggacagcgtgctgtag

SEQ ID NO: 79058 - DNA, 1191 bp, Artificial Sequence
  Description of Artificial Sequence: Synthetic coding sequence
atggccctgctgaccaacctgctgcccctgtgctgcctggccctgctggccctgcccgcccagagctgcggccccggcagaggccccgtgggcagaagaagatacgccagaaagcagctggtgcccctgctgtacaagcagttcgtgcccggcgtgcccgagagaaccctgggcgccagcggccccgccgagggcagagtggccagaggcagcgagagattcagagacctggtgcccaactacaaccccgacatcatcttcaaggacgaggagaacagcggcgccgacagactgatgaccgagagatgcaaggagagagtgaacgccctggccatcgccgtgatgaacatgtggcccggcgtgagactgagagtgaccgagggctgggacgaggacggccaccacgcccaggacagcctgcactacgagggcagagccctggacatcaccaccagcgacagagacagaaacaagtacggcctgctggccagactggccgtggaggccggcttcgactgggtgtactacgagagcagaaaccacgtgcacgtgagcgtgaaggccgacaacagcctggccgtgagagccggcggctgcttccccggcaacgccaccgtgagactgtggagcggcgagagaaagggcctgagagagctgcacagaggcgactgggtgctggccgccgacgccagcggcagagtggtgcccacccccgtgctgctgttcctggacagagacctgcagagaagagccagcttcgtggccgtggagaccgagtggccccccagaaagctgctgctgaccccctggcacctggtgttcgccgccagaggccccgcccccgcccccggcgacttcgcccccgtgttcgccagaagactgagagccggcgacagcgtgctggcccccggcggcgacgccctgagacccgccagagtggccagagtggccagagaggaggccgtgggcgtgttcgcccccctgaccgcccacggcaccctgctggtgaacgacgtgctggccagctgctacgccgtgctggagagccaccagtgggcccacagagccttcgcccccctgagactgctgcacgccctgggcgccctgctgcccggcggcgccgtgcagcccaccggcatgcactggtacagcagactgctgtacagactggccgaggagctgctgggctag

SEQ ID NO: 79059 - DNA, 1413 bp, Artificial Sequence
  Description of Artificial Sequence: Synthetic coding sequence
atgagccaggcctacagcagcagccagagagtgagcagctacagaagaaccttcggcggcgcccccggcttccccctgggcagccccctgagcagccccgtgttccccagagccggcttcggcagcaagggcagcagcagcagcgtgaccagcagagtgtaccaggtgagcagaaccagcggcggcgccggcggcctgggcagcctgagagccagcagactgggcaccaccagaacccccagcagctacggcgccggcgagctgctggacttcagcctggccgacgccgtgaaccaggagttcctgaccaccagaaccaacgagaaggtggagctgcaggagctgaacgacagattcgccaactacatcgagaaggtgagattcctggagcagcagaacgccgccctggccgccgaggtgaacagactgaagggcagagagcccaccagagtggccgagctgtacgaggaggagctgagagagctgagaagacaggtggaggtgctgaccaaccagagagccagagtggacgtggagagagacaacctgctggacgacctgcagagactgaaggccaagctgcaggaggagatccagctgaaggaggaggccgagaacaacctggccgccttcagagccgacgtggacgccgccaccctggccagaatcgacctggagagaagaatcgagagcctgaacgaggagatcgccttcctgaagaaggtgcacgaggaggagatcagagagctgcaggcccagctgcaggagcagcaggtgcaggtggagatggacatgagcaagcccgacctgaccgccgccctgagagacatcagagcccagtacgagaccatcgccgccaagaacatcagcgaggccgaggagtggtacaagagcaaggtgagcgacctgacccaggccgccaacaagaacaacgacgccctgagacaggccaagcaggagatgatggagtacagacaccagatccagagctacacctgcgagatcgacgccctgaagggcaccaacgacagcctgatgagacagatgagagagctggaggacagattcgccagcgaggccagcggctaccaggacaacatcgccagactggaggaggagatcagacacctgaaggacgagatggccagacacctgagagagtaccaggacctgctgaacgtgaagatggccctggacgtggagatcgccacctacagaaagctgctggagggcgaggagagcagaatcaacctgcccatccagacctacagcgccctgaacttcagagagaccagccccgagcagagaggcagcgaggtgcacaccaagaagaccgtgatgatcaagaccatcgagaccagagacggcgaggtggtgagcgaggccacccagcagcagcacgaggtgctgtag

SEQ ID NO: 79060 - DNA, 2523 bp, Artificial Sequence
  Description of Artificial Sequence: Synthetic coding sequence
atggccctggccagcgccgcccccggcagcatcttctgcaagcagctgctgttcagcctgctggtgctgaccctgctgtgcgacgcctgccagaaggtgtacctgagagtgcccagccacctgcaggccgagaccctggtgggcaaggtgaacctggaggagtgcctgaagagcgccagcctgatcagaagcagcgaccccgccttcagaatcctggaggacggcagcatctacaccacccacgacctgatcctgagcagcgagagaaagagcttcagcatcttcctgagcgacggccagagaagagagcagcaggagatcaaggtggtgctgagcgccagagagaacaagagccccaagaagagacacaccaaggacaccgccctgaagagaagcaagagaagatgggcccccatccccgccagcctgatggagaacagcctgggccccttcccccagcacgtgcagcagatccagagcgacgccgcccagaactacaccatcttctacagcatcagcggccccggcgtggacaaggagcccttcaacctgttctacatcgagaaggacaccggcgacatcttctgcaccagaagcatcgacagagagaagtacgagcagttcgccctgtacggctacgccaccaccgccgacggctacgcccccgagtaccccctgcccctgatcatcaagatcgaggacgacaacgacaacgccccctacttcgagcacagagtgaccatcttcaccgtgcccgagaactgcagaagcggcaccagcgtgggcaaggtgaccgccaccgacctggacgagcccgacaccctgcacaccagactgaagtacaagatcctgcagcagatccccgaccaccccaagcacttcagcatccaccccgacaccggcgtgatcaccaccaccacccccttcctggacagagagaagtgcgacacctaccagctgatcatggaggtgagagacatgggcggccagcccttcggcctgttcaacaccggcaccatcaccatcagcctggaggacgagaacgacaacccccccagcttcaccgagaccagctacgtgaccgaggtggaggagaacagaatcgacgtggagatcctgagaatgaaggtgcaggaccaggacctgcccaacaccccccacagcaaggccgtgtacaagatcctgcagggcaacgagaacggcaacttcatcatcagcaccgaccccaacaccaacgagggcgtgctgtgcgtggtgaagcccctgaactacgaggtgaacagacaggtgatcctgcaggtgggcgtgatcaacgaggcccagttcagcaaggccgccagcagccagacccccaccatgtgcaccaccaccgtgaccgtgaagatcatcgacagcgacgagggccccgagtgccacccccccgtgaaggtgatccagagccaggacggcttccccgccggccaggagctgctgggctacaaggccctggaccccgagatcagcagcggcgagggcctgagataccagaagctgggcgacgaggacaactggttcgagatcaaccagcacaccggcgacctgagaaccctgaaggtgctggacagagagagcaagttcgtgaagaacaaccagtacaacatcagcgtggtggccgtggacgccgtgggcagaagctgcaccggcaccctggtggtgcacctggacgactacaacgaccacgccccccagatcgacaaggaggtgaccatctgccagaacaacgaggacttcgccgtgctgaagcccgtggaccccgacggccccgagaacggcccccccttccagttcttcctggacaacagcgccagcaagaactggaacatcgaggagaaggacggcaagaccgccatcctgagacagagacagaacctggactacaactactacagcgtgcccatccagatcaaggacagacacggcctggtggccacccacatgctgaccgtgagagtgtgcgactgcagcacccccagcgagtgcagaatgaaggacaagagcaccagagacgtgagacccaacgtgatcctgggcagatgggccatcctggccatggtgctgggcagcgtgctgctgctgtgcatcctgttcacctgcttctgcgtgaccgccaagagaaccgtgaagaagtgcttccccgaggacatcgcccagcagaacctgatcgtgagcaacaccgagggccccggcgaggaggtgaccgaggccaacatcagactgcccatgcagaccagcaacatctgcgacaccagcatgagcgtgggcaccgtgggcggccagggcatcaagacccagcagagcttcgagatggtgaagggcggctacaccctggacagcaacaagggcggcggccaccagaccctggagagcgtgaagggcgtgggccagggcgacaccggcagatacgcctacaccgactggcagagcttcacccagcccagactgggcgaggagagcatcagaggccacaccctgatcaagaactag

SEQ ID NO: 79061 - DNA, 2685 bp, Artificial Sequence
  Description of Artificial Sequence: Synthetic coding sequence
atggccctggccagcgccgcccccggcagcatcttctgcaagcagctgctgttcagcctgctggtgctgaccctgctgtgcgacgcctgccagaaggtgtacctgagagtgcccagccacctgcaggccgagaccctggtgggcaaggtgaacctggaggagtgcctgaagagcgccagcctgatcagaagcagcgaccccgccttcagaatcctggaggacggcagcatctacaccacccacgacctgatcctgagcagcgagagaaagagcttcagcatcttcctgagcgacggccagagaagagagcagcaggagatcaaggtggtgctgagcgccagagagaacaagagccccaagaagagacacaccaaggacaccgccctgaagagaagcaagagaagatgggcccccatccccgccagcctgatggagaacagcctgggccccttcccccagcacgtgcagcagatccagagcgacgccgcccagaactacaccatcttctacagcatcagcggccccggcgtggacaaggagcccttcaacctgttctacatcgagaaggacaccggcgacatcttctgcaccagaagcatcgacagagagaagtacgagcagttcgccctgtacggctacgccaccaccgccgacggctacgcccccgagtaccccctgcccctgatcatcaagatcgaggacgacaacgacaacgccccctacttcgagcacagagtgaccatcttcaccgtgcccgagaactgcagaagcggcaccagcgtgggcaaggtgaccgccaccgacctggacgagcccgacaccctgcacaccagactgaagtacaagatcctgcagcagatccccgaccaccccaagcacttcagcatccaccccgacaccggcgtgatcaccaccaccacccccttcctggacagagagaagtgcgacacctaccagctgatcatggaggtgagagacatgggcggccagcccttcggcctgttcaacaccggcaccatcaccatcagcctggaggacgagaacgacaacccccccagcttcaccgagaccagctacgtgaccgaggtggaggagaacagaatcgacgtggagatcctgagaatgaaggtgcaggaccaggacctgcccaacaccccccacagcaaggccgtgtacaagatcctgcagggcaacgagaacggcaacttcatcatcagcaccgaccccaacaccaacgagggcgtgctgtgcgtggtgaagcccctgaactacgaggtgaacagacaggtgatcctgcaggtgggcgtgatcaacgaggcccagttcagcaaggccgccagcagccagacccccaccatgtgcaccaccaccgtgaccgtgaagatcatcgacagcgacgagggccccgagtgccacccccccgtgaaggtgatccagagccaggacggcttccccgccggccaggagctgctgggctacaaggccctggaccccgagatcagcagcggcgagggcctgagataccagaagctgggcgacgaggacaactggttcgagatcaaccagcacaccggcgacctgagaaccctgaaggtgctggacagagagagcaagttcgtgaagaacaaccagtacaacatcagcgtggtggccgtggacgccgtgggcagaagctgcaccggcaccctggtggtgcacctggacgactacaacgaccacgccccccagatcgacaaggaggtgaccatctgccagaacaacgaggacttcgccgtgctgaagcccgtggaccccgacggccccgagaacggcccccccttccagttcttcctggacaacagcgccagcaagaactggaacatcgaggagaaggacggcaagaccgccatcctgagacagagacagaacctggactacaactactacagcgtgcccatccagatcaaggacagacacggcctggtggccacccacatgctgaccgtgagagtgtgcgactgcagcacccccagcgagtgcagaatgaaggacaagagcaccagagacgtgagacccaacgtgatcctgggcagatgggccatcctggccatggtgctgggcagcgtgctgctgctgtgcatcctgttcacctgcttctgcgtgaccgccaagagaaccgtgaagaagtgcttccccgaggacatcgcccagcagaacctgatcgtgagcaacaccgagggccccggcgaggaggtgaccgaggccaacatcagactgcccatgcagaccagcaacatctgcgacaccagcatgagcgtgggcaccgtgggcggccagggcatcaagacccagcagagcttcgagatggtgaagggcggctacaccctggacagcaacaagggcggcggccaccagaccctggagagcgtgaagggcgtgggccagggcgacaccggcagatacgcctacaccgactggcagagcttcacccagcccagactgggcgagaaggtgtacctgtgcggccaggacgaggagcacaagcactgcgaggactacgtgtgcagctacaactacgagggcaagggcagcctggccggcagcgtgggctgctgcagcgacagacaggaggaggagggcctggagttcctggaccacctggagcccaagttcagaaccctggccaagacctgcatcaagaagtag

SEQ ID NO: 79062 - DNA, 2691 bp, Artificial Sequence
  Description of Artificial Sequence: Synthetic coding sequence
atggccgccgccggccccagaagaagcgtgagaggcgccgtgtgcctgcacctgctgctgaccctggtgatcttcagcagagccggcgaggcctgcaagaaggtgatcctgaacgtgcccagcaagctggaggccgacaagatcatcggcagagtgaacctggaggagtgcttcagaagcgccgacctgatcagaagcagcgaccccgacttcagagtgctgaacgacggcagcgtgtacaccgccagagccgtggccctgagcgacaagaagagaagcttcaccatctggctgagcgacaagagaaagcagacccagaaggaggtgaccgtgctgctggagcaccagaagaaggtgagcaagaccagacacaccagagagaccgtgctgagaagagccaagagaagatgggcccccatcccctgcagcatgcaggagaacagcctgggccccttccccctgttcctgcagcaggtggagagcgacgccgcccagaactacaccgtgttctacagcatcagcggcagaggcgtggacaaggagcccctgaacctgttctacatcgagagagacaccggcaacctgttctgcaccagacccgtggacagagaggagtacgacgtgttcgacctgatcgcctacgccagcaccgccgacggctacagcgccgacctgcccctgcccctgcccatcagagtggaggacgagaacgacaaccaccccgtgttcaccgaggccatctacaacttcgaggtgctggagagcagcagacccggcaccaccgtgggcgtggtgtgcgccaccgacagagacgagcccgacaccatgcacaccagactgaagtacagcatcctgcagcagacccccagaagccccggcctgttcagcgtgcaccccagcaccggcgtgatcaccaccgtgagccactacctggacagagaggtggtggacaagtacagcctgatcatgaaggtgcaggacatggacggccagttcttcggcctgatcggcaccagcacctgcatcatcaccgtgaccgacagcaacgacaacgcccccaccttcagacagaacgcctacgaggccttcgtggaggagaacgccttcaacgtggagatcctgagaatccccatcgaggacaaggacctgatcaacaccgccaactggagagtgaacttcaccatcctgaagggcaacgagaacggccacttcaagatcagcaccgacaaggagaccaacgagggcgtgctgagcgtggtgaagcccctgaactacgaggagaacagacaggtgaacctggagatcggcgtgaacaacgaggcccccttcgccagagacatccccagagtgaccgccctgaacagagccctggtgaccgtgcacgtgagagacctggacgagggccccgagtgcacccccgccgcccagtacgtgagaatcaaggagaacctggccgtgggcagcaagatcaacggctacaaggcctacgaccccgagaacagaaacggcaacggcctgagatacaagaagctgcacgaccccaagggctggatcaccatcgacgagatcagcggcagcatcatcaccagcaagatcctggacagagaggtggagacccccaagaacgagctgtacaacatcaccgtgctggccatcgacaaggacgacagaagctgcaccggcaccctggccgtgaacatcgaggacgtgaacgacaacccccccgagatcctgcaggagtacgtggtgatctgcaagcccaagatgggctacaccgacatcctggccgtggaccccgacgagcccgtgcacggcgcccccttctacttcagcctgcccaacaccagccccgagatcagcagactgtggagcctgaccaaggtgaacgacaccgccgccagactgagctaccagaagaacgccggcttccaggagtacaccatccccatcaccgtgaaggacagagccggccaggccgccaccaagctgctgagagtgaacctgtgcgagtgcacccaccccacccagtgcagagccaccagcagaagcaccggcgtgatcctgggcaagtgggccatcctggccatcctgctgggcatcgccctgctgttcagcgtgctgctgaccctggtgtgcggcgtgttcggcgccaccaagggcaagagattccccgaggacctggcccagcagaacctgatcatcagcaacaccgaggcccccggcgacgacagagtgtgcagcgccaacggcttcatgacccagaccaccaacaacagcagccagggcttctgcggcaccatgggcagcggcatgaagaacggcggccaggagaccatcgagatgatgaagggcggcaaccagaccctggagagctgcagaggcgccggccaccaccacaccctggacagctgcagaggcggccacaccgaggtggacaactgcagatacacctacagcgagtggcacagcttcacccagcccagactgggcgagaagctgcacagatgcaaccagaacgaggacagaatgcccagccaggactacgtgctgacctacaactacgagggcagaggcagccccgccggcagcgtgggctgctgcagcgagaagcaggaggaggacggcctggacttcctgaacaacctggagcccaagttcatcaccctggccgaggcctgcaccaagagatag

SEQ ID NO: 79063 - DNA, 2520 bp, Artificial Sequence
  Description of Artificial Sequence: Synthetic coding sequence
atggccgccgccggccccagaagaagcgtgagaggcgccgtgtgcctgcacctgctgctgaccctggtgatcttcagcagagccggcgaggcctgcaagaaggtgatcctgaacgtgcccagcaagctggaggccgacaagatcatcggcagagtgaacctggaggagtgcttcagaagcgccgacctgatcagaagcagcgaccccgacttcagagtgctgaacgacggcagcgtgtacaccgccagagccgtggccctgagcgacaagaagagaagcttcaccatctggctgagcgacaagagaaagcagacccagaaggaggtgaccgtgctgctggagcaccagaagaaggtgagcaagaccagacacaccagagagaccgtgctgagaagagccaagagaagatgggcccccatcccctgcagcatgcaggagaacagcctgggccccttccccctgttcctgcagcaggtggagagcgacgccgcccagaactacaccgtgttctacagcatcagcggcagaggcgtggacaaggagcccctgaacctgttctacatcgagagagacaccggcaacctgttctgcaccagacccgtggacagagaggagtacgacgtgttcgacctgatcgcctacgccagcaccgccgacggctacagcgccgacctgcccctgcccctgcccatcagagtggaggacgagaacgacaaccaccccgtgttcaccgaggccatctacaacttcgaggtgctggagagcagcagacccggcaccaccgtgggcgtggtgtgcgccaccgacagagacgagcccgacaccatgcacaccagactgaagtacagcatcctgcagcagacccccagaagccccggcctgttcagcgtgcaccccagcaccggcgtgatcaccaccgtgagccactacctggacagagaggtggtggacaagtacagcctgatcatgaaggtgcaggacatggacggccagttcttcggcctgatcggcaccagcacctgcatcatcaccgtgaccgacagcaacgacaacgcccccaccttcagacagaacgcctacgaggccttcgtggaggagaacgccttcaacgtggagatcctgagaatccccatcgaggacaaggacctgatcaacaccgccaactggagagtgaacttcaccatcctgaagggcaacgagaacggccacttcaagatcagcaccgacaaggagaccaacgagggcgtgctgagcgtggtgaagcccctgaactacgaggagaacagacaggtgaacctggagatcggcgtgaacaacgaggcccccttcgccagagacatccccagagtgaccgccctgaacagagccctggtgaccgtgcacgtgagagacctggacgagggccccgagtgcacccccgccgcccagtacgtgagaatcaaggagaacctggccgtgggcagcaagatcaacggctacaaggcctacgaccccgagaacagaaacggcaacggcctgagatacaagaagctgcacgaccccaagggctggatcaccatcgacgagatcagcggcagcatcatcaccagcaagatcctggacagagaggtggagacccccaagaacgagctgtacaacatcaccgtgctggccatcgacaaggacgacagaagctgcaccggcaccctggccgtgaacatcgaggacgtgaacgacaacccccccgagatcctgcaggagtacgtggtgatctgcaagcccaagatgggctacaccgacatcctggccgtggaccccgacgagcccgtgcacggcgcccccttctacttcagcctgcccaacaccagccccgagatcagcagactgtggagcctgaccaaggtgaacgacaccgccgccagactgagctaccagaagaacgccggcttccaggagtacaccatccccatcaccgtgaaggacagagccggccaggccgccaccaagctgctgagagtgaacctgtgcgagtgcacccaccccacccagtgcagagccaccagcagaagcaccggcgtgatcctgggcaagtgggccatcctggccatcctgctgggcatcgccctgctgttcagcgtgctgctgaccctggtgtgcggcgtgttcggcgccaccaagggcaagagattccccgaggacctggcccagcagaacctgatcatcagcaacaccgaggcccccggcgacgacagagtgtgcagcgccaacggcttcatgacccagaccaccaacaacagcagccagggcttctgcggcaccatgggcagcggcatgaagaacggcggccaggagaccatcgagatgatgaagggcggcaaccagaccctggagagctgcagaggcgccggccaccaccacaccctggacagctgcagaggcggccacaccgaggtggacaactgcagatacacctacagcgagtggcacagcttcacccagcccagactgggcgaggagagcatcagaggccacaccggctag

SEQ ID NO: 79064 - DNA, 3150 bp, Artificial Sequence
  Description of Artificial Sequence: Synthetic coding sequence
atggactggagcttcttcagagtggtggccatgctgttcatcttcctggtggtggtggaggtgaacagcgagttcagaatccaggtgagagactacaacaccaagaacggcaccatcaagtggcacagcatcagaagacagaagagagagtggatcaagttcgccgccgcctgcagagagggcgaggacaacagcaagagaaaccccatcgccaagatccacagcgactgcgccgccaaccagcaggtgacctacagaatcagcggcgtgggcatcgaccagcccccctacggcatcttcgtgatcaaccagaagaccggcgagatcaacatcaccagcatcgtggacagagaggtgacccccttcttcatcatctactgcagagccctgaacagcatgggccaggacctggagagacccctggagctgagagtgagagtgctggacatcaacgacaacccccccgtgttcagcatggccaccttcgccggccagatcgaggagaacagcaacgccaacaccctggtgatgatcctgaacgccaccgacgccgacgagcccaacaacctgaacagcaagatcgccttcaagatcatcagacaggagcccagcgacagccccatgttcatcatcaacagaaacaccggcgagatcagaaccatgaacaacttcctggacagagagcagtacggccagtacgccctggccgtgagaggcagcgacagagacggcggcgccgacggcatgagcgccgagtgcgagtgcaacatcaagatcctggacgtgaacgacaacatcccctacatggagcagagcagctacaccatcgagatccaggagaacaccctgaacagcaacctgctggagatcagagtgatcgacctggacgaggagttcagcgccaactggatggccgtgatcttcttcatcagcggcaacgagggcaactggttcgagatcgagatgaacgagagaaccaacgtgggcatcctgaaggtggtgaagcccctggactacgaggccatgcagagcctgcagctgagcatcggcgtgagaaacaaggccgagttccaccacagcatcatgagccagtacaagctgaaggccagcgccatcagcgtgaccgtgctgaacgtgatcgagggccccgtgttcagacccggcagcaagacctacgtggtgaccggcaacatgggcagcaacgacaaggtgggcgacttcgtggccaccgacctggacaccggcagacccagcaccaccgtgagatacgtgatgggcaacaaccccgccgacctgctggccgtggacagcagaaccggcaagctgaccctgaagaacaaggtgaccaaggagcagtacaacatgctgggcggcaagtaccagggcaccatcctgagcatcgacgacaacctgcagagaacctgcaccggcaccatcaacatcaacatccagagcttcggcaacgacgacagaaccaacaccgagcccaacaccaagatcaccaccaacaccggcagacaggagagcaccagcagcaccaactacgacaccagcaccaccagcaccgacagcagccaggtgtacagcagcgagcccggcaacggcgccaaggacctgctgagcgacaacgtgcacttcggccccgccggcatcggcctgctgatcatgggcttcctggtgctgggcctggtgcccttcctgatgatctgctgcgactgcggcggcgcccccagaagcgccgccggcttcgagcccgtgcccgagtgcagcgacggcgccatccacagctgggccgtggagggcccccagcccgagcccagagacatcaccaccgtgatcccccagatcccccccgacaacgccaacatcatcgagtgcatcgacaacagcggcgtgtacaccaacgagtacggcggcagagagatgcaggacctgggcggcggcgagagaatgaccggcttcgagctgaccgagggcgtgaagaccagcggcatgcccgagatctgccaggagtacagcggcaccctgagaagaaacagcatgagagagtgcagagagggcggcctgaacatgaacttcatggagagctacttctgccagaaggcctacgcctacgccgacgaggacgagggcagacccagcaacgactgcctgctgatctacgacatcgagggcgtgggcagccccgccggcagcgtgggctgctgcagcttcatcggcgaggacctggacgacagcttcctggacaccctgggccccaagttcaagaagctggccgacatcagcctgggcaaggagagctaccccgacctggaccccagctggcccccccagagcaccgagcccgtgtgcctgccccaggagaccgagcccgtggtgagcggccacccccccatcagcccccacttcggcaccaccaccgtgatcagcgagagcacctaccccagcggccccggcgtgctgcaccccaagcccatcctggaccccctgggctacggcaacgtgaccgtgaccgagagctacaccaccagcgacaccctgaagcccagcgtgcacgtgcacgacaacagacccgccagcaacgtggtggtgaccgagagagtggtgggccccatcagcggcgccgacctgcacggcatgctggagatgcccgacctgagagacggcagcaacgtgatcgtgaccgagagagtgatcgcccccagcagcagcctgcccaccagcctgaccatccaccaccccagagagagcagcaacgtggtggtgaccgagagagtgatccagcccaccagcggcatgatcggcagcctgagcatgcaccccgagctggccaacgcccacaacgtgatcgtgaccgagagagtggtgagcggcgccggcgtgaccggcatcagcggcaccaccggcatcagcggcggcatcggcagcagcggcctggtgggcaccagcatgggcgccggcagcggcgccctgagcggcgccggcatcagcggcggcggcatcggcctgagcagcctgggcggcaccgccagcatcggccacatgagaagcagcagcgaccaccacttcaaccagaccatcggcagcgccagccccagcaccgccagaagcagaatcaccaagtacagcaccgtgcagtacagcaagtag

SEQ ID NO: 79065 - DNA, 3357 bp, Artificial Sequence
  Description of Artificial Sequence: Synthetic coding sequence
atggccagaagccccggcagagcctacgccctgctgctgctgctgatctgcttcaacgtgggcagcggcctgcacctgcaggtgctgagcaccagaaacgagaacaagctgctgcccaagcacccccacctggtgagacagaagagagcctggatcaccgcccccgtggccctgagagagggcgaggacctgagcaagaagaaccccatcgccaagatccacagcgacctggccgaggagagaggcctgaagatcacctacaagtacaccggcaagggcatcaccgagccccccttcggcatcttcgtgttcaacaaggacaccggcgagctgaacgtgaccagcatcctggacagagaggagacccccttcttcctgctgaccggctacgccctggacgccagaggcaacaacgtggagaagcccctggagctgagaatcaaggtgctggacatcaacgacaacgagcccgtgttcacccaggacgtgttcgtgggcagcgtggaggagctgagcgccgcccacaccctggtgatgaagatcaacgccaccgacgccgacgagcccaacaccctgaacagcaagatcagctacagaatcgtgagcctggagcccgcctacccccccgtgttctacctgaacaaggacaccggcgagatctacaccaccagcgtgaccctggacagagaggagcacagcagctacaccctgaccgtggaggccagagacggcaacggcgaggtgaccgacaagcccgtgaagcaggcccaggtgcagatcagaatcctggacgtgaacgacaacatccccgtggtggagaacaaggtgctggagggcatggtggaggagaaccaggtgaacgtggaggtgaccagaatcaaggtgttcgacgccgacgagatcggcagcgacaactggctggccaacttcaccttcgccagcggcaacgagggcggctacttccacatcgagaccgacgcccagaccaacgagggcatcgtgaccctgatcaaggaggtggactacgaggagatgaagaacctggacttcagcgtgatcgtggccaacaaggccgccttccacaagagcatcagaagcaagtacaagcccacccccatccccatcaaggtgaaggtgaagaacgtgaaggagggcatccacttcaagagcagcgtgatcagcatctacgtgagcgagagcatggacagaagcagcaagggccagatcatcggcaacttccaggccttcgacgaggacaccggcctgcccgcccacgccagatacgtgaagctggaggacagagacaactggatcagcgtggacagcgtgaccagcgagatcaagctggccaagctgcccgacttcgagagcagatacgtgcagaacggcacctacaccgtgaagatcgtggccatcagcgaggactaccccagaaagaccatcaccggcaccgtgctgatcaacgtggaggacatcaacgacaactgccccaccctgatcgagcccgtgcagaccatctgccacgacgccgagtacgtgaacgtgaccgccgaggacctggacggccaccccaacagcggccccttcagcttcagcgtgatcgacaagccccccggcatggccgagaagtggaagatcgccagacaggagagcaccagcgtgctgctgcagcagagcgagaagaagctgggcagaagcgagatccagttcctgatcagcgacaaccagggcttcagctgccccgagaagcaggtgctgaccctgaccgtgtgcgagtgcctgcacggcagcggctgcagagaggcccagcacgacagctacgtgggcctgggccccgccgccatcgccctgatgatcctggccttcctgctgctgctgctggtgcccctgctgctgctgatgtgccactgcggcaagggcgccaagggcttcacccccatccccggcaccatcgagatgctgcacccctggaacaacgagggcgccccccccgaggacaaggtggtgcccagcttcctgcccgtggaccagggcggcagcctggtgggcagaaacggcgtgggcggcatggccaaggaggccaccatgaagggcagcagcagcgccagcatcgtgaagggccagcacgagatgagcgagatggacggcagatgggaggagcacagaagcctgctgagcggcagagccacccagttcaccggcgccaccggcgccatcatgaccaccgagaccaccaagaccgccagagccaccggcgccagcagagacatggccggcgcccaggccgccgccgtggccctgaacgaggagttcctgagaaactacttcaccgacaaggccgccagctacaccgaggaggacgagaaccacaccgccaaggactgcctgctggtgtacagccaggaggagaccgagagcctgaacgccagcatcggctgctgcagcttcatcgagggcgagctggacgacagattcctggacgacctgggcctgaagttcaagaccctggccgaggtgtgcctgggccagaagatcgacatcaacaaggagatcgagcagagacagaagcccgccaccgagaccagcatgaacaccgccagccacagcctgtgcgagcagaccatggtgaacagcgagaacacctacagcagcggcagcagcttccccgtgcccaagagcctgcaggaggccaacgccgagaaggtgacccaggagatcgtgaccgagagaagcgtgagcagcagacaggcccagaaggtggccacccccctgcccgaccccatggccagcagaaacgtgatcgccaccgagaccagctacgtgaccggcagcaccatgccccccaccaccgtgatcctgggccccagccagccccagagcctgatcgtgaccgagagagtgtacgcccccgccagcaccctggtggaccagccctacgccaacgagggcaccgtggtggtgaccgagagagtgatccagccccacggcggcggcagcaaccccctggagggcacccagcacctgcaggacgtgccctacgtgatggtgagagagagagagagcttcctggcccccagcagcggcgtgcagcccaccctggccatgcccaacatcgccgtgggccagaacgtgaccgtgaccgagagagtgctggcccccgccagcaccctgcagagcagctaccagatccccaccgagaacagcatgaccgccagaaacaccaccgtgagcggcgccggcgtgcccggccccctgcccgacttcggcctggaggagagcggccacagcaacagcaccatcaccaccagcagcaccagagtgaccaagcacagcaccgtgcagcacagctacagctag

SEQ ID NO: 79066 - DNA, 3123 bp, Artificial Sequence
  Description of Artificial Sequence: Synthetic coding sequence
atggactggctgttcttcagaaacatctgcctgctgatcatcctgatggtggtgatggaggtgaacagcgagttcatcgtggaggtgaaggagttcgacatcgagaacggcaccaccaagtggcagaccgtgagaagacagaagagagagtggatcaagttcgccgccgcctgcagagagggcgaggacaacagcaagagaaaccccatcgccaagatcagaagcgactgcgagagcaaccagaagatcacctacagaatcagcggcgtgggcatcgacagacccccctacggcgtgttcaccatcaaccccagaaccggcgagatcaacatcaccagcgtggtggacagagagatcacccccctgttcctgatctactgcagagccctgaacagcagaggcgaggacctggagagacccctggagctgagagtgaaggtgatggacatcaacgacaacgcccccgtgttcagccagagcgtgtacaccgccagcatcgaggagaacagcgacgccaacaccctggtggtgaagctgtgcgccaccgacgccgacgaggagaaccacctgaacagcaagatcgcctacaagatcgtgagccaggagcccagcggcgcccccatgttcatcctgaacagatacaccggcgaggtgtgcaccatgagcagcttcctggacagagagcagcacagcatgtacaacctggtggtgagaggcagcgacagagacggcgccgccgacggcctgagcagcgagtgcgactgcagaatcaaggtgctggacgtgaacgacaacttccccaccctggagaagaccagctacagcgccagcatcgaggagaactgcctgagcagcgagctgatcagactgcaggccatcgacctggacgaggagggcaccgacaactggctggcccagtacctgatcctgagcggcaacgacggcaactggttcgacatccagaccgacccccagaccaacgagggcatcctgaaggtggtgaagatgctggactacgagcaggcccccaacatccagctgagcatcggcgtgaagaaccaggccgacttccactacagcgtggccagccagttccagatgcaccccacccccgtgagaatccaggtggtggacgtgagagagggccccgccttccaccccagcaccatggccttcagcgtgagagagggcatcaagggcagcagcctgctgaactacgtgctgggcacctacaccgccatcgacctggacaccggcaaccccgccaccgacgtgagatacatcatcggccacgacgccggcagctggctgaagatcgacagcagaaccggcgagatccagttcagcagagagttcgacaagaagagcaagtacatcatcaacggcatctacaccgccgagatcctggccatcgacgacggcagcggcaagaccgccaccggcaccatctgcatcgaggtgcccgacatcaacgactactgccccaacatcttccccgagagaagaaccatctgcatcgacagccccagcgtgctgatcagcgtgaacgagcacagctacggcagccccttcaccttctgcgtggtggacgagccccccggcatcgccgacatgtgggacgtgagaagcaccaacgccaccagcgccatcctgaccgccaagcaggtgctgagccccggcttctacgagatccccatcctggtgaaggacagctacaacagagcctgcgagctggcccagatggtgcagctgtacgcctgcgactgcgacgacaaccacatgtgcctggacagcggcgccgccggcatctacaccgaggacatcaccggcgacacctacggccccgtgaccgaggaccaggccggcgtgagcaacgtgggcctgggccccgccggcatcggcatgatggtgctgggcatcctgctgctgatcctggcccccctgctgctgctgctgtgctgctgcaagcagagacagcccgagggcctgggcaccagattcgcccccgtgcccgagggcggcgagggcgtgatgcagagctggagaatcgagggcgcccaccccgaggacagagacgtgagcaacatctgcgcccccatgaccgccagcaacacccaggacagaatggacagcagcgagatctacaccaacacctacgccgccggcggcaccgtggagggcggcgtgagcggcgtggagctgaacaccggcatgggcaccgccgtgggcctgatggccgccggcgccgccggcgccagcggcgccgccagaaagagaagcagcaccatgggcaccctgagagactacgccgacgccgacatcaacatggccttcctggacagctacttcagcgagaaggcctacgcctacgccgacgaggacgagggcagacccgccaacgactgcctgctgatctacgaccacgagggcgtgggcagccccgtgggcagcatcggctgctgcagctggatcgtggacgacctggacgagagctgcatggagaccctggaccccaagttcagaaccctggccgagatctgcctgaacaccgagatcgagcccttccccagccaccaggcctgcatccccatcagcaccgacctgcccctgctgggccccaactacttcgtgaacgagagcagcggcctgacccccagcgaggtggagttccaggaggagatggccgccagcgagcccgtggtgcacggcgacatcatcgtgaccgagacctacggcaacgccgacccctgcgtgcagcccaccaccatcatcttcgacccccagctggcccccaacgtggtggtgaccgaggccgtgatggcccccgtgtacgacatccagggcaacatctgcgtgcccgccgagctggccgactacaacaacgtgatctacgccgagagagtgctggccagccccggcgtgcccgacatgagcaacagcagcaccaccgagggctgcatgggccccgtgatgagcggcaacatcctggtgggccccgagatccaggtgatgcagatgatgagccccgacctgcccatcggccagaccgtgggcagcaccagccccatgaccagcagacacagagtgaccagatacagcaacatccactacacccagcagtag

SEQ ID NO: 79067 - DNA, 3180 bp, Artificial Sequence
  Description of Artificial Sequence: Synthetic coding sequence
atggactggctgttcttcagaaacatctgcctgctgatcatcctgatggtggtgatggaggtgaacagcgagttcatcgtggaggtgaaggagttcgacatcgagaacggcaccaccaagtggcagaccgtgagaagacagaagagagagtggatcaagttcgccgccgcctgcagagagggcgaggacaacagcaagagaaaccccatcgccaagatcagaagcgactgcgagagcaaccagaagatcacctacagaatcagcggcgtgggcatcgacagacccccctacggcgtgttcaccatcaaccccagaaccggcgagatcaacatcaccagcgtggtggacagagagatcacccccctgttcctgatctactgcagagccctgaacagcagaggcgaggacctggagagacccctggagctgagagtgaaggtgatggacatcaacgacaacgcccccgtgttcagccagagcgtgtacaccgccagcatcgaggagaacagcgacgccaacaccctggtggtgaagctgtgcgccaccgacgccgacgaggagaaccacctgaacagcaagatcgcctacaagatcgtgagccaggagcccagcggcgcccccatgttcatcctgaacagatacaccggcgaggtgtgcaccatgagcagcttcctggacagagagcagcacagcatgtacaacctggtggtgagaggcagcgacagagacggcgccgccgacggcctgagcagcgagtgcgactgcagaatcaaggtgctggacgtgaacgacaacttccccaccctggagaagaccagctacagcgccagcatcgaggagaactgcctgagcagcgagctgatcagactgcaggccatcgacctggacgaggagggcaccgacaactggctggcccagtacctgatcctgagcggcaacgacggcaactggttcgacatccagaccgacccccagaccaacgagggcatcctgaaggtggtgaagatgctggactacgagcaggcccccaacatccagctgagcatcggcgtgaagaaccaggccgacttccactacagcgtggccagccagttccagatgcaccccacccccgtgagaatccaggtggtggacgtgagagagggccccgccttccaccccagcaccatggccttcagcgtgagagagggcatcaagggcagcagcctgctgaactacgtgctgggcacctacaccgccatcgacctggacaccggcaaccccgccaccgacgtgagatacatcatcggccacgacgccggcagctggctgaagatcgacagcagaaccggcgagatccagttcagcagagagttcgacaagaagagcaagtacatcatcaacggcatctacaccgccgagatcctggccatcgacgacggcagcggcaagaccgccaccggcaccatctgcatcgaggtgcccgacatcaacgactactgccccaacatcttccccgagagaagaaccatctgcatcgacagccccagcgtgctgatcagcgtgaacgagcacagctacggcagccccttcaccttctgcgtggtggacgagccccccggcatcgccgacatgtgggacgtgagaagcaccaacgccaccagcgccatcctgaccgccaagcaggtgctgagccccggcttctacgagatccccatcctggtgaaggacagctacaacagagcctgcgagctggcccagatggtgcagctgtacgcctgcgactgcgacgacaaccacatgtgcctggacagcggcgccgccggcatctacaccgaggacatcaccggcgacacctacggccccgtgaccgaggaccaggccggcgtgagcaacgtgggcctgggccccgccggcatcggcatgatggtgctgggcatcctgctgctgatcctggcccccctgctgctgctgctgtgctgctgcaagcagagacagcccgagggcctgggcaccagattcgcccccgtgcccgagggcggcgagggcgtgatgcagagctggagaatcgagggcgcccaccccgaggacagactgttcagcgcctacgccctgcccggcggcggcggcaccgccgacggcggcggcagcgtgctgggcagatgcgccctgcaggccacccccgccctgctgaaccagcacccccccttcagcgagatctacaccaacacctacgccgccggcggcaccgtggagggcggcgtgagcggcgtggagctgaacaccggcatgggcaccgccgtgggcctgatggccgccggcgccgccggcgccagcggcgccgccagaaagagaagcagcaccatgggcaccctgagagactacgccgacgccgacatcaacatggccttcctggacagctacttcagcgagaaggcctacgcctacgccgacgaggacgagggcagacccgccaacgactgcctgctgatctacgaccacgagggcgtgggcagccccgtgggcagcatcggctgctgcagctggatcgtggacgacctggacgagagctgcatggagaccctggaccccaagttcagaaccctggccgagatctgcctgaacaccgagatcgagcccttccccagccaccaggcctgcatccccatcagcaccgacctgcccctgctgggccccaactacttcgtgaacgagagcagcggcctgacccccagcgaggtggagttccaggaggagatggccgccagcgagcccgtggtgcacggcgacatcatcgtgaccgagacctacggcaacgccgacccctgcgtgcagcccaccaccatcatcttcgacccccagctggcccccaacgtggtggtgaccgaggccgtgatggcccccgtgtacgacatccagggcaacatctgcgtgcccgccgagctggccgactacaacaacgtgatctacgccgagagagtgctggccagccccggcgtgcccgacatgagcaacagcagcaccaccgagggctgcatgggccccgtgatgagcggcaacatcctggtgggccccgagatccaggtgatgcagatgatgagccccgacctgcccatcggccagaccgtgggcagcaccagccccatgaccagcagacacagagtgaccagatacagcaacatccactacacccagcagtag

SEQ ID NO: 79068 - DNA, 498 bp, Artificial Sequence
  Description of Artificial Sequence: Synthetic coding sequence
atggccagcggcgtgcaggtggccgacgaggtgtgcagaatcttctacgacatgaaggtgagaaagtgcagcacccccgaggagatcaagaagagaaagaaggccgtgatcttctgcctgagcgccgacaagaagtgcatcatcgtggaggagggcaaggagatcctggtgggcgacgtgggcgtgaccatcaccgaccccttcaagcacttcgtgggcatgctgcccgagaaggactgcagatacgccctgtacgacgccagcttcgagaccaaggagagcagaaaggaggagctgatgttcttcctgtgggcccccgagctggcccccctgaagagcaagatgatctacgccagcagcaaggacgccatcaagaagaagttccagggcatcaagcacgagtgccaggccaacggccccgaggacctgaacagagcctgcatcgccgagaagctgggcggcagcctgatcgtggccttcgagggctgccccgtgtag

SEQ ID NO: 79069 - DNA, 447 bp, Artificial Sequence
  Description of Artificial Sequence: Synthetic coding sequence
atgaaggtgagaaagtgcagcacccccgaggagatcaagaagagaaagaaggccgtgatcttctgcctgagcgccgacaagaagtgcatcatcgtggaggagggcaaggagatcctggtgggcgacgtgggcgtgaccatcaccgaccccttcaagcacttcgtgggcatgctgcccgagaaggactgcagatacgccctgtacgacgccagcttcgagaccaaggagagcagaaaggaggagctgatgttcttcctgtgggcccccgagctggcccccctgaagagcaagatgatctacgccagcagcaaggacgccatcaagaagaagttccagggcatcaagcacgagtgccaggccaacggccccgaggacctgaacagagcctgcatcgccgagaagctgggcggcagcctgatcgtggccttcgagggctgccccgtgtag

SEQ ID NO: 79070 - DNA, 897 bp, Artificial Sequence
  Description of Artificial Sequence: Synthetic coding sequence
atgagcgacgccaacctggacagcagcaagaagaacttcctggagggcgaggtggacgacgaggagagcgtgatcctgaccctggtgcccgtgaaggacgacgccaacatggagcagatggagcccagcgtgagcagcaccagcgacgtgaagctggagaagcccaagaagtacaaccccggccacctgctgcagaccaacgagcagttcaccgccccccagaaggccagatgcaagatccccgccctgcccctgcccaccatcctgccccccatcaacaaggtgtgcagagacaccctgagagactggtgccagcagctgggcctgagcaccaacggcaagaagatcgaggtgtacctgagactgcacagacacgcctaccccgagcagagacaggacatgcccgagatgagccaggagaccagactgcagagatgcagcagaaagagaaaggccgtgaccaagagagccagactgcagagaagctacgagatgaacgagagagccgaggagaccaacaccgtggaggtgatcaccagcgcccccggcgccatgctggccagctgggccagaatcgccgccagagccgtgcagcccaaggccctgaacagctgcagcatccccgtgagcgtggaggccttcctgatgcaggccagcggcgtgagatggtgcgtggtgcacggcagactgctgagcgccgacaccaagggctgggtgagactgcagttccacgccggccaggcctgggtgcccaccacccacagaagaatgatcagcctgttcctgctgcccgcctgcatcttccccagccccggcatcgaggacaacatgctgtgccccgactgcgccaagagaaacaagaagatgatgaagagactgatgaccgtggagaagtag

SEQ ID NO: 79071 - DNA, 480 bp, Artificial Sequence
  Description of Artificial Sequence: Synthetic coding sequence
atggaccccagccagttcaaccccacctacatccccggcagcccccagatgctgaccgaggagaacagcagagacgacagcggcgccagccagatcagcagcgagaccctgatcaagaacctgagcaacctgaccatcaacgccagcagcgagagcgtgagccccctgagcgaggccctgctgagaagagagagcgtgggcgccgccgtgctgagagagatcgaggacgagtggctgtacagcagaagaggcgtgagaaccctgctgagcgtgcagagagagaagatggccagactgagatacatgctgctgggcggcgtgagaacccacgagagaagacccaccaacaaggagcccaagggcgtgaagaaggagagcagacccttcaagtgcccctgcagcttctgcgtgagcaacggctgggaccccagcgagaacgccagaatcggcaaccaggacaccaagcccctgcagccctag

SEQ ID NO: 79072 - DNA, 915 bp, Artificial Sequence
  Description of Artificial Sequence: Synthetic coding sequence
atgctgagaggcagcgccagcagcaccagcatggagaaggccaagggcaaggagtggaccagcaccgagaagagcagagaggaggaccagcaggccagcaaccagcccaacagcatcgccctgcccggcaccagcgccaagagaaccaaggagaagatgagcatcaagggcagcaaggtgctgtgccccaagaagaaggccgagcacaccgacaaccccagaccccagaagaagatccccatcccccccctgcccagcaagctgccccccgtgaacctgatccacagagacatcctgagagcctggtgccagcagctgaagctgagcagcaagggccagaagctggacgcctacaagagactgtgcgccttcgcctaccccaaccagaaggacttccccagcaccgccaaggaggccaagatcagaaagagcctgcagaagaagctgaaggtggagaagggcgagaccagcctgcagagcagcgagacccacccccccgaggtggccctgccccccgtgggcgagccccccgccctggagaacagcaccgccctgctggagggcgtgaacaccgtggtggtgaccaccagcgcccccgaggccctgctggccagctgggccagaatcagcgccagagccagaacccccgaggccgtggagagcccccaggaggccagcggcgtgagatggtgcgtggtgcacggcaagagcctgcccgccgacaccgacggctgggtgcacctgcagttccacgccggccaggcctgggtgcccgagaagcaggagggcagagtgagcgccctgttcctgctgcccgccagcaacttcccccccccccacctggaggacaacatgctgtgccccaagtgcgtgcacagaaacaaggtgctgatcaagagcctgcagtgggagtag

SEQ ID NO: 79073 - DNA, 351 bp, Artificial Sequence
  Description of Artificial Sequence: Synthetic coding sequence
atgggcaccctgcccgccagaagacacatccccccctgggtgaaggtgcccgaggacctgaaggaccccgaggtgttccaggtgcagaccagactgctgaaggccatcttcggccccgacggcagcagaatcccctacatcgagcaggtgagcaaggccatgctggagctgaaggccctggagagcagcgacctgaccgaggtggtggtgtacggcagctacctgtacaagctgagaaccaagtggatgctgcagagcatggccgagtggcacagacagagacaggagagaggcatgctgaagctggccgaggccatgaacgccctggagctgggcccctggatgaagtag

SEQ ID NO: 79074 - DNA, 1104 bp, Artificial Sequence
  Description of Artificial Sequence: Synthetic coding sequence
atgagcagcaccctggccaagatcgccgagatcgaggccgagatggccagaacccagaagaacaaggccaccgcccaccacctgggcctgctgaaggccagactggccaagctgagaagagagctgatcacccccaagggcggcggcggcggcggccccggcgagggcttcgacgtggccaagaccggcgacgccagaatcggcttcgtgggcttccccagcgtgggcaagagcaccctgctgagcaacctggccggcgtgtacagcgaggtggccgcctacgagttcaccaccctgaccaccgtgcccggcgtgatcagatacaagggcgccaagatccagctgctggacctgcccggcatcatcgagggcgccaaggacggcaagggcagaggcagacaggtgatcgccgtggccagaacctgcaacctgatcctgatcgtgctggacgtgctgaagcccctgggccacaagaagatcatcgagaacgagctggagggcttcggcatcagactgaacagcaagccccccaacatcggcttcaagaagaaggacaagggcggcatcaacctgaccgccacctgcccccagagcgagctggacgccgagaccgtgaagagcatcctggccgagtacaagatccacaacgccgacgtgaccctgagaagcgacgccaccgccgacgacctgatcgacgtggtggagggcaacagagtgtacatcccctgcatctacgtgctgaacaagatcgaccagatcagcatcgaggagctggacatcatctacaaggtgccccactgcgtgcccatcagcgcccaccacagatggaacttcgacgacctgctggagaagatctgggactacctgaagctggtgagaatctacaccaagcccaagggccagctgcccgactacaccagccccgtggtgctgccctacagcagaaccaccgtggaggacttctgcatgaagatccacaagaacctgatcaaggagttcaagtacgccctggtgtggggcctgagcgtgaagcacaacccccagaaggtgggcaaggaccacaccctggaggacgaggacgtgatccagatcgtgaagaagtag

SEQ ID NO: 79075 - DNA, 396 bp, Artificial Sequence
  Description of Artificial Sequence: Synthetic coding sequence
atggccgccgccgtggccatggagaccgacgacgccggcaacagactgagattccagctggagctggagttcgtgcagtgcctggccaaccccaactacctgaacttcctggcccagagaggctacttcaaggacaaggccttcgtgaactacctgaagtacctgctgtactggaaggaccccgagtacgccaagtacctgaagtacccccagtgcctgcacatgctggagctgctgcagtacgagcacttcagaaaggagctggtgaacgcccagtgcgccaagttcatcgacgagcagcagatcctgcactggcagcactacagcagaaagagaatgagactgcagcaggccctggccgagcagcagcagcagaacaacaccagcggcaagtag

SEQ ID NO: 79076 - DNA, 1032 bp, Artificial Sequence
  Description of Artificial Sequence: Synthetic coding sequence
atgggcatcctggagaagatcagcgagatcgagaaggagatcgccagaacccagaagaacaaggccaccgagtaccacctgggcctgctgaaggccaagctggccaagtacagagcccagctgctggagcccagcaagagcgccagcagcaagggcgagggcttcgacgtgatgaagagcggcgacgccagagtggccctgatcggcttccccagcgtgggcaagagcaccttcctgagcctgatgaccagcaccgccagcgaggccgccagctacgagttcaccaccctgacctgcatccccggcgtgatcgagtacaagggcgccaacatccagctgctggacctgcccggcatcatcgagggcgccgcccagggcaagggcagaggcagacaggtgatcgccgtggccagaaccgccgacgtgatcatcatgatgctggacgccaccaagggcgaggtgcagagaagcctgctggagaaggagctggagagcgtgggcatcagactgaacaagcacaagcccaacatctacttcaagcccaagaagggcggcggcatcagcttcaacagcaccgtgaccctgacccagtgcagcgagaagctggtgcagctgatcctgcacgagtacaagatcttcaacgccgaggtgctgttcagagaggactgcagccccgacgagttcatcgacgtgatcgtgggcaacagagtgtacatgccctgcctgtacgtgtacaacaagatcgaccagatcagcatggaggaggtggacagactggccagaaagcccaacagcgtggtgatcagctgcggcatgaagctgaacctggactacctgctggagatgctgtgggagtacctggccctgacctgcatctacaccaagaagagaggccagagacccgacttcaccgacgccatcatcctgagaaagggcgccagcgtggagcacgtgtgccacagaatccacagaagcctggccagccagttcaaggcccccgcccccagcaccgtgagaagcggctgggcctag

SEQ ID NO: 79077 - DNA, 2037 bp, Artificial Sequence
  Description of Artificial Sequence: Synthetic coding sequence
atggagctgagaagctaccagtgggaggtgatcatgcccgccctggagggcaagaacatcatcatctggctgcccaccggcgccggcaagaccagagccgccgcctacgtggccaagagacacctggagaccgtggacggcgccaaggtggtggtgctggtgaacagagtgcacctggtgacccagcacggcgaggagttcagaagaatgctggacggcagatggaccgtgaccaccctgagcggcgacatgggccccagagccggcttcggccacctggccagatgccacgacctgctgatctgcaccgccgagctgctgcagatggccctgaccagccccgaggaggaggagcacgtggagctgaccgtgttcagcctgatcgtggtggacgagtgccaccacacccacaaggacaccgtgtacaacgtgatcatgagccagtacctggagctgaagctgcagagagcccagcccctgccccaggtgctgggcctgaccgccagccccggcaccggcggcgccagcaagctggacggcgccatcaaccacgtgctgcagctgtgcgccaacctggacacctggtgcatcatgagcccccagaactgctgcccccagctgcaggagcacagccagcagccctgcaagcagtacaacctgtgccacagaagaagccaggaccccttcggcgacctgctgaagaagctgatggaccagatccacgaccacctggagatgcccgagctgagcagaaagttcggcacccagatgtacgagcagcaggtggtgaagctgagcgaggccgccgccctggccggcctgcaggagcagagagtgtacgccctgcacctgagaagatacaacgacgccctgctgatccacgacaccgtgagagccgtggacgccctggccgccctgcaggacttctaccacagagagcacgtgaccaagacccagatcctgtgcgccgagagaagactgctggccctgttcgacgacagaaagaacgagctggcccacctggccacccacggccccgagaaccccaagctggagatgctggagaagatcctgcagagacagttcagcagcagcaacagccccagaggcatcatcttcaccagaaccagacagagcgcccacagcctgctgctgtggctgcagcagcagcagggcctgcagaccgtggacatcagagcccagctgctgatcggcgccggcaacagcagccagagcacccacatgacccagagagaccagcaggaggtgatccagaagttccaggacggcaccctgaacctgctggtggccaccagcgtggccgaggagggcctggacatcccccactgcaacgtggtggtgagatacggcctgctgaccaacgagatcagcatggtgcaggccagaggcagagccagagccgaccagagcgtgtacgccttcgtggccaccgagggcagcagagagctgaagagagagctgatcaacgaggccctggagaccctgatggagcaggccgtggccgccgtgcagaagatggaccaggccgagtaccaggccaagatcagagacctgcagcaggccgccctgaccaagagagccgcccaggccgcccagagagagaaccagagacagcagttccccgtggagcacgtgcagctgctgtgcatcaactgcatggtggccgtgggccacggcagcgacctgagaaaggtggagggcacccaccacgtgaacgtgaaccccaacttcagcaactactacaacgtgagcagagaccccgtggtgatcaacaaggtgttcaaggactggaagcccggcggcgtgatcagctgcagaaactgcggcgaggtgtggggcctgcagatgatctacaagagcgtgaagctgcccgtgctgaaggtgagaagcatgctgctggagaccccccagggcagaatccaggccaagaagtggagcagagtgcccttcagcgtgcccgacttcgacttcctgcagcactgcgccgagaacctgagcgacctgagcctggactag

SEQ ID NO: 79078 - DNA, 909 bp, Artificial Sequence
  Description of Artificial Sequence: Synthetic coding sequence
atggagctgagaagctaccagtgggaggtgatcatgcccgccctggagggcaagaacatcatcatctggctgcccaccggcgccggcaagaccagagccgccgcctacgtggccaagagacacctggagaccgtggacggcgccaaggtggtggtgctggtgaacagagtgcacctggtgacccagcacggcgaggagttcagaagaatgctggacggcagatggaccgtgaccaccctgagcggcgacatgggccccagagccggcttcggccacctggccagatgccacgacctgctgatctgcaccgccgagctgctgcagatggccctgaccagccccgaggaggaggagcacgtggagctgaccgtgttcagcctgatcgtggtggacgagtgccaccacacccacaaggacaccgtgtacaacgtgatcatgagccagtacctggagctgaagctgcagagagcccagcccctgccccaggtgctgggcctgaccgccagccccggcaccggcggcgccagcaagctggacggcgccatcaaccacgtgctgcagctgtgcgccaacctggacacctggtgcatcatgagcccccagaactgctgcccccagctgcaggagcacagccagcagccctgcaagcagtacaacctgtgccacagaagaagccaggaccccttcggcgacctgctgaagaagctgatggaccagatccacgaccacctggagatgcccgagctgagcagaaagttcggcacccagatgtacgagcagcaggtggtgaagctgagcgaggccgccgccctggccggcctgcaggagcagagagtgtacgccctgcacctgagaagatacaacgacgccctgctgatccacgacaccgtgagagccgtggacgcctag

SEQ ID NO: 79079 - DNA, 1464 bp, Artificial Sequence
  Description of Artificial Sequence: Synthetic coding sequence
atggagctgagaagctaccagtgggaggtgatcatgcccgccctggagggcaagaacatcatcatctggctgcccaccggcgccggcaagaccagagccgccgcctacgtggccaagagacacctggagaccgtggacggcgccaaggtggtggtgctggtgaacagagtgcacctggtgacccagcacggcgaggagttcagaagaatgctggacggcagatggaccgtgaccaccctgagcggcgacatgggccccagagccggcttcggccacctggccagatgccaccacacccacaaggacaccgtgtacaacgtgatcatgagccagtacctggagctgaagctgcagagagcccagcccctgccccaggtgctgggcctgaccgccagccccggcaccggcggcgccagcaagctggacggcgccatcaaccacgtgctgcagctgtgcgccaacctggacacctggtgcatcatgagcccccagaactgctgcccccagctgcaggagcacagccagcagccctgcaagcagtacaacctgtgccacagaagaagccaggaccccttcggcgacctgctgaagaagctgatggaccagatccacgaccacctggagatgcccgagctgagcagaaagttcggcacccagatgtacgagcagcaggtggtgaagctgagcgaggccgccgccctggccggcctgcaggagcagagagtgtacgccctgcacctgagaagatacaacgacgccctgctgatccacgacaccgtgagagccgtggacgccctggccgccctgcaggacttctaccacagagagcacgtgaccaagacccagatcctgtgcgccgagagaagactgctggccctgttcgacgacagaaagaacgagctggcccacctggccacccacggccccgagaaccccaagctggagatgctggagaagatcctgcagagacagttcagcagcagcaacagccccagaggcatcatcttcaccagaaccagacagagcgcccacagcctgctgctgtggctgcagcagcagcagggcctgcagaccgtggacatcagagcccagctgctgatcggcgccggcaacagcagccagagcacccacatgacccagagagaccagcaggaggtgatccagaagttccaggacggcaccctgaacctgctggtggccaccagcgtggccgaggagggcctggacatcccccactgcaacgtggtggtgagatacggcctgctgaccaacgagatcagcatggtgcaggccagaggcagagccagagccgaccagagcgtgtacgccttcgtggccaccgagggcagcagagagctgaagagagagctgatcaacgaggccctggagaccctgatggagcaggccgtggccgccgtgcagaagatggaccaggccgagtaccaggccaaggagctgctgtag

SEQ ID NO: 79080 - DNA, 471 bp, Artificial Sequence
  Description of Artificial Sequence: Synthetic coding sequence
atggagctgagaagctaccagtgggaggtgatcatgcccgccctggagggcaagaacatcatcatctggctgcccaccggcgccggcaagaccagagccgccgcctacgtggccaagagacacctggagaccgtggacggcgccaaggtggtggtgctggtgaacagagtgcacctggtgacccagcacggcgaggagttcagaagaatgctggacggcagatggaccgtgaccaccctgagcggcgacatgggccccagagccggcttcggccacctggccagatgccacgacctgctgatctgcaccgccgagctgctgcagatggccctgaccagccccgaggaggaggagcacgtggagctgaccgtgttcagcctgatcgtggtggacgagtgccaccacacccacaaggacaccgtgtacaacgtgatcatgagccagtacctggagctgaagctgcagagatag

SEQ ID NO: 79081 - DNA, 2208 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagggcgacgccatcggctacgagggcttccagcagttcctgaagatctacctggaggtggacaacgtgcccagacacctgagcctggccctgttccagagcttcgagaccggccactgcctgaacgagaccaacgtgaccaaggacgtggtgtgcctgaacgacgtgagctgctacttcagcctgctggagggcggcagacccgaggacaagctggagttcaccttcaagctgtacgacaccgacagaaacggcatcctggacagcagcgaggtggacaagatcatcctgcagatgatgagagtggccgagtacctggactgggacgtgagcgagctgagacccatcctgcaggagatgatgaaggagatcgactacgacggcagcggcagcgtgagccaggccgagtgggtgagagccggcgccaccaccgtgcccctgctggtgctgctgggcctggagatgaccctgaaggacgacggccagcacatgtggagacccaagagattccccagacccgtgtactgcaacctgtgcgagagcagcatcggcctgggcaagcagggcctgagctgcaacctgtgcaagtacaccgtgcacgaccagtgcgccatgaaggccctgccctgcgaggtgagcacctacgccaagagcagaaaggacatcggcgtgcagagccacgtgtgggtgagaggcggctgcgagagcggcagatgcgacagatgccagaagaagatcagaatctaccacagcctgaccggcctgcactgcgtgtggtgccacctggagatccacgacgactgcctgcaggccgtgggccacgagtgcgactgcggcctgctgagagaccacatcctgccccccagcagcatctaccccagcgtgctggccagcggccccgacagaaagaacagcaagaccagccagaagaccatggacgacctgaacctgagcaccagcgaggccctgagaatcgaccccgtgcccaacacccaccccctgctggtgttcgtgaaccccaagagcggcggcaagcagggccagagagtgctgtggaagttccagtacatcctgaaccccagacaggtgttcaacctgctgaaggacggccccgagatcggcctgagactgttcaaggacgtgcccgacagcagaatcctggtgtgcggcggcgacggcaccgtgggctggatcctggagaccatcgacaaggccaacctgcccgtgctgccccccgtggccgtgctgcccctgggcaccggcaacgacctggccagatgcctgagatggggcggcggctacgagggccagaacctggccaagatcctgaaggacctggagatgagcaaggtggtgcacatggacagatggagcgtggaggtgatcccccagcagaccgaggagaagagcgaccccgtgcccttccagatcatcaacaactacttcagcatcggcgtggacgccagcatcgcccacagattccacatcatgagagagaagtaccccgagaagttcaacagcagaatgaagaacaagctgtggtacttcgagttcgccaccagcgagagcatcttcagcacctgcaagaagctggaggagagcctgaccgtggagatctgcggcaagcccctggacctgagcaacctgagcctggagggcatcgccgtgctgaacatccccagcatgcacggcggcagcaacctgtggggcgacaccagaagaccccacggcgacatctacggcatcaaccaggccctgggcgccaccgccaaggtgatcaccgaccccgacatcctgaagacctgcgtgcccgacctgagcgacaagagactggaggtggtgggcctggagggcgccatcgagatgggccagatctacaccaagctgaagaacgccggcagaagactggccaagtgcagcgagatcaccttccacaccaccaagaccctgcccatgcagatcgacggcgagccctggatgcagaccccctgcaccatcaagatcacccacaagaaccagatgcccatgctgatgggccccccccccagaagcaccaacttcttcggcttcctgagctag

SEQ ID NO: 79082 - DNA, 2208 bp, Artificial Sequence; identical to SEQ ID NO: 79081
  Description of Artificial Sequence: Synthetic coding sequence

SEQ ID NO: 79083 - DNA, 744 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagggcgacgccatcggctacgagggcttccagcagttcctgaagatctacctggaggtggacaacgtgcccagacacctgagcctggccctgttccagagcttcgagaccggccactgcctgaacgagaccaacgtgaccaaggacgtggtgtgcctgaacgacgtgagctgctacttcagcctgctggagggcggcagacccgaggacaagctggagttcaccttcaagctgtacgacaccgacagaaacggcatcctggacagcagcgaggtggacaagatcatcctgcagatgatgagagtggccgagtacctggactgggacgtgagcgagctgagacccatcctgcaggagatgatgaaggagatcgactacgacggcagcggcagcgtgagccaggccgagtgggtgagagccggcgccaccaccgtgcccctgctggtgctgctgggcctggagatgaccctgaaggacgacggccagcacatgtggagacccaagagattccccagacccgtgtactgcaacctgtgcgagagcagcatcggcctgggcaagcagggcctgagctgcaacagacccatcacctgcgtgggcgccagaagactgtag

SEQ ID NO: 79084 - DNA, 351 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagggcgacgccatcggctacgagggcttccagcagttcctgaagatctacctggaggtggacaacgtgcccagacacctgagcctggccctgttccagagcttcgagaccggccactgcctgaacgagaccaacgtgaccaaggacgtggtgtgcctgaacgacgtgagctgctacttcagcctgctggagggcggcagacccgaggacaagctggagtag

SEQ ID NO: 79085 - DNA, 177 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagggcgacgccatcggctacgagggcttccagcagttcctgaagtag

SEQ ID NO: 79086 - DNA, 66 bp, Artificial Sequence
  Description of Artificial Sequence: Synthetic coding sequence
atggccaaggagagaggcctgatcagccccagcgacttcgcccagctgcagaagtacatggagtag

SEQ ID NO: 79087 - DNA, 444 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagggcgacgccatcggctacgagggcttccagcagttcctgaagatctacctggaggtggacaacgtgcccagacacctgagcctggccctgttccagagcttcgagaccggccactgcctgaacgagaccaacgtgaccaaggacgtggtgtgcctgaacgacgtgagctgctacttcagcctgctggagggcggcagacccgaggacaagctggagttcaccttcaagctgtacgacaccgacagaaacggcatcctggacagcagcgaggtggacaagatcatcctgcagatgatgagagtggccgagtag

SEQ ID NO: 79088 - DNA, 2208 bp, Artificial Sequence; identical to SEQ ID NO: 79081
  Description of Artificial Sequence: Synthetic coding sequence

SEQ ID NO: 79089 - DNA, 402 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagggcgacgccatcggctacgagggcttccagcagttcctgaagatctacctggaggtggacaacgtgcccagacacctgagcctggccctgttccagagcttcgagaccggccactgcctgaacgagaccaacgtgaccaaggacgtggtgtgcctgaacgacgtgagctgctacttcagcctgctggagggcggcagacccgaggacaagctggagttcaccttcaagctgtacgacaccgacagaaacggcatcctggacagcagctag

SEQ ID NO: 79090 - DNA, 324 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagggcgacgccatcggctacgagggcttccagcagttcctgaagatctacctggaggtggacaacgtgcccagacacctgagcctggccctgttccagagcttcgagaccggccactgcctgaacgagaccaacgtgaccaaggacgtggtgtgcctgaacgacgtgagctgctacttcagcctgctggagtag

SEQ ID NO: 79091 - DNA, 135 bp, Artificial Sequence
  Description of Artificial Sequence: Synthetic coding sequence
atggccaaggagagaggcctgatcagccccagcgacttcgcccagctgcagaagtacatggagtacagcaccaagaaggtgagcgacgtgctgaagctgttcgaggacggcgagatggccaagtacgtgcagtag

SEQ ID NO: 79092 - DNA, 135 bp, Artificial Sequence; identical to SEQ ID NO: 79091
  Description of Artificial Sequence: Synthetic coding sequence

SEQ ID NO: 79093 - DNA, 402 bp, Artificial Sequence; identical to SEQ ID NO: 79089
  Description of Artificial Sequence: Synthetic coding sequence

SEQ ID NO: 79094 - DNA, 135 bp, Artificial Sequence; identical to SEQ ID NO: 79091
  Description of Artificial Sequence: Synthetic coding sequence

SEQ ID NO: 79095 - DNA, 2415 bp, Artificial Sequence
  Description of Artificial Sequence: Synthetic coding sequence
atgaccaaccaggagaagtgggcccacctgagccccagcgagttcagccagctgcagaagtacgccgagtacagcaccaagaagctgaaggacgtgctggaggagttccacggcaacggcgtgctggccaagtacaaccccgagggcaagctggtggtgctgggcaacaccatcgacttcgagggcttcaagctgttcatgaagaccttcctggaggccgagctgcccgacgacttcaccgcccacctgttcatgagcttcagcaacaagttcccccacagcagccccatggtgaagagcaagcccgccctgctgagcggcggcctgagaatgaacaagggcgccatcaccccccccagaaccaccagccccgccaacacctgcagccccgaggtgatccacctgaaggacatcgtgtgctacctgagcctgctggagagaggcagacccgaggacaagctggagttcatgttcagactgtacgacaccgacggcaacggcttcctggacagcagcgagctggagaacatcatcagccagatgatgcacgtggccgagtacctggagtgggacgtgaccgagctgaaccccatcctgcacgagatgatggaggagatcgactacgaccacgacggcaccgtgagcctggaggagtggatccagggcggcatgaccaccatccccctgctggtgctgctgggcctggagaacaacgtgaaggacgacggccagcacgtgtggagactgaagcacttcaacaagcccgcctactgcaacctgtgcctgaacatgctgatcggcgtgggcaagcagggcctgtgctgcagcttctgcaagtacaccgtgcacgagagatgcgtggccagagccccccccagctgcatcaagacctacgtgaagagcaagagaaacaccgacgtgatgcaccactactgggtggagggcaactgccccaccaagtgcgacaagtgccacaagaccgtgaagtgctaccagggcctgaccggcctgcactgcgtgtggtgccagatcaccctgcacaacaagtgcgccagccacctgaagcccgagtgcgactgcggccccctgaaggaccacatcctgccccccaccaccatctgccccgtggtgctgcagaccctgcccaccagcggcgtgagcgtgcccgaggagagacagagcaccgtgaagaaggagaagagcggcagccagcagcccaacaaggtgatcgacaagaacaagatgcagagagccaacagcgtgaccgtggacggccagggcctgcaggtgacccccgtgcccggcacccaccccctgctggtgttcgtgaaccccaagagcggcggcaagcagggcgagagaatctacagaaagttccagtacctgctgaaccccagacaggtgtacagcctgagcggcaacggccccatgcccggcctgaacttcttcagagacgtgcccgacttcagagtgctggcctgcggcggcgacggcaccgtgggctgggtgctggactgcatcgagaaggccaacgtgggcaagcacccccccgtggccatcctgcccctgggcaccggcaacgacctggccagatgcctgagatggggcggcggctacgagggcgagaacctgatgaagatcctgaaggacatcgagaacagcaccgagatcatgctggacagatggaagttcgaggtgatccccaacgacaaggacgagaagggcgaccccgtgccctacagcatcatcaacaactacttcagcatcggcgtggacgccagcatcgcccacagattccacatcatgagagagaagcaccccgagaagttcaacagcagaatgaagaacaagttctggtacttcgagttcggcaccagcgagaccttcagcgccacctgcaagaagctgcacgagagcgtggagatcgagtgcgacggcgtgcagatcgacctgatcaacatcagcctggagggcatcgccatcctgaacatccccagcatgcacggcggcagcaacctgtggggcgagagcaagaagagaagaagccacagaagaatcgagaagaagggcagcgacaagagaaccaccgtgaccgacgccaaggagctgaagttcgccagccaggacctgagcgaccagctgctggaggtggtgggcctggagggcgccatggagatgggccagatctacaccggcctgaagagcgccggcagaagactggcccagtgcagctgcgtggtgatcagaaccagcaagagcctgcccatgcagatcgacggcgagccctggatgcagaccccctgcaccatcaagatcacccacaagaaccaggcccccatgctgatgggccccccccccaagaccggcctgttctgcagcctggtgaagagaaccagaaacagaagcaaggagtag

SEQ ID NO: 79096 - DNA, 2415 bp, Artificial Sequence
  Description of Artificial Sequence: Synthetic coding sequence
atgaccaaccaggagaagtgggcccacctgagccccagcgagttcagccagctgcagaagtacgccgagtacagcaccaagaagctgaaggacgtgctggaggagttccacggcaacggcgtgctggccaagtacaaccccgagggcaagcaggacatcctgaaccagaccatcgacttcgagggcttcaagctgttcatgaagaccttcctggaggccgagctgcccgacgacttcaccgcccacctgttcatgagcttcagcaacaagttcccccacagcagccccatggtgaagagcaagcccgccctgctgagcggcggcctgagaatgaacaagggcgccatcaccccccccagaaccaccagccccgccaacacctgcagccccgaggtgatccacctgaaggacatcgtgtgctacctgagcctgctggagagaggcagacccgaggacaagctggagttcatgttcagactgtacgacaccgacggcaacggcttcctggacagcagcgagctggagaacatcatcagccagatgatgcacgtggccgagtacctggagtgggacgtgaccgagctgaaccccatcctgcacgagatgatggaggagatcgactacgaccacgacggcaccgtgagcctggaggagtggatccagggcggcatgaccaccatccccctgctggtgctgctgggcctggagaacaacgtgaaggacgacggccagcacgtgtggagactgaagcacttcaacaagcccgcctactgcaacctgtgcctgaacatgctgatcggcgtgggcaagcagggcctgtgctgcagcttctgcaagtacaccgtgcacgagagatgcgtggccagagccccccccagctgcatcaagacctacgtgaagagcaagagaaacaccgacgtgatgcaccactactgggtggagggcaactgccccaccaagtgcgacaagtgccacaagaccgtgaagtgctaccagggcctgaccggcctgcactgcgtgtggtgccagatcaccctgcacaacaagtgcgccagccacctgaagcccgagtgcgactgcggccccctgaaggaccacatcctgccccccaccaccatctgccccgtggtgctgcagaccctgcccaccagcggcgtgagcgtgcccgaggagagacagagcaccgtgaagaaggagaagagcggcagccagcagcccaacaaggtgatcgacaagaacaagatgcagagagccaacagcgtgaccgtggacggccagggcctgcaggtgacccccgtgcccggcacccaccccctgctggtgttcgtgaaccccaagagcggcggcaagcagggcgagagaatctacagaaagttccagtacctgctgaaccccagacaggtgtacagcctgagcggcaacggccccatgcccggcctgaacttcttcagagacgtgcccgacttcagagtgctggcctgcggcggcgacggcaccgtgggctgggtgctggactgcatcgagaaggccaacgtgggcaagcacccccccgtggccatcctgcccctgggcaccggcaacgacctggccagatgcctgagatggggcggcggctacgagggcgagaacctgatgaagatcctgaaggacatcgagaacagcaccgagatcatgctggacagatggaagttcgaggtgatccccaacgacaaggacgagaagggcgaccccgtgccctacagcatcatcaacaactacttcagcatcggcgtggacgccagcatcgcccacagattccacatcatgagagagaagcaccccgagaagttcaacagcagaatgaagaacaagttctggtacttcgagttcggcaccagcgagaccttcagcgccacctgcaagaagctgcacgagagcgtggagatcgagtgcgacggcgtgcagatcgacctgatcaacatcagcctggagggcatcgccatcctgaacatccccagcatgcacggcggcagcaacctgtggggcgagagcaagaagagaagaagccacagaagaatcgagaagaagggcagcgacaagagaaccaccgtgaccgacgccaaggagctgaagttcgccagccaggacctgagcgaccagctgctggaggtggtgggcctggagggcgccatggagatgggccagatctacaccggcctgaagagcgccggcagaagactggcccagtgcagctgcgtggtgatcagaaccagcaagagcctgcccatgcagatcgacggcgagccctggatgcagaccccctgcaccatcaagatcacccacaagaaccaggcccccatgctgatgggccccccccccaagaccggcctgttctgcagcctggtgaagagaaccagaaacagaagcaaggagtag

SEQ ID NO: 79097 - DNA, 2412 bp, Artificial Sequence
  Description of Artificial Sequence: Synthetic coding sequence
atgaccaaccaggagaagtgggcccacctgagccccagcgagttcagccagctgcagaagtacgccgagtacagcaccaagaagctgaaggacgtgctggaggagttccacggcaacggcgtgctggccaagtacaaccccgagggcaagcaggacatcctgaaccagaccatcgacttcgagggcttcaagctgttcatgaagaccttcctggaggccgagctgcccgacgacttcaccgcccacctgttcatgagcttcagcaacaagttcccccacagcagccccatggtgaagagcaagcccgccctgctgagcggcggcctgagaatgaacaagggcgccatcaccccccccagaaccaccagccccgccaacacctgcagccccgaggtgatccacctgaaggacatcgtgtgctacctgagcctgctggagagaggcagacccgaggacaagctggagttcatgttcagactgtacgacaccgacggcaacggcttcctggacagcagcgagctggagaacatcatcagccagatgatgcacgtggccgagtacctggagtgggacgtgaccgagctgaaccccatcctgcacgagatgatggaggagatcgactacgaccacgacggcaccgtgagcctggaggagtggatccagggcggcatgaccaccatccccctgctggtgctgctgggcctggagaacaacgtgaaggacgacggccagcacgtgtggagactgaagcacttcaacaagcccgcctactgcaacctgtgcctgaacatgctgatcggcgtgggcaagcagggcctgtgctgcagcttctgcaagtacaccgtgcacgagagatgcgtggccagagccccccccagctgcatcaagacctacgtgaagagcaagagaaacaccgacgtgatgcaccactactgggtggagggcaactgccccaccaagtgcgacaagtgccacaagaccgtgaagtgctaccagggcctgaccggcctgcactgcgtgtggtgccagatcaccctgcacaacaagtgcgccagccacctgaagcccgagtgcgactgcggccccctgaaggaccacatcctgccccccaccaccatctgccccgtggtgctgaccctgcccaccagcggcgtgagcgtgcccgaggagagacagagcaccgtgaagaaggagaagagcggcagccagcagcccaacaaggtgatcgacaagaacaagatgcagagagccaacagcgtgaccgtggacggccagggcctgcaggtgacccccgtgcccggcacccaccccctgctggtgttcgtgaaccccaagagcggcggcaagcagggcgagagaatctacagaaagttccagtacctgctgaaccccagacaggtgtacagcctgagcggcaacggccccatgcccggcctgaacttcttcagagacgtgcccgacttcagagtgctggcctgcggcggcgacggcaccgtgggctgggtgctggactgcatcgagaaggccaacgtgggcaagcacccccccgtggccatcctgcccctgggcaccggcaacgacctggccagatgcctgagatggggcggcggctacgagggcgagaacctgatgaagatcctgaaggacatcgagaacagcaccgagatcatgctggacagatggaagttcgaggtgatccccaacgacaaggacgagaagggcgaccccgtgccctacagcatcatcaacaactacttcagcatcggcgtggacgccagcatcgcccacagattccacatcatgagagagaagcaccccgagaagttcaacagcagaatgaagaacaagttctggtacttcgagttcggcaccagcgagaccttcagcgccacctgcaagaagctgcacgagagcgtggagatcgagtgcgacggcgtgcagatcgacctgatcaacatcagcctggagggcatcgccatcctgaacatccccagcatgcacggcggcagcaacctgtggggcgagagcaagaagagaagaagccacagaagaatcgagaagaagggcagcgacaagagaaccaccgtgaccgacgccaaggagctgaagttcgccagccaggacctgagcgaccagctgctggaggtggtgggcctggagggcgccatggagatgggccagatctacaccggcctgaagagcgccggcagaagactggcccagtgcagctgcgtggtgatcagaaccagcaagagcctgcccatgcagatcgacggcgagccctggatgcagaccccctgcaccatcaagatcacccacaagaaccaggcccccatgctgatgggccccccccccaagaccggcctgttctgcagcctggtgaagagaaccagaaacagaagcaaggagtag

SEQ ID NO: 79098 - DNA, 2415 bp, Artificial Sequence; identical to SEQ ID NO: 79096
  Description of Artificial Sequence: Synthetic coding sequence

SEQ ID NO: 79099 - DNA, 2322 bp, Artificial Sequence
  Description of Artificial Sequence: Synthetic coding sequence
atgaccaaccaggagaagtgggcccacctgagccccagcgagttcagccagctgcagaagtacgccgagtacagcaccaagaagctgaaggacgtgctggaggagttccacggcaacggcgtgctggccaagtacaaccccgagggcaagcaggacatcctgaaccagaccatcgacttcgagggcttcaagctgttcatgaagaccttcctggaggccgagctgcccgacgacttcaccgcccacctgttcatgagcttcagcaacaagttcccccacagcagccccatggtgaagagcaagcccgccctgctgagcggcggcctgagaatgaacaagggcgccatcaccccccccagaaccaccagccccgccaacacctgcagccccgaggtgatccacctgaaggacatcgtgtgctacctgagcctgctggagagaggcagacccgaggacaagctggagttcatgttcagactgtacgacaccgacggcaacggcttcctggacagcagcgagctggagaacatcatcagccagatgatgcacgtggccgagtacctggagtgggacgtgaccgagctgaaccccatcctgcacgagatgatggaggagatcgactacgaccacgacggcaccgtgagcctggaggagtggatccagggcggcatgaccaccatccccctgctggtgctgctgggcctggagaacaacgtgaaggacgacggccagcacgtgtggagactgaagcacttcaacaagcccgcctactgcaacctgtgcctgaacatgctgatcggcgtgggcaagcagggcctgtgctgcagcttctgcaagtacaccgtgcacgagagatgcgtggccagagccccccccagctgcatcaagacctacgtgaagagcaagagaaacaccgacgtgatgcaccactactgggtggagggcaactgccccaccaagtgcgacaagtgccacaagaccgtgaagtgctaccagggcctgaccggcctgcactgcgtgtggtgccagatcaccctgcacaacaagtgcgccagccacctgaagcccgagtgcgactgcggccccctgaaggaccacatcctgccccccaccaccatctgccccgtggtgctgcagaccctgcccaccagcggcgtgagcgtgcccgaggagagacagagcaccgtgaagaaggagaagagcggcagccagcagcccaacaaggtgatcgacaagaacaagatgcagagagccaacagcgtgaccgtggacggccagggcctgcaggtgacccccgtgcccggcacccaccccctgctggtgttcgtgaaccccaagagcggcggcaagcagggcgagagaatctacagaaagttccagtacctgctgaaccccagacaggtgtacagcctgagcggcaacggccccatgcccggcctgaacttcttcagagacgtgcccgacttcagagtgctggcctgcggcggcgacggcaccgtgggctgggtgctggactgcatcgagaaggccaacgtgggcaagcacccccccgtggccatcctgcccctgggcaccggcaacgacctggccagatgcctgagatggggcggcggctacgagggcgagaacctgatgaagatcctgaaggacatcgagaacagcaccgagatcatgctggacagatggaagttcgaggtgatccccaacgacaaggacgagaagggcgaccccgtgccctacagcatcatcaacaactacttcagcatcggcgtggacgccagcatcgcccacagattccacatcatgagagagaagcaccccgagaagttcaacagcagaatgaagaacaagttctggtacttcgagttcggcaccagcgagaccttcagcgccacctgcaagaagctgcacgagagcgtggagatcgagtgcgacggcgtgcagatcgacctgatcaacatcagcctggagggcatcgccatcctgaacatccccagcatgcacggcggcagcaacctgtggggcgagagcaagaagagaagaagccacagaagaatcgagaagaagggcagcgacaagagaaccaccgtgaccgacgccaaggagctgaagttcgccagccaggacctgagcgaccagctgctggaggtggtgggcctggagggcgccatggagatgggccagatctacaccggcctgaagagcgccggcagaagactggcccagtgcagctgcgtggtgatcagaaccagcaagagcctgcccatgcagatcgacggcgagccctggatgcagaccccctgcaccgtgagcaccgagtag

SEQ ID NO: 79100 - DNA, 2391 bp, Artificial Sequence
  Description of Artificial Sequence: Synthetic coding sequence
atgaccaaccaggagaagtgggcccacctgagccccagcgagttcagccagctgcagaagtacgccgagtacagcaccaagaagctgaaggacgtgctggaggagttccacggcaacggcgtgctggccaagtacaaccccgagggcaccatcgacttcgagggcttcaagctgttcatgaagaccttcctggaggccgagctgcccgacgacttcaccgcccacctgttcatgagcttcagcaacaagttcccccacagcagccccatggtgaagagcaagcccgccctgctgagcggcggcctgagaatgaacaagggcgccatcaccccccccagaaccaccagccccgccaacacctgcagccccgaggtgatccacctgaaggacatcgtgtgctacctgagcctgctggagagaggcagacccgaggacaagctggagttcatgttcagactgtacgacaccgacggcaacggcttcctggacagcagcgagctggagaacatcatcagccagatgatgcacgtggccgagtacctggagtgggacgtgaccgagctgaaccccatcctgcacgagatgatggaggagatcgactacgaccacgacggcaccgtgagcctggaggagtggatccagggcggcatgaccaccatccccctgctggtgctgctgggcctggagaacaacgtgaaggacgacggccagcacgtgtggagactgaagcacttcaacaagcccgcctactgcaacctgtgcctgaacatgctgatcggcgtgggcaagcagggcctgtgctgcagcttctgcaagtacaccgtgcacgagagatgcgtggccagagccccccccagctgcatcaagacctacgtgaagagcaagagaaacaccgacgtgatgcaccactactgggtggagggcaactgccccaccaagtgcgacaagtgccacaagaccgtgaagtgctaccagggcctgaccggcctgcactgcgtgtggtgccagatcaccctgcacaacaagtgcgccagccacctgaagcccgagtgcgactgcggccccctgaaggaccacatcctgccccccaccaccatctgccccgtggtgctgaccctgcccaccagcggcgtgagcgtgcccgaggagagacagagcaccgtgaagaaggagaagagcggcagccagcagcccaacaaggtgatcgacaagaacaagatgcagagagccaacagcgtgaccgtggacggccagggcctgcaggtgacccccgtgcccggcacccaccccctgctggtgttcgtgaaccccaagagcggcggcaagcagggcgagagaatctacagaaagttccagtacctgctgaaccccagacaggtgtacagcctgagcggcaacggccccatgcccggcctgaacttcttcagagacgtgcccgacttcagagtgctggcctgcggcggcgacggcaccgtgggctgggtgctggactgcatcgagaaggccaacgtgggcaagcacccccccgtggccatcctgcccctgggcaccggcaacgacctggccagatgcctgagatggggcggcggctacgagggcgagaacctgatgaagatcctgaaggacatcgagaacagcaccgagatcatgctggacagatggaagttcgaggtgatccccaacgacaaggacgagaagggcgaccccgtgccctacagcatcatcaacaactacttcagcatcggcgtggacgccagcatcgcccacagattccacatcatgagagagaagcaccccgagaagttcaacagcagaatgaagaacaagttctggtacttcgagttcggcaccagcgagaccttcagcgccacctgcaagaagctgcacgagagcgtggagatcgagtgcgacggcgtgcagatcgacctgatcaacatcagcctggagggcatcgccatcctgaacatccccagcatgcacggcggcagcaacctgtggggcgagagcaagaagagaagaagccacagaagaatcgagaagaagggcagcgacaagagaaccaccgtgaccgacgccaaggagctgaagttcgccagccaggacctgagcgaccagctgctggaggtggtgggcctggagggcgccatggagatgggccagatctacaccggcctgaagagcgccggcagaagactggcccagtgcagctgcgtggtgatcagaaccagcaagagcctgcccatgcagatcgacggcgagccctggatgcagaccccctgcaccatcaagatcacccacaagaaccaggcccccatgctgatgggccccccccccaagaccggcctgttctgcagcctggtgaagagaaccagaaacagaagcaaggagtag

SEQ ID NO: 79101 - DNA, 228 bp, Artificial Sequence
  Description of Artificial Sequence: Synthetic coding sequence
atgaccaaccaggagaagtgggcccacctgagccccagcgagttcagccagctgcagaagtacgccgagtacagcaccaagaagctgaaggacgtgctggaggagttccacggcaacggcgtgctggccaagtacaaccccgagggcaagcaggacatcctgaaccagaccatcgacttcgagggcttcaagctgttcatgaagaccttcctggaggccgagctgtag

SEQ ID NO: 79102 - DNA, 2358 bp, Artificial Sequence
  Description of Artificial Sequence: Synthetic coding sequence
atgaccaaccaggagaagtgggcccacctgagccccagcgagttcagccagctgcagaagtacgccgagtacagcaccaagaagctgaaggacgtgctggaggagttccacggcaacggcgtgctggccaagtacaaccccgagggcaccatcgacttcgagggcttcaagctgttcatgaagaccttcctggaggccgagctgcccgacgacttcaccgcccacctgttcatgagcttcagcaacaagttcccccacagcagccccatggtgaagagcaagcccgccctgctgagcggcggcctgagaatgaacaagggcgccatcaccccccccagaaccaccagccccgccaacacctgcagccccgaggtgatccacctgaaggacatcgtgtgctacctgagcctgctggagagaggcagacccgaggacaagctggagttcatgttcagactgtacgacaccgacggcaacggcttcctggacagcagcgagctggagaacatcatcagccagatgatgcacgtggccgagtacctggagtgggacgtgaccgagctgaaccccatcctgcacgagatgatggaggagatcgactacgaccacgacggcaccgtgagcctggaggagtggatccagggcggcatgaccaccatccccctgctggtgctgctgggcctggagaacaacgtgaaggacgacggccagcacgtgtggagactgaagcacttcaacaagcccgcctactgcaacctgtgcctgaacatgctgatcggcgtgggcaagcagggcctgtgctgcagcttctgcaagtacaccgtgcacgagagatgcgtggccagagccccccccagctgcatcaagacctacgtgaagagcaagagaaacaccgacgtgatgcaccactactgggtggagggcaactgccccaccaagtgcgacaagtgccacaagaccgtgaagtgctaccagggcctgaccggcctgcactgcgtgtggtgccagatcaccctgcacaacaagtgcgccagccacctgaagcccgagtgcgactgcggccccctgaaggaccacatcctgccccccaccaccatctgccccgtggtgctggagagacagagcaccgtgaagaaggagaagagcggcagccagcagcccaacaaggtgatcgacaagaacaagatgcagagagccaacagcgtgaccgtggacggccagggcctgcaggtgacccccgtgcccggcacccaccccctgctggtgttcgtgaaccccaagagcggcggcaagcagggcgagagaatctacagaaagttccagtacctgctgaaccccagacaggtgtacagcctgagcggcaacggccccatgcccggcctgaacttcttcagagacgtgcccgacttcagagtgctggcctgcggcggcgacggcaccgtgggctgggtgctggactgcatcgagaaggccaacgtgggcaagcacccccccgtggccatcctgcccctgggcaccggcaacgacctggccagatgcctgagatggggcggcggctacgagggcgagaacctgatgaagatcctgaaggacatcgagaacagcaccgagatcatgctggacagatggaagttcgaggtgatccccaacgacaaggacgagaagggcgaccccgtgccctacagcatcatcaacaactacttcagcatcggcgtggacgccagcatcgcccacagattccacatcatgagagagaagcaccccgagaagttcaacagcagaatgaagaacaagttctggtacttcgagttcggcaccagcgagaccttcagcgccacctgcaagaagctgcacgagagcgtggagatcgagtgcgacggcgtgcagatcgacctgatcaacatcagcctggagggcatcgccatcctgaacatccccagcatgcacggcggcagcaacctgtggggcgagagcaagaagagaagaagccacagaagaatcgagaagaagggcagcgacaagagaaccaccgtgaccgacgccaaggagctgaagttcgccagccaggacctgagcgaccagctgctggaggtggtgggcctggagggcgccatggagatgggccagatctacaccggcctgaagagcgccggcagaagactggcccagtgcagctgcgtggtgatcagaaccagcaagagcctgcccatgcagatcgacggcgagccctggatgcagaccccctgcaccatcaagatcacccacaagaaccaggcccccatgctgatgggccccccccccaagaccggcctgttctgcagcctggtgaagagaaccagaaacagaagcaaggagtag

SEQ ID NO: 79103 - DNA, 3645 bp, Artificial Sequence
  Description of Artificial Sequence: Synthetic coding sequence
atggccgccgccgccggcgcccccccccccggccccccccagcccccccccccccccccccccgaggagagcagcgacagcgagcccgaggccgagcccggcagcccccagaagctgatcagaaaggtgagcaccagcggccagatcagacagaagaccatcatcaaggagggcatgctgaccaagcagaacaacagcttccagagaagcaagagaagatacttcaagctgagaggcagaaccctgtactacgccaagaccgccaagagcatcatcttcgacgaggtggacctgaccgacgccagcgtggccgagagcagcaccaagaacgtgaacaacagcttcaccgtgatcaccccctgcagaaagctgatcctgtgcgccgacaacagaaaggagatggaggactggatcgccgccctgaagaccgtgcagaacagagagcacttcgagcccacccagtacagcatggaccacttcagcggcatgcacaactggtacgcctgcagccacgccagacccacctactgcaacgtgtgcagagaggccctgagcggcgtgaccagccacggcctgagctgcgaggtgtgcaagttcaaggcccacaagagatgcgccgtgagagccaccaacaactgcaagtggaccaccctggccagcatcggcaaggacatcatcgaggacgccgacggcatcgccatgccccaccagtggctggagggcaacctgcccgtgagcgccaagtgcaccgtgtgcgacaagacctgcggcagcgtgctgagactgcaggactggagatgcctgtggtgcaaggccatggtgcacaccagctgcaaggagagcctgctgaccaagtgccccctgggcctgtgcaaggtgagcgtgatcccccccaccgccctgaacagcatcgacagcgacggcttctggaaggccagctgcccccccagctgcaccagccccctgctggtgttcgtgaacagcaagagcggcgacaaccagggcgtgaagttcctgagaagattcaagcagctgctgaaccccgcccaggtgttcgacctgatgaacggcggcccccacctgggcctgagactgttccagaagttcgacaccttcagaatcctggtgtgcggcggcgacggcagcgtgggctgggtgctgagcgagatcgacagcctgaacctgcacaagcagtgccagctgggcgtgctgcccctgggcaccggcaacgacctggccagagtgctgggctggggcagcgcctgcgacgacgacacccagctgccccagatcctggagaagctggagagagccagcaccaagatgctggacagatggagcgtgatggcctacgaggccaagctgcccagacaggccagcagcagcaccgtgaccgaggacttcagcgaggacagcgaggtgcagcagatcctgttctacgaggacagcgtggccgcccacctgagcaagatcctgaccagcgaccagcacagcgtggtgatcagcagcgccaaggtgctgtgcgagaccgtgaaggacttcgtggccagagtgggcaaggcctacgagaagaccaccgagagcagcgaggagagcgaggtgatggccaagaagtgcagcgtgctgaaggagaagctggacagcctgctgaagaccctggacgacgagagccaggccagcagcagcctgcccaaccccccccccaccatcgccgaggaggccgaggacggcgacggcagcggcagcatctgcggcagcaccggcgacagactggtggccagcgcctgccccgccagaccccagatcttcagacccagagagcagctgatgctgagagccaacagcctgaagaaggccatcagacagatcatcgagcacaccgagaaggccgtggacgagcagaacgcccagacccaggagcaggagggcttcgtgctgggcctgagcgagagcgaggagaagatggaccacagagtgtgcccccccctgagccacagcgagagcttcggcgtgcccaagggcagaagccagagaaaggtgagcaagagcccctgcgagaagctgatcagcaagggcagcctgagcctgggcagcagcgccagcctgcccccccagcccggcagcagagacggcctgcccgccctgaacaccaagatcctgtaccccaacgtgagagccggcatgagcggcagcctgcccggcggcagcgtgatcagcagactgctgatcaacgccgaccccttcaacagcgagcccgagaccctggagtactacaccgagaagtgcgtgatgaacaactacttcggcatcggcctggacgccaagatcagcctggacttcaacaacaagagagacgagcaccccgagaagtgcagaagcagaaccaagaacatgatgtggtacggcgtgctgggcaccaaggagctgctgcacagaacctacaagaacctggagcagaaggtgctgctggagtgcgacggcagacccatccccctgcccagcctgcagggcatcgccgtgctgaacatccccagctacgccggcggcaccaacttctggggcggcaccaaggaggacgacaccttcgccgcccccagcttcgacgacaagatcctggaggtggtggccgtgttcggcagcatgcagatggccgtgagcagagtgatcagactgcagcaccacagaatcgcccagtgcagaaccgtgaagatcagcatcctgggcgacgagggcgtgcccgtgcaggtggacggcgaggcctgggtgcagccccccggctacatcagaatcgtgcacaagaacagagcccagaccctgaccagagacagagccttcgagagcaccctgaagagctgggaggacaagcagaagtgcgagctgcccagaccccccagctgcagcctgcaccccgagatgctgagcgaggaggaggccacccagatggaccagttcggccaggccgccggcgtgctgatccacagcatcagagagatcgcccagagccacagagacatggagcaggagctggcccacgccgtgaacgccagcagcaagagcatggacagagtgtacggcaagcccagaaccaccgagggcctgaactgcagcttcgtgctggagatggtgaacaacttcagagccctgagaagcgagaccgagctgctgctgagcggcaagatggccctgcagctggaccccccccagaaggagcagctgggcagcgccctggccgagatggacagacagctgagaagactggccgacaccccctggctgtgccagagcgccgagcccggcgacgaggagagcgtgatgctggacctggccaagagaagcagaagcggcaagttcagactggtgaccaagttcaagaaggagaagaacaacaagaacaaggaggcccacagcagcctgggcgcccccgtgcacctgtggggcaccgaggaggtggccgcctggctggagcacctgagcctgtgcgagtacaaggacatcttcaccagacacgacatcagaggcagcgagctgctgcacctggagagaagagacctgaaggacctgggcgtgaccaaggtgggccacatgaagagaatcctgtgcggcatcaaggagctgagcagaagcgcccccgccgtggaggcctag

SEQ ID NO: 79104 - DNA, 3513 bp, Artificial Sequence
  Description of Artificial Sequence: Synthetic coding sequence
atgaacatgttcctgtacttccagaccatcatcaaggagggcatgctgaccaagcagaacaacagcttccagagaagcaagagaagatacttcaagctgagaggcagaaccctgtactacgccaagaccgccaagagcatcatcttcgacgaggtggacctgaccgacgccagcgtggccgagagcagcaccaagaacgtgaacaacagcttcaccgtgatcaccccctgcagaaagctgatcctgtgcgccgacaacagaaaggagatggaggactggatcgccgccctgaagaccgtgcagaacagagagcacttcgagcccacccagtacagcatggaccacttcagcggcatgcacaactggtacgcctgcagccacgccagacccacctactgcaacgtgtgcagagaggccctgagcggcgtgaccagccacggcctgagctgcgaggtgtgcaagttcaaggcccacaagagatgcgccgtgagagccaccaacaactgcaagtggaccaccctggccagcatcggcaaggacatcatcgaggacgccgacggcatcgccatgccccaccagtggctggagggcaacctgcccgtgagcgccaagtgcaccgtgtgcgacaagacctgcggcagcgtgctgagactgcaggactggagatgcctgtggtgcaaggccatggtgcacaccagctgcaaggagagcctgctgaccaagtgccccctgggcctgtgcaaggtgagcgtgatcccccccaccgccctgaacagcatcgacagcgacggcttctggaaggccagctgcccccccagctgcaccagccccctgctggtgttcgtgaacagcaagagcggcgacaaccagggcgtgaagttcctgagaagattcaagcagctgctgaaccccgcccaggtgttcgacctgatgaacggcggcccccacctgggcctgagactgttccagaagttcgacaccttcagaatcctggtgtgcggcggcgacggcagcgtgggctgggtgctgagcgagatcgacagcctgaacctgcacaagcagtgccagctgggcgtgctgcccctgggcaccggcaacgacctggccagagtgctgggctggggcagcgcctgcgacgacgacacccagctgccccagatcctggagaagctggagagagccagcaccaagatgctggacagatggagcgtgatggcctacgaggccaagctgcccagacaggccagcagcagcaccgtgaccgaggacttcagcgaggacagcgaggtgcagcagatcctgttctacgaggacagcgtggccgcccacctgagcaagatcctgaccagcgaccagcacagcgtggtgatcagcagcgccaaggtgctgtgcgagaccgtgaaggacttcgtggccagagtgggcaaggcctacgagaagaccaccgagagcagcgaggagagcgaggtgatggccaagaagtgcagcgtgctgaaggagaagctggacagcctgctgaagaccctggacgacgagagccaggccagcagcagcctgcccaaccccccccccaccatcgccgaggaggccgaggacggcgacggcagcggcagcatctgcggcagcaccggcgacagactggtggccagcgcctgccccgccagaccccagatcttcagacccagagagcagctgatgctgagagccaacagcctgaagaaggccatcagacagatcatcgagcacaccgagaaggccgtggacgagcagaacgcccagacccaggagcaggagggcttcgtgctgggcctgagcgagagcgaggagaagatggaccacagagtgtgcccccccctgagccacagcgagagcttcggcgtgcccaagggcagaagccagagaaaggtgagcaagagcccctgcgagaagctgatcagcaagggcagcctgagcctgggcagcagcgccagcctgcccccccagcccggcagcagagacggcctgcccgccctgaacaccaagatcctgtaccccaacgtgagagccggcatgagcggcagcctgcccggcggcagcgtgatcagcagactgctgatcaacgccgaccccttcaacagcgagcccgagaccctggagtactacaccgagaagtgcgtgatgaacaactacttcggcatcggcctggacgccaagatcagcctggacttcaacaacaagagagacgagcaccccgagaagtgcagaagcagaaccaagaacatgatgtggtacggcgtgctgggcaccaaggagctgctgcacagaacctacaagaacctggagcagaaggtgctgctggagtgcgacggcagacccatccccctgcccagcctgcagggcatcgccgtgctgaacatccccagctacgccggcggcaccaacttctggggcggcaccaaggaggacgacaccttcgccgcccccagcttcgacgacaagatcctggaggtggtggccgtgttcggcagcatgcagatggccgtgagcagagtgatcagactgcagcaccacagaatcgcccagtgcagaaccgtgaagatcagcatcctgggcgacgagggcgtgcccgtgcaggtggacggcgaggcctgggtgcagccccccggctacatcagaatcgtgcacaagaacagagcccagaccctgaccagagacagagccttcgagagcaccctgaagagctgggaggacaagcagaagtgcgagctgcccagaccccccagctgcagcctgcaccccgagatgctgagcgaggaggaggccacccagatggaccagttcggccaggccgccggcgtgctgatccacagcatcagagagatcgcccagagccacagagacatggagcaggagctggcccacgccgtgaacgccagcagcaagagcatggacagagtgtacggcaagcccagaaccaccgagggcctgaactgcagcttcgtgctggagatggtgaacaacttcagagccctgagaagcgagaccgagctgctgctgagcggcaagatggccctgcagctggaccccccccagaaggagcagctgggcagcgccctggccgagatggacagacagctgagaagactggccgacaccccctggctgtgccagagcgccgagcccggcgacgaggagagcgtgatgctggacctggccaagagaagcagaagcggcaagttcagactggtgaccaagttcaagaaggagaagaacaacaagaacaaggaggcccacagcagcctgggcgcccccgtgcacctgtggggcaccgaggaggtggccgcctggctggagcacctgagcctgtgcgagtacaaggacatcttcaccagacacgacatcagaggcagcgagctgctgcacctggagagaagagacctgaaggacctgggcgtgaccaaggtgggccacatgaagagaatcctgtgcggcatcaaggagctgagcagaagcgcccccgccgtggaggcctag

SEQ ID NO: 79105 - DNA, 1704 bp, Artificial Sequence
  Description of Artificial Sequence: Synthetic coding sequence
atggaggccgagagaagacccgcccccggcagccccagcgagggcctgttcgccgacggccacctgatcctgtggaccctgtgcagcgtgctgctgcccgtgttcatcaccttctggtgcagcctgcagagaagcagaagacagctgcacagaagagacatcttcagaaagagcaagcacggctggagagacaccgacctgttcagccagcccacctactgctgcgtgtgcgcccagcacatcctgcagggcgccttctgcgactgctgcggcctgagagtggacgagggctgcctgagaaaggccgacaagagattccagtgcaaggagatcatgctgaagaacgacaccaaggtgctggacgccatgccccaccactggatcagaggcaacgtgcccctgtgcagctactgcatggtgtgcaagcagcagtgcggctgccagcccaagctgtgcgactacagatgcatctggtgccagaagaccgtgcacgacgagtgcatgaagaacagcctgaagaacgagaagtgcgacttcggcgagttcaagaacctgatcatcccccccagctacctgaccagcatcaaccagatgagaaaggacaagaagaccgactacgaggtgctggccagcaagctgggcaagcagtggacccccctgatcatcctggccaacagcagaagcggcaccaacatgggcgagggcctgctgggcgagttcagaatcctgctgaaccccgtgcaggtgttcgacgtgaccaagaccccccccatcaaggccctgcagctgtgcaccctgctgccctactacagcgccagagtgctggtgtgcggcggcgacggcaccgtgggctgggtgctggacgccgtggacgacatgaagatcaagggccaggagaagtacatcccccaggtggccgtgctgcccctgggcaccggcaacgacctgagcaacaccctgggctggggcaccggctacgccggcgagatccccgtggcccaggtgctgagaaacgtgatggaggccgacggcatcaagctggacagatggaaggtgcaggtgaccaacaagggctactacaacctgagaaagcccaaggagttcaccatgaacaactacttcagcgtgggccccgacgccctgatggccctgaacttccacgcccacagagagaaggcccccagcctgttcagcagcagaatcctgaacaaggccgtgtacctgttctacggcaccaaggactgcctggtgcaggagtgcaaggacctgaacaagaaggtggagctggagctggacggcgagagagtggccctgcccagcctggagggcatcatcgtgctgaacatcggctactggggcggcggctgcagactgtgggagggcatgggcgacgagacctaccccctggccagacacgacgacggcctgctggaggtggtgggcgtgtacggcagcttccactgcgcccagatccaggtgaagctggccaaccccttcagaatcggccaggcccacaccgtgagactgatcctgaagtgcagcatgatgcccatgcaggtggacggcgagccctgggcccagggcccctgcaccgtgaccatcacccacaagacccacgccatgatgctgtacttcagcggcgagcagaccgacgacgacatcagcagcaccagcgaccaggaggacatcaaggccaccgagtag

SEQ ID NO: 79106 - DNA, 2376 bp, Artificial Sequence
  Description of Artificial Sequence: Synthetic coding sequence
atgggcgaggagagatgggtgagcctgacccccgaggagttcgaccagctgcagaagtacagcgagtacagcagcaagaagatcaaggacgccctgaccgagttcaacgagggcggcagcctgaagcagtacgacccccacgagcccatcagctacgacgtgttcaagctgttcatgagagcctacctggaggtggacctgccccagcccctgagcacccacctgttcctggccttcagccagaagcccagacacgagaccagcgaccaccccaccgagggcgccagcaacagcgaggccaacagcgccgacaccaacatccagaacgccgacaacgccaccaaggccgacgaggcctgcgcccccgacaccgagagcaacatggccgagaagcaggcccccgccgaggaccaggtggccgccacccccctggagccccccgtgcccagaagcagcagcagcgagagccccgtggtgtacctgaaggacgtggtgtgctacctgagcctgctggagaccggcagaccccaggacaagctggagttcatgttcagactgtacgacagcgacgagaacggcctgctggaccaggccgagatggactgcatcgtgaaccagatgctgcacatcgcccagtacctggagtgggaccccaccgagctgagacccatcctgaaggagatgctgcagggcatggactacgacagagacggcttcgtgagcctgcaggagtgggtgcacggcggcatgaccaccatccccctgctggtgctgctgggcatggacgacagcggcagcaagggcgacggcagacacgcctggaccatgaagcacttcaagaagcccacctactgcaacttctgccacatcatgctgatgggcgtgagaaagcagggcctgtgctgcacctactgcaagtacaccgtgcacgagagatgcgtgagcagaaacatccccggctgcgtgaagacctacagcaaggccaagagaagcggcgaggtgatgcagcacgcctgggtggagggcaacagcagcgtgaagtgcgacagatgccacaagagcatcaagtgctaccagagcgtgaccgccagacactgcgtgtggtgcagaatgaccttccacagaaagtgcgagctgagcaccctgtgcgacggcggcgagctgagagaccacatcctgctgcccaccagcatctgccccatcaccagagacagacccggcgagaagagcgacggctgcgtgagcgccaagggcgagctggtgatgcagtacaagatcatccccacccccggcacccaccccctgctggtgctggtgaaccccaagagcggcggcagacagggcgagagaatcctgagaaagttccactacctgctgaaccccaagcaggtgttcaacctggacaacggcggccccacccccggcctgaacttcttcagagacacccccgacttcagagtgctggcctgcggcggcgacggcaccgtgggctggatcctggactgcatcgacaaggccaacttcgccaagcacccccccgtggccgtgctgcccctgggcaccggcaacgacctggccagatgcctgagatggggcggcggctacgagggcggcagcctgaccaagatcctgaaggacatcgagcagagccccctggtgatgctggacagatggcacctggaggtgatccccagagaggaggtggagaacggcgaccaggtgccctacagcatcatgaacaactacttcagcatcggcgtggacgccagcatcgcccacagattccacgtgatgagagagaagcaccccgagaagttcaacagcagaatgaagaacaagctgtggtacttcgagttcggcaccagcgagaccttcgccgccacctgcaagaagctgcacgaccacatcgagctggagtgcgacggcgtgggcgtggacctgagcaacatcttcctggagggcatcgccatcctgaacatccccagcatgtacggcggcaccaacctgtggggcgagaacaagaagaacagagccgtgatcagagagagcagaaagggcgtgaccgaccccaaggagctgaagttctgcgtgcaggacctgagcgaccagctgctggaggtggtgggcctggagggcgccatggagatgggccagatctacaccggcctgaagagcgccggcagaagactggcccagtgcgccagcgtgaccatcagaaccaacaagctgctgcccatgcaggtggacggcgagccctggatgcagccctgctgcaccatcaagatcacccacaagaaccaggcccccatgatgatgggccccccccagaagagcagcttcttcagcctgagaagaaagagcagaagcaaggactag

SEQ ID NO: 79107 - DNA, 2301 bp, Artificial Sequence
  Description of Artificial Sequence: Synthetic coding sequence
atgggcgaggagagatgggtgagcctgacccccgaggagttcgaccagctgcagaagtacagcgagtacagcagcaagaagatcaaggacgccctgaccgagttcaacgagggcggcagcctgaagcagtacgacccccacgagcccatcagctacgacgtgttcaagctgttcatgagagcctacctggaggtggacctgccccagcccctgagcacccacctgttcctggccttcagccagaagcccagacacgagaccagcgaccaccccaccgagggcgccagcaacagcgaggccaacagcgccgacaccaacatccagaacgccgacaacgccaccaaggccgacgaggcctgcgcccccgacaccgagagcaacatggccgagaagcaggcccccgccgaggaccaggtggccgccacccccctggagccccccgtgcccagaagcagcagcagcgagagccccgtggtgtacctgaaggacgtggtgtgctacctgagcctgctggagaccggcagaccccaggacaagctggagttcatgttcagactgtacgacagcgacgagaacggcctgctggaccaggccgagatggactgcatcgtgaaccagatgctgcacatcgcccagtacctggagtgggaccccaccgagctgagacccatcctgaaggagatgctgcagggcatggactacgacagagacggcttcgtgagcctgcaggagtgggtgcacggcggcatgaccaccatccccctgctggtgctgctgggcatggacgacagcggcagcaagggcgacggcagacacgcctggaccatgaagcacttcaagaagcccacctactgcaacttctgccacatcatgctgatgggcgtgagaaagcagggcctgtgctgcacctactgcaagtacaccgtgcacgagagatgcgtgagcagaaacatccccggctgcgtgaagacctacagcaaggccaagagaagcggcgaggtgatgcagcacgcctgggtggagggcaacagcagcgtgaagtgcgacagatgccacaagagcatcaagtgctaccagagcgtgaccgccagacactgcgtgtggtgcagaatgaccttccacagaaagtgcgagctgagcaccctgtgcgacggcggcgagctgagagaccacatcctgctgcccaccagcatctgccccatcaccagagacagacccggcgagaagagcgacggctgcgtgagcgccaagggcgagctggtgatgcagtacaagatcatccccacccccggcacccaccccctgctggtgctggtgaaccccaagagcggcggcagacagggcgagagactgaacttcttcagagacacccccgacttcagagtgctggcctgcggcggcgacggcaccgtgggctggatcctggactgcatcgacaaggccaacttcgccaagcacccccccgtggccgtgctgcccctgggcaccggcaacgacctggccagatgcctgagatggggcggcggctacgagggcggcagcctgaccaagatcctgaaggacatcgagcagagccccctggtgatgctggacagatggcacctggaggtgatccccagagaggaggtggagaacggcgaccaggtgccctacagcatcatgaacaactacttcagcatcggcgtggacgccagcatcgcccacagattccacgtgatgagagagaagcaccccgagaagttcaacagcagaatgaagaacaagctgtggtacttcgagttcggcaccagcgagaccttcgccgccacctgcaagaagctgcacgaccacatcgagctggagtgcgacggcgtgggcgtggacctgagcaacatcttcctggagggcatcgccatcctgaacatccccagcatgtacggcggcaccaacctgtggggcgagaacaagaagaacagagccgtgatcagagagagcagaaagggcgtgaccgaccccaaggagctgaagttctgcgtgcaggacctgagcgaccagctgctggaggtggtgggcctggagggcgccatggagatgggccagatctacaccggcctgaagagcgccggcagaagactggcccagtgcgccagcgtgaccatcagaaccaacaagctgctgcccatgcaggtggacggcgagccctggatgcagccctgctgcaccatcaagatcacccacaagaaccaggcccccatgatgatgggccccccccagaagagcagcttcttcagcctgagaagaaagagcagaagcaaggactag

SEQ ID NO: 79108 - DNA, 2259 bp, Artificial Sequence
  Description of Artificial Sequence: Synthetic coding sequence
atgggcgaggagagatgggtgagcctgacccccgaggagttcgaccagctgcagaagtacagcgagtacagcagcaagaagatcaaggacgccctgaccgagttcaacgagggcggcagcctgaagcagtacgacccccacgagcccatcagctacgacgtgttcaagctgttcatgagagcctacctggaggtggacctgccccagcccctgagcacccacctgttcctggccttcagccagaagcccagacacgagaccagcgaccaccccaccgagggcgccagcaacagcgaggccaacagcgccgacaccaacatccagaacgccgacaacgccaccaaggccgacgaggcctgcgcccccgacaccgagagcaacatggccgagaagcaggcccccgccgaggaccaggtggccgccacccccctggagccccccgtgcccagaagcagcagcagcgagagccccgtggtgtacctgaaggacgtggtgtgctacctgagcctgctggagaccggcagaccccaggacaagctggagttcatgttcagactgtacgacagcgacgagaacggcctgctggaccaggccgagatggactgcatcgtgaaccagatgctgcacatcgcccagtacctggagtgggaccccaccgagctgagacccatcctgaaggagatgctgcagggcatggactacgacagagacggcttcgtgagcctgcaggagtgggtgcacggcggcatgaccaccatccccctgctggtgctgctgggcatggacgacagcggcagcaagggcgacggcagacacgcctggaccatgaagcacttcaagaagcccacctactgcaacttctgccacatcatgctgatgggcgtgagaaagcagggcctgtgctgcacctactgcaagtacaccgtgcacgagagatgcgtgagcagaaacatccccggctgcgtgaagacctacagcaaggccaagagaagcggcgagttccacagaaagtgcgagctgagcaccctgtgcgacggcggcgagctgagagaccacatcctgctgcccaccagcatctgccccatcaccagagacagacccggcgagaagagcgacggctgcgtgagcgccaagggcgagctggtgatgcagtacaagatcatccccacccccggcacccaccccctgctggtgctggtgaaccccaagagcggcggcagacagggcgagagaatcctgagaaagttccactacctgctgaaccccaagcaggtgttcaacctggacaacggcggccccacccccggcctgaacttcttcagagacacccccgacttcagagtgctggcctgcggcggcgacggcaccgtgggctggatcctggactgcatcgacaaggccaacttcgccaagcacccccccgtggccgtgctgcccctgggcaccggcaacgacctggccagatgcctgagatggggcggcggctacgagggcggcagcctgaccaagatcctgaaggacatcgagcagagccccctggtgatgctggacagatggcacctggaggtgatccccagagaggaggtggagaacggcgaccaggtgccctacagcatcatgaacaactacttcagcatcggcgtggacgccagcatcgcccacagattccacgtgatgagagagaagcaccccgagaagttcaacagcagaatgaagaacaagctgtggtacttcgagttcggcaccagcgagaccttcgccgccacctgcaagaagctgcacgaccacatcgagctggagtgcgacggcgtgggcgtggacctgagcaacatcttcctggagggcatcgccatcctgaacatccccagcatgtacggcggcaccaacctgtggggcgagaacaagaagaacagagccgtgatcagagagagcagaaagggcgtgaccgaccccaaggagctgaagttctgcgtgcaggacctgagcgaccagctgctggaggtggtgggcctggagggcgccatggagatgggccagatctacaccggcctgaagagcgccggcagaagactggcccagtgcgccagcgtgaccatcagaaccaacaagctgctgcccatgcaggtggacggcgagccctggatgcagccctgctgcaccatcaagatcacccacaagaaccaggcccccatgatgatgggccccccccagaagagcagcttcttcagcctgagaagaaagagcagaagcaaggactag

SEQ ID NO: 79109 - DNA, 1818 bp, Artificial Sequence
  Description of Artificial Sequence: Synthetic coding sequence
agcctgaagatgggcgaggagagatgggtgagcctgacccccgaggagttcgaccagctgcagaagtacagcgagtacagcagcaagaagatcaaggacgccctgaccgagttcaacgagggcggcagcctgaagcagtacgacccccacgagcccatcagctacgacgtgttcaagctgttcatgagagcctacctggaggtggacctgccccagcccctgagcacccacctgttcctggccttcagccagaagcccagacacgagaccagcgaccaccccaccgagggcgccagcaacagcgaggccaacagcgccgacaccaacatccagaacgccgacaacgccaccaaggccgacgaggcctgcgcccccgacaccgagagcaacatggccgagaagcaggcccccgccgaggaccaggtggccgccacccccctggagccccccgtgcccagaagcagcagcagcgagagccccgtggtgtacctgaaggacgtggtgtgctacctgagcctgctggagaccggcagaccccaggacaagctggagttcatgttcagactgtacgacagcgacgagaacggcctgctggaccaggccgagatggactgcatcgtgaaccagatgctgcacatcgcccagtacctggagtgggaccccaccgagctgagacccatcctgaaggagatgctgcagggcatggactacgacagagacggcttcgtgagcctgcaggagtgggtgcacggcggcatgaccaccatccccctgctggtgctgctgggcatggacgacagcggcagcaagggcgacggcagacacgcctggaccatgaagcacttcaagaagcccacctactgcaacttctgccacatcatgctgatgggcgtgagaaagcagggcctgtgctgcacctactgcaagtacaccgtgcacgagagatgcgtgagcagaaacatccccggctgcgtgaagacctacagcaaggccaagagaagcggcgagttccacagaaagtgcgagctgagcaccctgtgcgacggcggcgagctgagagaccacatcctgctgcccaccagcatctgccccatcaccagagacagacccggcgagaagagcgacggctgcgtgagcgccaagggcgagctggtgatgcagtacaagatcatccccacccccggcacccaccccctgctggtgctggtgaaccccaagagcggcggcagacagggcgagagaatcctgagaaagttccactacctgctgaaccccaagcaggtgttcaacctggacaacggcggccccacccccggcctgaacttcttcagagacacccccgacttcagagtgctggcctgcggcggcgacggcaccgtgggctggatcctggactgcatcgacaaggccaacttcgccaagcacccccccgtggccgtgctgcccctgggcaccggcaacgacctggccagatgcctgagatggggcggcggctacgagggcggcagcctgaccaagatcctgaaggacatcgagcagagccccctggtgatgctggacagatggcacctggaggtgatccccagagaggaggtggagaacggcgaccaggtgccctacagcatcatgaacaactacttcagcatcggcgtggacgccagcatcgcccacagattccacgtgatgagagagaagcaccccgagaagttcaacagcagaatgaagaacaagctgtggtacttcgagttcggcaccagcgagaccttcgccgccacctgcaagaagctgcacgaccacatcgagctggagtggtgctag

SEQ ID NO: 79110 - DNA, 2199 bp, Artificial Sequence
  Description of Artificial Sequence: Synthetic coding sequence
atgggcgaggagagatgggtgagcctgacccccgaggagttcgaccagctgcagaagtacagcgagtacagcagcaagaagatcaaggacgccctgaccgagttcaacgagggcggcagcctgaagcagtacgacccccacgagcccatcagctacgacgtgttcaagctgttcatgagagcctacctggaggtggacctgccccagcccctgagcacccacctgttcctggccttcagccagaagcccagacacgagaccagcgaccaccccaccgagggcgccagcaacagcgaggccaacagcgccgacaccaacatccagaacgccgacaacgccaccaaggccgacgaggcctgcgcccccgacaccgagagcaacatggccgagaagcaggcccccgccgaggaccaggtggccgccacccccctggagccccccgtgcccagaagcagcagcagcgagagccccgtggtgtacctgaaggacgtggtgtgctacctgagcctgctggagaccggcagaccccaggacaagctggagttcatgttcagactgtacgacagcgacgagaacggcctgctggaccaggccgagatggactgcatcgtgaaccagatgctgcacatcgcccagtacctggagtgggaccccaccgagctgagacccatcctgaaggagatgctgcagggcatggactacgacagagacggcttcgtgagcctgcaggagtgggtgcacggcggcatgaccaccatccccctgctggtgctgctgggcatggacgacagcggcagcaagggcgacggcagacacgcctggaccatgaagcacttcaagaagcccacctactgcaacttctgccacatcatgctgatgggcgtgagaaagcagggcctgtgctgcacctactgcaagtacaccgtgcacgagagatgcgtgagcagaaacatccccggctgcgtgaagacctacagcaaggccaagagaagcggcgagttccacagaaagtgcgagctgagcaccctgtgcgacggcggcgagctgagagaccacatcctgctgcccaccagcatctgccccatcaccagatacaagatcatccccacccccggcacccaccccctgctggtgctggtgaaccccaagagcggcggcagacagggcgagagaatcctgagaaagttccactacctgctgaaccccaagcaggtgttcaacctggacaacggcggccccacccccggcctgaacttcttcagagacacccccgacttcagagtgctggcctgcggcggcgacggcaccgtgggctggatcctggactgcatcgacaaggccaacttcgccaagcacccccccgtggccgtgctgcccctgggcaccggcaacgacctggccagatgcctgagatggggcggcggctacgagggcggcagcctgaccaagatcctgaaggacatcgagcagagccccctggtgatgctggacagatggcacctggaggtgatccccagagaggaggtggagaacggcgaccaggtgccctacagcatcatgaacaactacttcagcatcggcgtggacgccagcatcgcccacagattccacgtgatgagagagaagcaccccgagaagttcaacagcagaatgaagaacaagctgtggtacttcgagttcggcaccagcgagaccttcgccgccacctgcaagaagctgcacgaccacatcgagctggagtgcgacggcgtgggcgtggacctgagcaacatcttcctggagggcatcgccatcctgaacatccccagcatgtacggcggcaccaacctgtggggcgagaacaagaagaacagagccgtgatcagagagagcagaaagggcgtgaccgaccccaaggagctgaagttctgcgtgcaggacctgagcgaccagctgctggaggtggtgggcctggagggcgccatggagatgggccagatctacaccggcctgaagagcgccggcagaagactggcccagtgcgccagcgtgaccatcagaaccaacaagctgctgcccatgcaggtggacggcgagccctggatgcagccctgctgcaccatcaagatcacccacaagaaccaggcccccatgatgatgggccccccccagaagagcagcttcttcagcctgagaagaaagagcagaagcaaggactag

SEQ ID NO: 79111 - DNA, 3198 bp, Artificial Sequence
  Description of Artificial Sequence: Synthetic coding sequence
atggacgccgccggcagaggctgccacctgctgcccctgcccgccgccagaggccccgccagagcccccgccgccgccgccgccgccgccgccagcccccccggcccctgcagcggcgccgcctgcgcccccagcgccgccgccggcgccggcgccatgaaccccagcagcagcgccggcgaggagaagggcgccaccggcggcagcagcagcagcggcagcggcgccggcagctgctgcctgggcgccgagggcggcgccgaccccagaggcgccggcagcgccgccgccgccggcgccgccgccctggacgagcccgccgccgccggccagaaggagaaggacgaggccctggaggagaagctgagaaacctgaccttcagaaagcaggtgagctacagaaaggccatcagcagagccggcctgcagcacctggcccccgcccaccccctgagcctgcccgtggccaacggccccgccaaggagcccagagccaccctggactggagcgagaacgccgtgaacggcgagcacctgtggctggagaccaacgtgagcggcgacctgtgctacctgggcgaggagaactgccaggtgagattcgccaagagcgccctgagaagaaagtgcgccgtgtgcaagatcgtggtgcacaccgcctgcatcgagcagctggagaagatcaacttcagatgcaagcccaccttcagagagggcggcagcagaagccccagagagaacttcgtgagacaccactgggtgcacagaagaagacaggagggcaagtgcaagcagtgcggcaagggcttccagcagaagttcagcttccacagcaaggagatcgtggccatcagctgcagctggtgcaagcaggccttccacaacaaggtgacctgcttcatgctgcaccacatcgaggagccctgcagcctgggcgcccacgccgccgtgatcgtgccccccacctggatcatcaaggtgaagaagccccagaacagcctgaaggccagcaacagaaagaagaagagaaccagcttcaagagaaaggccagcaagagaggcatggagcaggagaacaagggcagacccttcgtgatcaagcccatcagcagccccctgatgaagcccctgctggtgttcgtgaaccccaagagcggcggcaaccagggcaccaaggtgctgcagatgttcatgtggtacctgaaccccagacaggtgttcgacctgagccaggagggccccaaggacgccctggagctgtacagaaaggtgcccaacctgagaatcctggcctgcggcggcgacggcaccgtgggctggatcctgagcatcctggacgagctgcagctgagcccccagccccccgtgggcgtgctgcccctgggcaccggcaacgacctggccagaaccctgaactggggcggcggctacaccgacgagcccgtgagcaagatcctgtgccaggtggaggacggcaccgtggtgcagctggacagatggaacctgcacgtggagagaaaccccgacctgccccccgaggagctggaggacggcgtgtgcaagctgcccctgaacgtgttcaacaactacttcagcctgggcttcgacgcccacgtgaccctggagttccacgagagcagagaggccaaccccgagaagttcaacagcagattcagaaacaagatgttctacgccggcgccgccttcagcgacttcctgcagagaagcagcagagacctgagcaagcacgtgaaggtggtgtgcgacggcaccgacctgacccccaagatccaggagctgaagttccagtgcatcgtgttcctgaacatccccagatactgcgccggcaccatgccctggggcaaccccggcgaccaccacgacttcgagccccagagacacgacgacggctacatcgaggtgatcggcttcaccatggccagcctggccgccctgcaggtgggcggccacggcgagagactgcaccagtgcagagaggtgatgctgctgacctacaagagcatccccatgcaggtggacggcgagccctgcagactggcccccgccatgatcagaatcagcctgagaaaccaggccaacatggtgcagaagagcaagagaagaaccagcatgcccctgctgaacgacccccagagcgtgcccgacagactgagaatcagagtgaacaagatcagcctgcaggactacgagggcttccactacgacaaggagaagctgagagaggccagcatcagcgactggctgagaaccatcgccggcgagctggtgcagagcttcggcgccatccccctgggcatcctggtggtgagaggcgactgcgacctggagacctgcagaatgtacatcgacagactgcaggaggacctgcagagcgtgagcagcggcagccagagagtgcactaccaggaccacgagaccagcttccccagagccctgagcgcccagagactgagccccagatggtgcttcctggacgacagaagccaggagcacctgcacttcgtgatggagatcagccaggacgagatcttcatcctggaccccgacatggtggtgagccagcccgccggcaccccccccggcatgcccgacctggtggtggagcaggccagcggcatcagcgactggtggaaccccgccctgagaaagagaatgctgagcgacagcggcctgggcatgatcgccccctactacgaggacagcgacctgaaggacctgagccacagcagagtgctgcagagccccgtgagcagcgaggaccacgccatcctgcaggccgtgatcgccggcgacctgatgaagctgatcgagagctacaagaacggcggcagcctgctgatccagggccccgaccactgcagcctgctgcactacgccgccaagaccggcaacggcgagatcgtgaagtacatcctggaccacggccccagcgagctgctggacatggccgacagcgagaccggcgagaccgccctgcacaaggccgcctgccagagaaacagagccgtgtgccagctgctggtggacgccggcgccagcctgagaaagaccgacagcaagggcaagaccccccaggagagagcccagcaggccggcgaccccgacctggccgcctacctggagagcagacagaactacaaggtgatcggccacgaggacctggagaccgccgtgtag

SEQ ID NO: 79112 - DNA, 3207 bp, Artificial Sequence
  Description of Artificial Sequence: Synthetic coding sequence
atggacgccgccggcagaggctgccacctgctgcccctgcccgccgccagaggccccgccagagcccccgccgccgccgccgccgccgccgccagcccccccggcccctgcagcggcgccgcctgcgcccccagcgccgccgccggcgccggcgccatgaaccccagcagcagcgccggcgaggagaagggcgccaccggcggcagcagcagcagcggcagcggcgccggcagctgctgcctgggcgccgagggcggcgccgaccccagaggcgccggcagcgccgccgccgccggcgccgccgccctggacgagcccgccgccgccggccagaaggagaaggacgaggccctggaggagaagctgagaaacctgaccttcagaaagcaggtgagctacagaaaggccatcagcagagccggcctgcagcacctggcccccgcccaccccctgagcctgcccgtggccaacggccccgccaaggagcccagagccaccctggactggagcgagaacgccgtgaacggcgagcacctgtggctggagaccaacgtgagcggcgacctgtgctacctgggcgaggagaactgccaggtgagattcgccaagagcgccctgagaagaaagtgcgccgtgtgcaagatcgtggtgcacaccgcctgcatcgagcagctggagaagatcaacttcagatgcaagcccaccttcagagagggcggcagcagaagccccagagagaacttcgtgagacaccactgggtgcacagaagaagacaggagggcaagtgcaagcagtgcggcaagggcttccagcagaagttcagcttccacagcaaggagatcgtggccatcagctgcagctggtgcaagcaggccttccacaacaaggtgacctgcttcatgctgcaccacatcgaggagccctgcagcctgggcgcccacgccgccgtgatcgtgccccccacctggatcatcaaggtgaagaagccccagaacagcctgaaggccagcaacagaaagaagaagagaaccagcttcaagagaaaggccagcaagagaggcatggagcaggagaacaagggcagacccttcgtgatcaagcccatcagcagccccctgatgaagcccctgctggtgttcgtgaaccccaagagcggcggcaaccagggcaccaaggtgctgcagatgttcatgtggtacctgaaccccagacaggtgttcgacctgagccaggagggccccaaggacgccctggagctgtacagaaaggtgcccaacctgagaatcctggcctgcggcggcgacggcaccgtgggctggatcctgagcatcctggacgagctgcagctgagcccccagccccccgtgggcgtgctgcccctgggcaccggcaacgacctggccagaaccctgaactggggcggcggctacaccgacgagcccgtgagcaagatcctgtgccaggtggaggacggcaccgtggtgcagctggacagatggaacctgcacgtggagagaaaccccgacctgccccccgaggagctggaggacggcgtgtgcaagctgcccctgaacgtgttcaacaactacttcagcctgggcttcgacgcccacgtgaccctggagttccacgagagcagagaggccaaccccgagaagttcaacagcagattcagaaacaagatgttctacgccggcgccgccttcagcgacttcctgcagagaagcagcagagacctgagcaagcacgtgaaggtggtgtgcgacggcaccgacctgacccccaagatccaggagctgaagttccagtgcatcgtgttcctgaacatccccagatactgcgccggcaccatgccctggggcaaccccggcgaccaccacgacttcgagccccagagacacgacgacggctacatcgaggtgatcggcttcaccatggccagcctggccgccctgcaggtgggcggccacggcgagagactgcaccagtgcagagaggtgatgctgctgacctacaagagcatccccatgcaggtggacggcgagccctgcagactggcccccgccatgatcagaatcagcctgagaaaccaggccaacatggtgcagaagagcaagagaagaaccagcatgcccctgctgaacgacatccaccaggtgcagaccgccgacctgagaagagtgagcgccccccccggcagcttcaccatcccccagagcgtgcccgacagactgagaatcagagtgaacaagatcagcctgcaggactacgagggcttccactacgacaaggagaagctgagagaggccagcatccccctgggcatcctggtggtgagaggcgactgcgacctggagacctgcagaatgtacatcgacagactgcaggaggacctgcagagcgtgagcagcggcagccagagagtgcactaccaggaccacgagaccagcttccccagagccctgagcgcccagagactgagccccagatggtgcttcctggacgacagaagccaggagcacctgcacttcgtgatggagatcagccaggacgagatcttcatcctggaccccgacatggtggtgagccagcccgccggcaccccccccggcatgcccgacctggtggtggagcaggccagcggcatcagcgactggtggaaccccgccctgagaaagagaatgctgagcgacagcggcctgggcatgatcgccccctactacgaggacagcgacctgaaggacctgagccacagcagagtgctgcagagccccgtgagcagcgaggaccacgccatcctgcaggccgtgatcgccggcgacctgatgaagctgatcgagagctacaagaacggcggcagcctgctgatccagggccccgaccactgcagcctgctgcactacgccgccaagaccggcaacggcgagatcgtgaagtacatcctggaccacggccccagcgagctgctggacatggccgacagcgagaccggcgagaccgccctgcacaaggccgcctgccagagaaacagagccgtgtgccagctgctggtggacgccggcgccagcctgagaaagaccgacagcaagggcaagaccccccaggagagagcccagcaggccggcgaccccgacctggccgcctacctggagagcagacagaactacaaggtgatcggccacgaggacctggagaccgccgtgtag

SEQ ID NO: 79113 - DNA, 2949 bp, Artificial Sequence
  Description of Artificial Sequence: Synthetic coding sequence
atgaaccccagcagcagcgccggcgaggagaagggcgccaccggcggcagcagcagcagcggcagcggcgccggcagctgctgcctgggcgccgagggcggcgccgaccccagaggcgccggcagcgccgccgccgccggcgccgccgccctggacgagcccgccgccgccggccagaaggagaaggacgaggccctggaggagaagctgagaaacctgaccttcagaaagcaggtgagctacagaaaggccatcagcagagccggcctgcagcacctggcccccgcccaccccctgagcctgcccgtggccaacggccccgccaaggagcccagagccaccctggactggagcgagaacgccgtgaacggcgagcacctgtggctggagaccaacgtgagcggcgacctgtgctacctgggcgaggagaactgccaggtgagattcgccaagagcgccctgagaagaaagtgcgccgtgtgcaagatcgtggtgcacaccgcctgcatcgagcagctggagaagatcaacttcagatgcaagcccaccttcagagagggcggcagcagaagccccagagagaacttcgtgagacaccactgggtgcacagaagaagacaggagggcaagtgcaagcagtgcggcaagggcttccagcagaagttcagcttccacagcaaggagatcgtggccatcagctgcagctggtgcaagcaggccttccacaacaaggtgacctgcttcatgctgcaccacatcgaggagccctgcagcctgggcgcccacgccgccgtgatcgtgccccccacctggatcatcaaggtgaagaagccccagaacagcctgaaggccagcaacagaaagaagaagagaaccagcttcaagagaaaggccagcaagagaggcatggagcaggagaacaagggcagacccttcgtgatcaagcccatcagcagccccctgatgaagcccctgctggtgttcgtgaaccccaagagcggcggcaaccagggcaccaaggtgctgcagatgttcatgtggtacctgaaccccagacaggtgttcgacctgagccaggagggccccaaggacgccctggagctgtacagaaaggtgcccaacctgagaatcctggcctgcggcggcgacggcaccgtgggctggatcctgagcatcctggacgagctgcagctgagcccccagccccccgtgggcgtgctgcccctgggcaccggcaacgacctggccagaaccctgaactggggcggcggctacaccgacgagcccgtgagcaagatcctgtgccaggtggaggacggcaccgtggtgcagctggacagatggaacctgcacgtggagagaaaccccgacctgccccccgaggagctggaggacggcgtgtgcaagctgcccctgaacgtgttcaacaactacttcagcctgggcttcgacgcccacgtgaccctggagttccacgagagcagagaggccaaccccgagaagttcaacagcagattcagaaacaagatgttctacgccggcgccgccttcagcgacttcctgcagagaagcagcagagacctgagcaagcacgtgaaggtggtgtgcgacggcaccgacctgacccccaagatccaggagctgaagttccagtgcatcgtgttcctgaacatccccagatactgcgccggcaccatgccctggggcaaccccggcgaccaccacgacttcgagccccagagacacgacgacggctacatcgaggtgatcggcttcaccatggccagcctggccgccctgcaggtgggcggccacggcgagagactgcaccagtgcagagaggtgatgctgctgacctacaagagcatccccatgcaggtggacggcgagccctgcagactggcccccgccatgatcagaatcagcctgagaaaccaggccaacatggtgcagaagagcaagagaagaaccagcatgcccctgctgaacgacccccagagcgtgcccgacagactgagaatcagagtgaacaagatcagcctgcaggactacgagggcttccactacgacaaggagaagctgagagaggccagcatcagcgactggctgagaaccatcgccggcgagctggtgcagagcttcggcgccatccccctgggcatcctggtggtgagaggcgactgcgacctggagacctgcagaatgtacatcgacagactgcaggaggacctgcagagcgtgagcagcggcagccagagagtgcactaccaggaccacgagaccagcttccccagagccctgagcgcccagagactgagccccagatggtgcttcctggacgccaccagcgccgacagattctacagaatcgacagaagccaggagcacctgcacttcgtgatggagatcagccaggacgagatcttcatcctggaccccgacatggtggtgagccagcccgccggcaccccccccggcatgcccgacctggtggtggagcaggccagcggcagccccgtgagcagcgaggaccacgccatcctgcaggccgtgatcgccggcgacctgatgaagctgatcgagagctacaagaacggcggcagcctgctgatccagggccccgaccactgcagcctgctgcactacgccgccaagaccggcaacggcgagatcgtgaagtacatcctggaccacggccccagcgagctgctggacatggccgacagcgagaccggcgagaccgccctgcacaaggccgcctgccagagaaacagagccgtgtgccagctgctggtggacgccggcgccagcctgagaaagaccgacagcaagggcaagaccccccaggagagagcccagcaggccggcgaccccgacctggccgcctacctggagagcagacagaactacaaggtgatcggccacgaggacctggagaccgccgtgtag

SEQ ID NO: 79114 - DNA, 2829 bp, Artificial Sequence
  Description of Artificial Sequence: Synthetic coding sequence
atggccgccgccgccgagcccggcgccagagcctggctgggcggcggcagccccagacccggcagccccgcctgcagccccgtgctgggcagcggcggcagagccagacccggccccggccccggccccggccccgagagagccggcgtgagagcccccggccccgccgccgcccccggccacagcttcagaaaggtgaccctgaccaagcccaccttctgccacctgtgcagcgacttcatctggggcctggccggcttcctgtgcgacgtgtgcaacttcatgagccacgagaagtgcctgaagcacgtgagaatcccctgcaccagcgtggcccccagcctggtgagagtgcccgtggcccactgcttcggccccagaggcctgcacaagagaaagttctgcgccgtgtgcagaaaggtgctggaggcccccgccctgcactgcgaggtgtgcgagctgcacctgcaccccgactgcgtgcccttcgcctgcagcgactgcagacagtgccaccaggacggccaccaggaccacgacacccaccaccaccactggagagagggcaacctgcccagcggcgccagatgcgaggtgtgcagaaagacctgcggcagcagcgacgtgctggccggcgtgagatgcgagtggtgcggcgtgcaggcccacagcctgtgcagcgccgccctggcccccgagtgcggcttcggcagactgagaagcctggtgctgccccccgcctgcgtgagactgctgcccggcggcttcagcaagacccagagcttcagaatcgtggaggccgccgagcccggcgagggcggcgacggcgccgacggcagcgccgccgtgggccccggcagagagacccaggccacccccgagagcggcaagcagaccctgaagatcttcgacggcgacgacgccgtgagaagaagccagttcagactggtgaccgtgagcagactggccggcgccgaggaggtgctggaggccgccctgagagcccaccacatccccgaggaccccggccacctggagctgtgcagactgccccccagcagccaggcctgcgacgcctgggccggcggcaaggccggcagcgccgtgatcagcgaggagggcagaagccccggcagcggcgaggccacccccgaggcctgggtgatcagagccctgcccagagcccaggaggtgctgaagatctaccccggctggctgaaggtgggcgtggcctacgtgagcgtgagagtgacccccaagagcaccgccagaagcgtggtgctggaggtgctgcccctgctgggcagacaggccgagagccccgagagcttccagctggtggaggtggccatgggctgcagacacgtgcagagaaccatgctgatggacgagcagcccctgctggacagactgcaggacatcagacagatgagcgtgagacaggtgagccagaccagattctacgtggccgagagcagagacgtggccccccacgtgagcctgttcgtgggcggcctgccccccggcctgagccccgaggagtacagcagcctgctgcacgaggccggcgccaccaaggccaccgtggtgagcgtgagccacatctacagcagccagggcgccgtggtgctggacgtggcctgcttcgccgaggccgagagactgtacatgctgctgaaggacatggccgtgagaggcagactgctgaccgccctggtgctgcccgacctgctgcacgccaagctgccccccgacagctgccccctgctggtgttcgtgaaccccaagagcggcggcctgaagggcagagacctgctgtgcagcttcagaaagctgctgaacccccaccaggtgttcgacctgaccaacggcggccccctgcccggcctgcacctgttcagccaggtgccctgcttcagagtgctggtgtgcggcggcgacggcaccgtgggctgggtgctgggcgccctggaggagaccagatacagactggcctgccccgagcccagcgtggccatcctgcccctgggcaccggcaacgacctgggcagagtgctgagatggggcgccggctacagcggcgaggaccccttcagcgtgctgctgagcgtggacgaggccgacgccgtgctgatggacagatggaccatcctgctggacgcccacgaggccggcagcgccgagaacgacaccgccgacgccgagccccccaagatcgtgcagatgagcaactactgcggcatcggcatcgacgccgagctgagcctggacttccaccaggccagagaggaggagcccggcaagttcaccagcagactgcacaacaagggcgtgtacgtgagagtgggcctgcagaagatcagccacagcagaagcctgcacaagcagatcagactgcaggtggagagacaggaggtggagctgcccagcatcgagggcctgatcttcatcaacatccccagctggggcagcggcgccgacctgtggggcagcgacagcgacaccagattcgagaagcccagaatggacgacggcctgctggaggtggtgggcgtgaccggcgtggtgcacatgggccaggtgcagggcggcctgagaagcggcatcagaatcgcccagggcagctacttcagagtgaccctgctgaaggccacccccgtgcaggtggacggcgagccctgggtgcaggcccccggccacatgatcatcagcgccgccggccccaaggtgcacatgctgagaaaggccaagcagaagcccagaagagccggcaccaccagagacgccagagccgacgccgcccccgcccccgagagcgaccccagatag

SEQ ID NO: 79115 - DNA, 1632 bp, Artificial Sequence
  Description of Artificial Sequence: Synthetic coding sequence
atgcccggcatggtgctgttcggcagaagatgggccatcgccagcgacgacctggtgttccccggcttcttcgagctggtggtgagagtgctgtggtggatcggcatcctgaccctgtacctgatgcacagaggcaagctggactgcgccggcggcgccctgctgagcagctacctgatcgtgctgatgatcctgctggccgtggtgatctgcaccgtgagcgccatcatgtgcgtgagcatgagaggcaccatctgcaaccccggccccagaaagagcatgagcaagctgctgtacatcagactggccctgttcttccccgagatggtgtgggccagcctgggcgccgcctgggtggccgacggcgtgcagtgcgacagaaccgtggtgaacggcatcatcgccaccgtggtggtgagaacccagatctggtgccccgccaccctgagaagagccagcccctgcttcatcagcaacagaaccatcagcggcaccaccaagagcctgcccagatggagcgccatgccccagggcgcccccagctgcagaagcagaaccaccgactacgacctggtgggcggcgaccagctgaactgccacttcggcagcatcctgcacaccaccggcctgcagtacagagacttcatccacgtgagcttccacgacaaggtgtacgagctgcccttcctggtggccctggaccacagaaaggagagcgtggtggtggccgtgagaggcaccatgagcctgcaggacgtgctgaccgacctgagcgccgagagcgaggtgctggacgtggagtgcgaggtgcaggacagactggcccacaagggcatcagccaggccgccagatacgtgtaccagagactgatcaacgacggcatcctgagccaggccttcagcatcgcccccgagtacagactggtgatcgtgggccacagcctgggcggcggcgccgccgccctgctggccaccatgctgagagccgcctacccccaggtgagatgctacgccttcagcccccccagaggcctgtggagcaaggccctgcaggagtacagccagagcttcatcgtgagcctggtgctgggcaaggacgtgatccccagactgagcgtgaccaacctggaggacctgaagagaagaatcctgagagtggtggcccactgcaacaagcccaagtacaagatcctgctgcacggcctgtggtacgagctgttcggcggcaaccccaacaacctgcccaccgagctggacggcggcgaccaggaggtgctgacccagcccctgctgggcgagcagagcctgctgaccagatggagccccgcctacagcttcagcagcgacagccccctggacagcagccccaagtacccccccctgtacccccccggcagaatcatccacctgcaggaggagggcgccagcggcagattcggctgctgcagcgccgcccactacagcgccaagtggagccacgaggccgagttcagcaagatcctgatcggccccaagatgctgaccgaccacatgcccgacatcctgatgagagccctggacagcgtggtgagcgacagagccgcctgcgtgagctgccccgcccagggcgtgagcagcgtggacgtggcctag

SEQ ID NO: 79116 - DNA, 3129 bp, Artificial Sequence
  Description of Artificial Sequence: Synthetic coding sequence
atgcccggcatcgtggtgttcagaagaagatggagcgtgggcagcgacgacctggtgctgcccgccatcttcctgttcctgctgcacaccacctggttcgtgatcctgagcgtggtgctgttcggcctggtgtacaacccccacgaggcctgcagcctgaacctggtggaccacggcagaggctacctgggcatcctgctgagctgcatgatcgccgagatggccatcatctggctgagcatgagaggcggcatcctgtacaccgagcccagagacagcatgcagtacgtgctgtacgtgagactggccatcctggtgatcgagttcatctacgccatcgtgggcatcgtgtggctgacccagtactacaccagctgcaacgacctgaccgccaagaacgtgaccctgggcatggtggtgtgcaactgggtggtgatcctgagcgtgtgcatcaccgtgctgtgcgtgttcgaccccaccggcagaaccttcgtgaagctgagagccaccaagagaagacagagaaacctgagaacctacaacctgagacacagactggaggagggccaggccaccagctggagcagaagactgaaggtgttcctgtgctgcaccagaaccaaggacagccagagcgacgcctacagcgagatcgcctacctgttcgccgagttcttcagagacctggacatcgtgcccagcgacatcatcgccggcctggtgctgctgagacagagacagagagccaagagaaacgccgtgctggacgaggccaacaacgacatcctggccttcctgagcggcatgcccgtgaccagaaacaccaagtacctggacctgaagaacagccaggagatgctgagatacaaggaggtgtgctactacatgctgttcgccctggccgcctacggctggcccatgtacctgatgagaaagcccgcctgcggcctgtgccagctggccagaagctgcagctgctgcctgtgccccgccagacccagattcgcccccggcgtgaccatcgaggaggacaactgctgcggctgcaacgccatcgccatcagaagacacttcctggacgagaacatgaccgccgtggacatcgtgtacaccagctgccacgacgccgtgtacgagacccccttctacgtggccgtggaccacgacaagaagaaggtggtgatcagcatcagaggcaccctgagccccaaggacgccctgaccgacctgaccggcgacgccgagagactgcccgtggagggccaccacggcacctggctgggccacaagggcatggtgctgagcgccgagtacatcaagaagaagctggagcaggagatggtgctgagccaggccttcggcagagacctgggcagaggcaccaagcactacggcctgatcgtggtgggccacagcctgggcgccggcaccgccgccatcctgagcttcctgctgagaccccagtaccccaccctgaagtgcttcgcctacagcccccccggcggcctgctgagcgaggacgccatggagtacagcaaggagttcgtgaccgccgtggtgctgggcaaggacctggtgcccagaatcggcctgagccagctggagggcttcagaagacagctgctggacgtgctgcagagaagcaccaagcccaagtggagaatcatcgtgggcgccaccaagtgcatccccaagagcgagctgcccgaggaggtggaggtgaccaccctggccagcaccagactgtggacccaccccagcgacctgaccatcgccctgagcgccagcacccccctgtacccccccggcagaatcatccacgtggtgcacaaccaccccgccgagcagtgctgctgctgcgagcaggaggagcccacctacttcgccatctggggcgacaacaaggccttcaacgaggtgatcatcagccccgccatgctgcacgagcacctgccctacgtggtgatggagggcctgaacaaggtgctggagaactacaacaagggcaagaccgccctgctgagcgccgccaaggtgatggtgagccccaccgaggtggacctgacccccgagctgatcttccagcagcagcccctgcccaccggcccccccatgcccaccggcctggccctggagctgcccaccgccgaccacagaaacagcagcgtgagaagcaagagccagagcgagatgagcctggagggcttcagcgagggcagactgctgagccccgtggtggccgccgccgccagacaggaccccgtggagctgctgctgctgagcacccaggagagactggccgccgagctgcaggccagaagagcccccctggccaccatggagagcctgagcgacaccgagagcctgtacagcttcgacagcagaagaagcagcggcttcagaagcatcagaggcagccccagcctgcacgccgtgctggagagagacgagggccacctgttctacatcgaccccgccatccccgaggagaaccccagcctgagcagcagaaccgagctgctggccgccgacagcctgagcaagcacagccaggacacccagcccctggaggccgccctgggcagcggcggcgtgacccccgagagaccccccagcgccgccgccaacgacgaggaggaggaggtgggcggcggcggcggcggccccgccagcagaggcgagctggccctgcacaacggcagactgggcgacagccccagcccccaggtgctggagttcgccgagttcatcgacagcctgttcaacctggacagcaagagcagcagcttccaggacctgtactgcatggtggtgcccgagagccccaccagcgactacgccgagggccccaagagccccagccagcaggagatcctgctgagagcccagttcgagcccaacctggtgcccaagccccccagactgttcgccggcagcgccgaccccagcagcggcatcagcctgagccccagcttccccctgagcagcagcggcgagctgatggacctgacccccaccggcctgagcagccaggagtgcctggccgccgacaagatcagaaccagcacccccaccggccacggcgccagccccgccaagcaggacgagctggtgatcagcgccagatag

SEQ ID NO: 79117 - DNA, 2019 bp, Artificial Sequence
  Description of Artificial Sequence: Synthetic coding sequence
atgcccggcatggtgctgttcggcagaagatgggccatcgccagcgacgacctggtgttccccggcttcttcgagctggtggtgagagtgctgtggtggatcggcatcctgaccctgtacctgatgcacagaggcaagctggactgcgccggcggcgccctgctgagcagctacctgatcgtgctgatgatcctgctggccgtggtgatctgcaccgtgagcgccatcatgtgcgtgagcatgagaggcaccatctgcaaccccggccccagaaagagcatgagcaagctgctgtacatcagactggccctgttcttccccgagatggtgtgggccagcctgggcgccgcctgggtggccgacggcgtgcagtgcgacagaaccgtggtgaacggcatcatcgccaccgtggtggtgagctggatcatcatcgccgccaccgtggtgagcatcatcatcgtgttcgaccccctgggcggcaagatggccccctacagcagcgccggccccagccacctggacagccacgacagcagccagctgctgaacggcctgaagaccgccgccaccagcgtgtgggagaccagaatcaagctgctgtgctgctgcatcggcaaggacgaccacaccagagtggccttcagcagcaccgccgagctgttcagcacctacttcagcgacaccgacctggtgcccagcgacatcgccgccggcctggccctgctgcaccagcagcaggacaacatcagaaacaaccaggagcccgcccaggtggtgtgccacgcccccggcagcagccaggaggccgacctggacgccgagctggagaactgccaccactacatgcagttcgccgccgccgcctacggctggcccctgtacatctacagaaaccccctgaccggcctgtgcagaatcggcggcgactgctgcagaagcagaaccaccgactacgacctggtgggcggcgaccagctgaactgccacttcggcagcatcctgcacaccaccggcctgcagtacagagacttcatccacgtgagcttccacgacaaggtgtacgagctgcccttcctggtggccctggaccacagaaaggagagcgtggtggtggccgtgagaggcaccatgagcctgcaggacgtgctgaccgacctgagcgccgagagcgaggtgctggacgtggagtgcgaggtgcaggacagactggcccacaagggcatcagccaggccgccagatacgtgtaccagagactgatcaacgacggcatcctgagccaggccttcagcatcgcccccgagtacagactggtgatcgtgggccacagcctgggcggcggcgccgccgccctgctggccaccatgctgagagccgcctacccccaggtgagatgctacgccttcagcccccccagaggcctgtggagcaaggccctgcaggagtacagccagagcttcatcgtgagcctggtgctgggcaaggacgtgatccccagactgagcgtgaccaacctggaggacctgaagagaagaatcctgagagtggtggcccactgcaacaagcccaagtacaagatcctgctgcacggcctgtggtacgagctgttcggcggcaaccccaacaacctgcccaccgagctggacggcggcgaccaggaggtgctgacccagcccctgctgggcgagcagagcctgctgaccagatggagccccgcctacagcttcagcagcgacagccccctggacagcagccccaagtacccccccctgtacccccccggcagaatcatccacctgcaggaggagggcgccagcggcagattcggctgctgcagcgccgcccactacagcgccaagtggagccacgaggccgagttcagcaagatcctgatcggccccaagatgctgaccgaccacatgcccgacatcctgatgagagccctggacagcgtggtgagcgacagagccgcctgcgtgagctgccccgcccagggcgtgagcagcgtggacgtggcctag

SEQ ID NO: 79118 - DNA, 663 bp, Artificial Sequence
  Description of Artificial Sequence: Synthetic coding sequence
atgtactgcgtgagccaccacgtgtgccagcacgagagaacccagatctggtgccccgccaccctgagaagagccagcccctgcttcatcagcaacagaaccatcagcggcaccaccaagagcctgcccagatggagcgccatgccccagggcgcccccagctgcagaagcagaaccaccgactacgacctggtgggcggcgaccagctgaactgccacttcggcagcatcctgcacaccaccggcctgcagtacagagacttcatccacgtgagcttccacgacaaggtgtacgagctgcccttcctggtggccctggaccacagaaaggagagcgtggtggtggccgtgagaggcaccatgagcctgcaggacgtgctgaccgacctgagcgccgagagcgaggtgctggacgtggagtgcgaggtgcaggacagactggcccacaagggcatcagccaggccgccagatacgtgtaccagagactgatcaacgacggcatcctgagccaggccttcagcatcgcccccgagtacagactggtgatcgtgggccacagcctgggcggcggcgccgccgccctgctggccaccatgctgagagccgcctacccccaggtgagatgctacgccttcagcccccccagaggcctgtggagatag

SEQ ID NO: 79119 - DNA, 1140 bp, Artificial Sequence
  Description of Artificial Sequence: Synthetic coding sequence
atgtactgcgtgagccaccacgtgtgccagcacgagagctggatcatcatcgccgccaccgtggtgagcatcatcatcgtgttcgaccccctgggcggcaagatggccccctacagcagcgccggccccagccacctggacagccacgacagcagccagctgctgaacggcctgaagaccgccgccaccagcgtgtgggagaccagaatcaagctgctgtgctgctgcatcggcaaggacgaccacaccagagtggccttcagcagcaccgccgagctgttcagcacctacttcagcgacaccgacctggtgcccagcgacatcgccgccggcctggccctgctgcaccagcagcaggacaacatcagaaacaaccaggagcccgcccaggtggtgtgccacgcccccggcagcagccaggaggccgacctggacgccgagctggagaactgccaccactacatgcagttcgccgccgccgcctacggctggcccctgtacatctacagaaaccccctgaccggcctgtgcagaatcggcggcgactgctgcagaagcagaaccaccgactacgacctggtgggcggcgaccagctgaactgccacttcggcagcatcctgcacaccaccggcctgcagtacagagacttcatccacgtgagcttccacgacaaggtgtacgagctgcccttcctggtggccctggaccacagaaaggagagcgtggtggtggccgtgagaggcaccatgagcctgcaggacgtgctgaccgacctgagcgccgagagcgaggtgctggacgtggagtgcgaggtgcaggacagactggcccacaagggcatcagccaggccgccagatacgtgtaccagagactgatcaacgacggcatcctgagccaggccttcagcatcgcccccgagtacagactggtgatcgtgggccacagcctgggcggcggcgccgccgccctgctggccaccatgctgagagccgcctacccccagcagagcagcgccggcatcttcagcgagctgcacagagtgaccagacccggcgagggctgcgacagccaggcccagtgcgaccagctgggcagaagcgaggagaagaacctggccagcggcagagccctgcagtag

SEQ ID NO: 79120 - DNA, 804 bp, Artificial Sequence
  Description of Artificial Sequence: Synthetic coding sequence
atgcccggcatggtgctgttcggcagaagatgggccatcgccagcgacgacctggtgttccccggcttcttcgagctggtggtgagagtgctgtggtggatcggcatcctgaccctgtacctgatgcacagaggcaagctggactgcgccggcggcgccctgctgagcagctacctgatcgtgctgatgatcctgctggccgtggtgatctgcaccgtgagcgccatcatgtgcgtgagcatgagaggcaccatctgcaaccccggccccagaaagagcatgagcaagctgctgtacatcagactggccctgttcttccccgagatggtgtgggccagcctgggcgccgcctgggtggccgacggcgtgcagtgcgacagaaccgtggtgaacggcatcatcgccaccgtggtggtgagctggatcatcatcgccgccaccgtggtgagcatcatcatcgtgttcgaccccctgggcggcaagatggccccctacagcagcgccggccccagccacctggacagccacgacagcagccagctgctgaacggcctgaagaccgccgccaccagcgtgtgggagaccagaatcaagctgctgtgctgctgcatcggcaaggacgaccacaccagagtggccttcagcagcaccgccgagctgttcagcacctacttcagcgacaccgacctggtgcccagcgacatcgccgccggcctggccctgctgcaccagcagcaggacaacaccagagccaccggcaactgccccagaaacgacggcctgaccctgctgagcctgaactag

SEQ ID NO: 79121 - DNA, 1467 bp, Artificial Sequence
  Description of Artificial Sequence: Synthetic coding sequence
atgggcgacagaggcagcagcagaagaagaagaaccggcagcagacccagcagccacggcggcggcggccccgccgccgccgaggaggaggtgagagacgccgccgccggccccgacgtgggcgccgccggcgacgcccccgcccccgcccccaacaaggacggcgacgccggcgtgggcagcggccactgggagctgagatgccacagactgcaggacagcctgttcagcagcgacagcggcttcagcaactacagaggcatcctgaactggtgcgtggtgatgctgatcctgagcaacgccagactgttcctggagaacctgatcaagtacggcatcctggtggaccccatccaggtggtgagcctgttcctgaaggacccctacagctggcccgccccctgcctggtgatcgccgccaacgtgttcgccgtggccgccttccaggtggagaagagactggccgtgggcgccctgaccgagcaggccggcctgctgctgcacgtggccaacctggccaccatcctgtgcttccccgccgccgtggtgctgctggtggagagcatcacccccgtgggcagcctgctggccctgatggcccacaccatcctgttcctgaagctgttcagctacagagacgtgaacagctggtgcagaagagccagagccaaggccgccagcgccggcaagaaggccagcagcgccgccgccccccacaccgtgagctaccccgacaacctgacctacagagacctgtactacttcctgttcgcccccaccctgtgctacgagctgaacttccccagaagccccagaatcagaaagagattcctgctgagaagaatcctggagatgctgttcttcacccagctgcaggtgggcctgatccagcagtggatggtgcccaccatccagaacagcatgaagcccttcaaggacatggactacagcagaatcatcgagagactgctgaagctggccgtgcccaaccacctgatctggctgatcttcttctactggctgttccacagctgcctgaacgccgtggccgagctgatgcagttcggcgacagagagttctacagagactggtggaacagcgagagcgtgacctacttctggcagaactggaacatccccgtgcacaagtggtgcatcagacacttctacaagcccatgctgagaagaggcagcagcaagtggatggccagaaccggcgtgttcctggccagcgccttcttccacgagtacctggtgagcgtgcccctgagaatgttcagactgtgggccttcaccggcatgatggcccagatccccctggcctggttcgtgggcagattcttccagggcaactacggcaacgccgccgtgtggctgagcctgatcatcggccagcccatcgccgtgctgatgtacgtgcacgactactacgtgctgaactacgaggcccccgccgccgaggcctag

SEQ ID NO: 79122 - DNA, 282 bp, Artificial Sequence
  Description of Artificial Sequence: Synthetic coding sequence
atgaagctgctgatggtgctgatgctggccgccctgagccagcactgctacgccggcagcggctgccccctgctggagaacgtgatcagcaagaccatcaacccccaggtgagcaagaccgagtacaaggagctgctgcaggagttcatcgacgacaacgccaccaccaacgccatcgacgagctgaaggagtgcttcctgaaccagaccgacgagaccctgagcaacgtggaggtgttcatgcagctgatctacgacagcagcctgtgcgacctgttctag

SEQ ID NO: 79123 - DNA, 1038 bp, Artificial Sequence
  Description of Artificial Sequence: Synthetic coding sequence
atgaagaccctgatcgccgcctacagcggcgtgctgagaggcgagagacaggccgaggccgacagaagccagagaagccacggcggccccgccctgagcagagagggcagcggcagatggggcgtggcctgcagcgccatcctgatgtacatcttctgcaccgactgctggctgatcgccgtgctgtacttcacctggctggtgttcgactggaacacccccaagaagggcggcagaagaagccagtgggtgagaaactgggccgtgtggagatacttcagagactacttccccatccagctggtgaagacccacaacctgctgaccaccagaaactacatcttcggctaccacccccacggcatcatgggcctgggcgccttctgcaacttcagcaccgaggccaccgaggtgagcaagaagttccccggcatcagaccctacctggccaccctggccggcaacttcagaatgcccgtgctgagagagtacctgatgagcggcggcatctgccccgtgagcagagacaccatcgactacctgctgagcaagaacggcagcggcaacgccatcatcatcgtggtgggcggcgccgccgagagcctgagcagcatgcccggcaagaacgccgtgaccctgagaaacagaaagggcttcgtgaagctggccctgagacacggcgccgacctggtgcccatctacagcttcggcgagaacgaggtgtacaagcaggtgatcttcgaggagggcagctggggcagatgggtgcagaagaagttccagaagtacatcggcttcgccccctgcatcttccacggcagaggcctgttcagcagcgacacctggggcctggtgccctacagcaagcccatcaccaccgtggtgggcgagcccatcaccatccccaagctggagcaccccacccagcaggacatcgacctgtaccacaccatgtacatggaggccctggtgaagctgttcgacaagcacaagaccaagttcggcctgcccgagaccgaggtgctggaggtgaactag

SEQ ID NO: 79124 - DNA, 3306 bp, Artificial Sequence
  Description of Artificial Sequence: Synthetic coding sequence
atggagcagcccggcgccgccgccagcggcgccggcggcggcagcgaggagcccggcggcggcagaagcaacaagagaagcgccggcaacagagccgccaacgaggaggagaccaagaacaagcccaagctgaacatccagatcaagaccctggccgacgacgtgagagacagaatcaccagcttcagaaagagcaccgtgaagaaggagaagcccctgatccagcaccccatcgacagccaggtggccatgagcgagttccccgccgcccagcccctgtacgacgagagaagcctgaacctgagcgagaaggaggtgctggacctgttcgagaagatgatggaggacatgaacctgaacgaggagaagaaggcccccctgagaaacaaggacttcaccaccaagagagagatggtggtgcagtacatcagcgccaccgccaagagcggcggcctgaagaacagcaagcacgagtgcaccctgagcagccaggagtacgtgcacgagctgagaagcggcatcagcgacgagaagctgctgaactgcctggagagcctgagagtgagcctgaccagcaaccccgtgagctgggtgaacaacttcggccacgagggcctgggcctgctgctggacgagctggagaagctgctggacaagaagcagcaggagaacatcgacaagaagaaccagtacaagctgatccagtgcctgaaggccttcatgaacaacaagttcggcctgcagagaatcctgggcgacgagagaagcctgctgctgctggccagagccatcgaccccaagcagcccaacatgatgaccgagatcgtgaagatcctgagcgccatctgcatcgtgggcgaggagaacatcctggacaagctgctgggcgccatcaccaccgccgccgagagaaacaacagagagagattcagccccatcgtggagggcctggagaaccaggaggccctgcagctgcaggtggcctgcatgcagttcatcaacgccctggtgaccagcccctacgagctggacttcagaatccacctgagaaacgagttcctgagaagcggcctgaagaccatgctgcccgacctgaaggagaaggagaacgacgagctggacatccagctgaaggtgttcgacgagaacaaggaggacgacctgaccgagctgagccacagactgaacgacatcagagccgagatggacgacatgaacgaggtgtaccacctgctgtacaacatgctgaaggacaccgccgccgagaactacttcctgagcatcctgcagcacttcctgctgatcagaaacgactactacatcagaccccagtactacaagatcatcgaggagtgcgtgagccagatcgtgctgcactgcagcggcatggaccccgacttcaagtacagacagagactggacatcgacctgacccacctgatcgacagctgcgtgaacaaggccaaggtggaggagagcgagcagaaggccgccgagttcagcaagaagttcgacgaggagttcaccgccagacaggaggcccaggccgagctgcagaagagagacgagaagatcaaggagctggaggccgagatccagcagctgagaacccaggcccaggtgctgagcagcagcagcggcatccccggcccccccgccgccccccccctgcccggcgtgggcccccccccccccccccccgccccccccctgcccggcggcgcccccctgccccccccccccccccccctgcccggcatgatgggcatccccccccccccccccccccccctgctgttcggcggcccccccccccccccccccctgggcggcgtgccccccccccccggcatcagcctgaacctgccctacggcatgaagcagaagaagatgtacaagcccgaggtgagcatgaagagaatcaactggagcaagatcgagcccaccgagctgagcgagaactgcttctggctgagagtgaaggaggacaagttcgagaaccccgacctgttcgccaagctggccctgaacttcgccacccagatcaaggtgcagaagaacgccgaggccctggaggagaagaagaccggccccaccaagaagaaggtgaaggagctgagaatcctggaccccaagaccgcccagaacctgagcatcttcctgggcagctacagaatgccctacgaggacatcagaaacgtgatcctggaggtgaacgaggacatgctgagcgaggccctgatccagaacctggtgaagcacctgcccgagcagaagatcctgaacgagctggccgagctgaagaacgagtacgacgacctgtgcgagcccgagcagttcggcgtggtgatgagcagcgtgaagatgctgcagcccagactgagcagcatcctgttcaagctgaccttcgaggagcacatcaacaacatcaagcccagcatcatcgccgtgaccctggcctgcgaggagctgaagaagagcgagagcttcaacagactgctggagctggtgctgctggtgggcaactacatgaacagcggcagcagaaacgcccagagcctgggcttcaagatcaacttcctgtgcaagatcagagacaccaagagcgccgaccagaagaccaccctgctgcacttcatcgccgacatctgcgaggagaagtacagagacatcctgaagttccccgaggagctggagcacgtggagagcgccagcaaggtgagcgcccagatcctgaagagcaacctggccagcatggagcagcagatcgtgcacctggagagagacatcaagaagttcccccaggccgagaaccagcacgacaagttcgtggagaagatgaccagcttcaccaagaccgccagagagcagtacgagaagctgagcaccatgcacaacaacatgatgaagctgtacgagaacctgggcgagtacttcatcttcgacagcaagaccgtgagcatcgaggagttcttcggcgacctgaacaacttcagaaccctgttcctggaggccgtgagagagaacaacaagagaagagagatggaggagaagaccagaagagccaagctggccaaggagaaggccgagcaggagaagctggagagacagaagaagaagaagcagctgatcgacatcaacaaggagggcgacgagaccggcgtgatggacaacctgctggaggccctgcagagcggcgccgccttcagagacagaagaaagagaatccccagaaaccccgacaacagaagagtgcccctggagagaagcagaagcagacacaacggcgccatcagcagcaagtag

SEQ ID NO: 79125 - DNA, 3291 bp, Artificial Sequence
  Description of Artificial Sequence: Synthetic coding sequence
atggagcagcccggcgccgccgccagcggcgccggcggcggcagcgaggagcccggcggcggcagaagcaacaagagaagcgccggcaacagagccgccaacgaggaggagaccaagaacaagcccaagctgaacatccagatcaagaccctggccgacgacgtgagagacagaatcaccagcttcagaaagagcaccgtgaagaaggagaagcccctgatccagcaccccatcgacagccaggtggccatgagcgagttccccgccgcccagcccctgtacgacgagagaagcctgaacctgagcgagaaggaggtgctggacctgttcgagaagatgatggaggacatgaacctgaacgaggagaagaaggcccccctgagaaacaaggacttcaccaccaagagagagatggtggtgcagtacatcagcgccaccgccaagagcggcggcctgaagaacagcaagcacgagtgcaccctgagcagccaggagtacgtgcacgagctgagaagcggcatcagcgacgagaagctgctgaactgcctggagagcctgagagtgagcctgaccagcaaccccgtgagctgggtgaacaacttcggccacgagggcctgggcctgctgctggacgagctggagaagctgctggacaagaagcagcaggagaacatcgacaagaagaaccagtacaagctgatccagtgcctgaaggccttcatgaacaacaagttcggcctgcagagaatcctgggcgacgagagaagcctgctgctgctggccagagccatcgaccccaagcagcccaacatgatgaccgagatcgtgaagatcctgagcgccatctgcatcgtgggcgaggagaacatcctggacaagctgctgggcgccatcaccaccgccgccgagagaaacaacagagagagattcagccccatcgtggagggcctggagaaccaggaggccctgcagctgcaggtggcctgcatgcagttcatcaacgccctggtgaccagcccctacgagctggacttcagaatccacctgagaaacgagttcctgagaagcggcctgaagaccatgctgcccgacctgaaggagaaggagaacgacgagctggacatccagctgaaggtgttcgacgagaacaaggaggacgacctgaccgagctgagccacagactgaacgacatcagagccgagatggacgacatgaacgaggtgtaccacctgctgtacaacatgctgaaggacaccgccgccgagaactacttcctgagcatcctgcagcacttcctgctgatcagaaacgactactacatcagaccccagtactacaagatcatcgaggagtgcgtgagccagatcgtgctgcactgcagcggcatggaccccgacttcaagtacagacagagactggacatcgacctgacccacctgatcgacagctgcgtgaacaaggccaaggtggaggagagcgagcagaaggccgccgagttcagcaagaagttcgacgaggagttcaccgccagacaggaggcccaggccgagctgcagaagagagacgagaagatcaaggagctggaggccgagatccagcagctgagaacccaggcccaggtgctgagcagcagcagcggcatccccggcccccccgccgccccccccctgcccggcgtgggcccccccccccccccccccgccccccccctgcccggcggcgcccccctgccccccccccccccccccctgcccggcatgatgggcatccccccccccccccccccccccctgctgttcggcggcccccccccccccccccccctgggcggcgtgccccccccccccggcatcagcctgaacctgccctacggcatgaagcagaagaagatgtacaagcccgaggtgagcatgaagagaatcaactggagcaagatcgagcccaccgagctgagcgagaactgcttctggctgagagtgaaggaggacaagttcgagaaccccgacctgttcgccaagctggccctgaacttcgccacccagatcaaggtgcagaagaacgccgaggccctggaggagaagaagaccggccccaccaagaagaaggtgaaggagctgagaatcctggaccccaagaccgcccagaacctgagcatcttcctgggcagctacagaatgccctacgaggacatcagaaacgtgatcctggaggtgaacgaggacatgctgagcgaggccctgatccagaacctggtgaagcacctgcccgagcagaagatcctgaacgagctggccgagctgaagaacgagtacgacgacctgtgcgagcccgagcagttcggcgtggtgatgagcagcgtgaagatgctgcagcccagactgagcagcatcctgttcaagctgaccttcgaggagcacatcaacaacatcaagcccagcatcatcgccgtgaccctggcctgcgaggagctgaagaagagcgagagcttcaacagactgctggagctggtgctgctggtgggcaactacatgaacagcggcagcagaaacgcccagagcctgggcttcaagatcaacttcctgtgcaagatcagagacaccaagagcgccgaccagaagaccaccctgctgcacttcatcgccgacatctgcgaggagaagtacagagacatcctgaagttccccgaggagctggagcacgtggagagcgccagcaaggtgagcgcccagatcctgaagagcaacctggccagcatggagcagcagatcgtgcacctggagagagacatcaagaagttcccccaggccgagaaccagcacgacaagttcgtggagaagatgaccatcttcaccaagaccgccagagagcagtacgagaagctgagcaccatgcacaacaacatgatgaagctgtacgagaacctgggcgagtacttcatcttcgacagcaagaccgtgagcatcgaggagttcttcggcgacctgaacaacttcagaaccctgttcctggaggccgtgagagagaacaacaagagaagagagatggaggagaagaccagaagagccaagctggccaaggagaaggccgagcaggagaagctggagagacagaagaagaagaagcagctgatcgacatcaacaaggagggcgacgagaccggcgtgatggacaacctgctggaggccctgcagagcggcgccgccttcagagacagaagaaagagaatccccagaaaccccgtggtgaaccacccctgcgccaccagagccaaccccagaagcgccacctag

SEQ ID NO: 79126 - DNA, 3291 bp, Artificial Sequence
  Description of Artificial Sequence: Synthetic coding sequence
atggagcagcccggcgccgccgccagcggcgccggcggcggcagcgaggagcccggcggcggcagaagcaacaagagaagcgccggcaacagagccgccaacgaggaggagaccaagaacaagcccaagctgaacatccagatcaagaccctggccgacgacgtgagagacagaatcaccagcttcagaaagagcaccgtgaagaaggagaagcccctgatccagcaccccatcgacagccaggtggccatgagcgagttccccgccgcccagcccctgtacgacgagagaagcctgaacctgagcgagaaggaggtgctggacctgttcgagaagatgatggaggacatgaacctgaacgaggagaagaaggcccccctgagaaacaaggacttcaccaccaagagagagatggtggtgcagtacatcagcgccaccgccaagagcggcggcctgaagaacagcaagcacgagtgcaccctgagcagccaggagtacgtgcacgagctgagaagcggcatcagcgacgagaagctgctgaactgcctggagagcctgagagtgagcctgaccagcaaccccgtgagctgggtgaacaacttcggccacgagggcctgggcctgctgctggacgagctggagaagctgctggacaagaagcagcaggagaacatcgacaagaagaaccagtacaagctgatccagtgcctgaaggccttcatgaacaacaagttcggcctgcagagaatcctgggcgacgagagaagcctgctgctgctggccagagccatcgaccccaagcagcccaacatgatgaccgagatcgtgaagatcctgagcgccatctgcatcgtgggcgaggagaacatcctggacaagctgctgggcgccatcaccaccgccgccgagagaaacaacagagagagattcagccccatcgtggagggcctggagaaccaggaggccctgcagctgcaggtggcctgcatgcagttcatcaacgccctggtgaccagcccctacgagctggacttcagaatccacctgagaaacgagttcctgagaagcggcctgaagaccatgctgcccgacctgaaggagaaggagaacgacgagctggacatccagctgaaggtgttcgacgagaacaaggaggacgacctgaccgagctgagccacagactgaacgacatcagagccgagatggacgacatgaacgaggtgtaccacctgctgtacaacatgctgaaggacaccgccgccgagaactacttcctgagcatcctgcagcacttcctgctgatcagaaacgactactacatcagaccccagtactacaagatcatcgaggagtgcgtgagccagatcgtgctgcactgcagcggcatggaccccgacttcaagtacagacagagactggacatcgacctgacccacctgatcgacagctgcgtgaacaaggccaaggtggaggagagcgagcagaaggccgccgagttcagcaagaagttcgacgaggagttcaccgccagacaggaggcccaggccgagctgcagaagagagacgagaagatcaaggagctggaggccgagatccagcagctgagaacccaggcccaggtgctgagcagcagcagcggcatccccggcccccccgccgccccccccctgcccggcgtgggcccccccccccccccccccgccccccccctgcccggcggcgcccccctgccccccccccccccccccctgcccggcatgatgggcatccccccccccccccccccccccctgctgttcggcggcccccccccccccccccccctgggcggcgtgccccccccccccggcatcagcctgaacctgccctacggcatgaagcagaagaagatgtacaagcccgaggtgagcatgaagagaatcaactggagcaagatcgagcccaccgagctgagcgagaactgcttctggctgagagtgaaggaggacaagttcgagaaccccgacctgttcgccaagctggccctgaacttcgccacccagatcaaggtgcagaagaacgccgaggccctggaggagaagaagaccggccccaccaagaagaaggtgaaggagctgagaatcctggaccccaagaccgcccagaacctgagcatcttcctgggcagctacagaatgccctacgaggacatcagaaacgtgatcctggaggtgaacgaggacatgctgagcgaggccctgatccagaacctggtgaagcacctgcccgagcagaagatcctgaacgagctggccgagctgaagaacgagtacgacgacctgtgcgagcccgagcagttcggcgtggtgatgagcagcgtgaagatgctgcagcccagactgagcagcatcctgttcaagctgaccttcgaggagcacatcaacaacatcaagcccagcatcatcgccgtgaccctggcctgcgaggagctgaagaagagcgagagcttcaacagactgctggagctggtgctgctggtgggcaactacatgaacagcggcagcagaaacgcccagagcctgggcttcaagatcaacttcctgtgcaagatcagagacaccaagagcgccgaccagaagaccaccctgctgcacttcatcgccgacatctgcgaggagaagtacagagacatcctgaagttccccgaggagctggagcacgtggagagcgccagcaaggtgagcgcccagatcctgaagagcaacctggccagcatggagcagcagatcgtgcacctggagagagacatcaagaagttcccccaggccgagaaccagcacgacaagttcgtggagaagatgaccagcttcaccaagaccgccagagagcagtacgagaagctgagcaccatgcacaacaacatgatgaagctgtacgagaacctgggcgagtacttcatcttcgacagcaagaccgtgagcatcgaggagttcttcggcgacctgaacaacttcagaaccctgttcctggaggccgtgagagagaacaacaagagaagagagatggaggagaagaccagaagagccaagctggccaaggagaaggccgagcaggagaagctggagagacagaagaagaagaagcagctgatcgacatcaacaaggagggcgacgagaccggcgtgatggacaacctgctggaggccctgcagagcggcgccgccttcagagacagaagaaagagaatccccagaaaccccgtggtgaaccacccctgcgccaccagagccaaccccagaagcgccacctag

SEQ ID NO: 79127 - DNA, 3294 bp, Artificial Sequence
  Description of Artificial Sequence: Synthetic coding sequence
atggagcagcccggcgccgccgccagcggcgccggcggcggcagcgaggagcccggcggcggcagaagcaacaagagaagcgccggcaacagagccgccaacgaggaggagaccaagaacaagcccaagctgagagacagaatcaccagcttcagaaagagcaccgtgaagaaggagaagcccctgatccagcaccccatcgacagccaggtggccatgagcgagttccccgccgcccagcccctgtacgacgagagaagcctgaacctgagcgagaaggaggtgctggacctgttcgagaagatgatggaggacatgaacctgaacgaggagaagaaggcccccctgagaaacaaggacttcaccaccaagagagagatggtggtgcagtacatcagcgccaccgccaagagcgtgatcagcagccacatcaagggcggcctgaagaacagcaagcacgagtgcaccctgagcagccaggagtacgtgcacgagctgagaagcggcatcagcgacgagaagctgctgaactgcctggagagcctgagagtgagcctgaccagcaaccccgtgagctgggtgaacaacttcggccacgagggcctgggcctgctgctggacgagctggagaagctgctggacaagaagcagcaggagaacatcgacaagaagaaccagtacaagctgatccagtgcctgaaggccttcatgaacaacaagttcggcctgcagagaatcctgggcgacgagagaagcctgctgctgctggccagagccatcgaccccaagcagcccaacatgatgaccgagatcgtgaagatcctgagcgccatctgcatcgtgggcgaggagaacatcctggacaagctgctgggcgccatcaccaccgccgccgagagaaacaacagagagagattcagccccatcgtggagggcctggagaaccaggaggccctgcagctgcaggtggcctgcatgcagttcatcaacgccctggtgaccagcccctacgagctggacttcagaatccacctgagaaacgagttcctgagaagcggcctgaagaccatgctgcccgacctgaaggagaaggagaacgacgagctggacatccagctgaaggtgttcgacgagaacaaggaggacgacctgaccgagctgagccacagactgaacgacatcagagccgagatggacgacatgaacgaggtgtaccacctgctgtacaacatgctgaaggacaccgccgccgagaactacttcctgagcatcctgcagcacttcctgctgatcagaaacgactactacatcagaccccagtactacaagatcatcgaggagtgcgtgagccagatcgtgctgcactgcagcggcatggaccccgacttcaagtacagacagagactggacatcgacctgacccacctgatcgacagctgcgtgaacaaggccaaggtggaggagagcgagcagaaggccgccgagttcagcaagaagttcgacgaggagttcaccgccagacaggaggcccaggccgagctgcagaagagagacgagaagatcaaggagctggaggccgagatccagcagctgagaacccaggcccaggtgctgagcagcagcagcggcatccccggcccccccgccgccccccccctgcccggcgtgggcccccccccccccccccccgccccccccctgcccggcggcgcccccctgccccccccccccccccccctgcccggcatgatgggcatccccccccccccccccccccccctgctgttcggcggcccccccccccccccccccctgggcggcgtgccccccccccccggcatcagcctgaacctgccctacggcatgaagcagaagaagatgtacaagcccgaggtgagcatgaagagaatcaactggagcaagatcgagcccaccgagctgagcgagaactgcttctggctgagagtgaaggaggacaagttcgagaaccccgacctgttcgccaagctggccctgaacttcgccacccagatcaaggtgcagaagaacgccgaggccctggaggagaagaagaccggccccaccaagaagaaggtgaaggagctgagaatcctggaccccaagaccgcccagaacctgagcatcttcctgggcagctacagaatgccctacgaggacatcagaaacgtgatcctggaggtgaacgaggacatgctgagcgaggccctgatccagaacctggtgaagcacctgcccgagcagaagatcctgaacgagctggccgagctgaagaacgagtacgacgacctgtgcgagcccgagcagttcggcgtggtgatgagcagcgtgaagatgctgcagcccagactgagcagcatcctgttcaagctgaccttcgaggagcacatcaacaacatcaagcccagcatcatcgccgtgaccctggcctgcgaggagctgaagaagagcgagagcttcaacagactgctggagctggtgctgctggtgggcaactacatgaacagcggcagcagaaacgcccagagcctgggcttcaagatcaacttcctgtgcaagatcagagacaccaagagcgccgaccagaagaccaccctgctgcacttcatcgccgacatctgcgaggagaagtacagagacatcctgaagttccccgaggagctggagcacgtggagagcgccagcaaggtgagcgcccagatcctgaagagcaacctggccagcatggagcagcagatcgtgcacctggagagagacatcaagaagttcccccaggccgagaaccagcacgacaagttcgtggagaagatgaccatcttcaccaagaccgccagagagcagtacgagaagctgagcaccatgcacaacaacatgatgaagctgtacgagaacctgggcgagtacttcatcttcgacagcaagaccgtgagcatcgaggagttcttcggcgacctgaacaacttcagaaccctgttcctggaggccgtgagagagaacaacaagagaagagagatggaggagaagaccagaagagccaagctggccaaggagaaggccgagcaggagaagctggagagacagaagaagaagaagcagctgatcgacatcaacaaggagggcgacgagaccggcgtgatggacaacctgctggaggccctgcagagcggcgccgccttcagagacagaagaaagagaatccccagaaaccccgacaacagaagagtgcccctggagagaagcagaagcagacacaacggcgccatcagcagcaagtag

SEQ ID NO: 79128 - DNA, 3306 bp, Artificial Sequence
  Description of Artificial Sequence: Synthetic coding sequence
atggagcagcccggcgccgccgccagcggcgccggcggcggcagcgaggagcccggcggcggcagaagcaacaagagaagcgccggcaacagagccgccaacgaggaggagaccaagaacaagcccaagctgaacatccagatcaagaccctggccgacgacgtgagagacagaatcaccagcttcagaaagagcaccgtgaagaaggagaagcccctgatccagcaccccatcgacagccaggtggccatgagcgagttccccgccgcccagcccctgtacgacgagagaagcctgaacctgagcgagaaggaggtgctggacctgttcgagaagatgatggaggacatgaacctgaacgaggagaagaaggcccccctgagaaacaaggacttcaccaccaagagagagatggtggtgcagtacatcagcgccaccgccaagagcggcggcctgaagaacagcaagcacgagtgcaccctgagcagccaggagtacgtgcacgagctgagaagcggcatcagcgacgagaagctgctgaactgcctggagagcctgagagtgagcctgaccagcaaccccgtgagctgggtgaacaacttcggccacgagggcctgggcctgctgctggacgagctggagaagctgctggacaagaagcagcaggagaacatcgacaagaagaaccagtacaagctgatccagtgcctgaaggccttcatgaacaacaagttcggcctgcagagaatcctgggcgacgagagaagcctgctgctgctggccagagccatcgaccccaagcagcccaacatgatgaccgagatcgtgaagatcctgagcgccatctgcatcgtgggcgaggagaacatcctggacaagctgctgggcgccatcaccaccgccgccgagagaaacaacagagagagattcagccccatcgtggagggcctggagaaccaggaggccctgcagctgcaggtggcctgcatgcagttcatcaacgccctggtgaccagcccctacgagctggacttcagaatccacctgagaaacgagttcctgagaagcggcctgaagaccatgctgcccgacctgaaggagaaggagaacgacgagctggacatccagctgaaggtgttcgacgagaacaaggaggacgacctgaccgagctgagccacagactgaacgacatcagagccgagatggacgacatgaacgaggtgtaccacctgctgtacaacatgctgaaggacaccgccgccgagaactacttcctgagcatcctgcagcacttcctgctgatcagaaacgactactacatcagaccccagtactacaagatcatcgaggagtgcgtgagccagatcgtgctgcactgcagcggcatggaccccgacttcaagtacagacagagactggacatcgacctgacccacctgatcgacagctgcgtgaacaaggccaaggtggaggagagcgagcagaaggccgccgagttcagcaagaagttcgacgaggagttcaccgccagacaggaggcccaggccgagctgcagaagagagacgagaagatcaaggagctggaggccgagatccagcagctgagaacccaggcccaggtgctgagcagcagcagcggcatccccggcccccccgccgccccccccctgcccggcgtgggcccccccccccccccccccgccccccccctgcccggcggcgcccccctgccccccccccccccccccctgcccggcatgatgggcatccccccccccccccccccccccctgctgttcggcggcccccccccccccccccccctgggcggcgtgccccccccccccggcatcagcctgaacctgccctacggcatgaagcagaagaagatgtacaagcccgaggtgagcatgaagagaatcaactggagcaagatcgagcccaccgagctgagcgagaactgcttctggctgagagtgaaggaggacaagttcgagaaccccgacctgttcgccaagctggccctgaacttcgccacccagatcaaggtgcagaagaacgccgaggccctggaggagaagaagaccggccccaccaagaagaaggtgaaggagctgagaatcctggaccccaagaccgcccagaacctgagcatcttcctgggcagctacagaatgccctacgaggacatcagaaacgtgatcctggaggtgaacgaggacatgctgagcgaggccctgatccagaacctggtgaagcacctgcccgagcagaagatcctgaacgagctggccgagctgaagaacgagtacgacgacctgtgcgagcccgagcagttcggcgtggtgatgagcagcgtgaagatgctgcagcccagactgagcagcatcctgttcaagctgaccttcgaggagcacatcaacaacatcaagcccagcatcatcgccgtgaccctggcctgcgaggagctgaagaagagcgagagcttcaacagactgctggagctggtgctgctggtgggcaactacatgaacagcggcagcagaaacgcccagagcctgggcttcaagatcaacttcctgtgcaagatcagagacaccaagagcgccgaccagaagaccaccctgctgcacttcatcgccgacatctgcgaggagaagtacagagacatcctgaagttccccgaggagctggagcacgtggagagcgccagcaaggtgagcgcccagatcctgaagagcaacctggccagcatggagcagcagatcgtgcacctggagagagacatcaagaagttcccccaggccgagaaccagcacgacaagttcgtggagaagatgaccatcttcaccaagaccgccagagagcagtacgagaagctgagcaccatgcacaacaacatgatgaagctgtacgagaacctgggcgagtacttcatcttcgacagcaagaccgtgagcatcgaggagttcttcggcgacctgaacaacttcagaaccctgttcctggaggccgtgagagagaacaacaagagaagagagatggaggagaagaccagaagagccaagctggccaaggagaaggccgagcaggagaagctggagagacagaagaagaagaagcagctgatcgacatcaacaaggagggcgacgagaccggcgtgatggacaacctgctggaggccctgcagagcggcgccgccttcagagacagaagaaagagaatccccagaaaccccgacaacagaagagtgcccctggagagaagcagaagcagacacaacggcgccatcagcagcaagtag

SEQ ID NO: 79129 - DNA, 3312 bp, Artificial Sequence
  Description of Artificial Sequence: Synthetic coding sequence
atggagcagcccggcgccgccgccagcggcgccggcggcggcagcgaggagcccggcggcggcagaagcaacaagagaagcgccggcaacagagccgccaacgaggaggagaccaagaacaagcccaagctgaacatccagatcaagaccctggccgacgacgtgagagacagaatcaccagcttcagaaagagcaccgtgaagaaggagaagcccctgatccagcaccccatcgacagccaggtggccatgagcgagttccccgccgcccagcccctgtacgacgagagaagcctgaacctgagcgagaaggaggtgctggacctgttcgagaagatgatggaggacatgaacctgaacgaggagaagaaggcccccctgagaaacaaggacttcaccaccaagagagagatggtggtgcagtacatcagcgccaccgccaagagcatcgtgggcagcaaggtgaccggcggcctgaagaacagcaagcacgagtgcaccctgagcagccaggagtacgtgcacgagctgagaagcggcatcagcgacgagaagctgctgaactgcctggagagcctgagagtgagcctgaccagcaaccccgtgagctgggtgaacaacttcggccacgagggcctgggcctgctgctggacgagctggagaagctgctggacaagaagcagcaggagaacatcgacaagaagaaccagtacaagctgatccagtgcctgaaggccttcatgaacaacaagttcggcctgcagagaatcctgggcgacgagagaagcctgctgctgctggccagagccatcgaccccaagcagcccaacatgatgaccgagatcgtgaagatcctgagcgccatctgcatcgtgggcgaggagaacatcctggacaagctgctgggcgccatcaccaccgccgccgagagaaacaacagagagagattcagccccatcgtggagggcctggagaaccaggaggccctgcagctgcaggtggcctgcatgcagttcatcaacgccctggtgaccagcccctacgagctggacttcagaatccacctgagaaacgagttcctgagaagcggcctgaagaccatgctgcccgacctgaaggagaaggagaacgacgagctggacatccagctgaaggtgttcgacgagaacaaggaggacgacctgaccgagctgagccacagactgaacgacatcagagccgagatggacgacatgaacgaggtgtaccacctgctgtacaacatgctgaaggacaccgccgccgagaactacttcctgagcatcctgcagcacttcctgctgatcagaaacgactactacatcagaccccagtactacaagatcatcgaggagtgcgtgagccagatcgtgctgcactgcagcggcatggaccccgacttcaagtacagacagagactggacatcgacctgacccacctgatcgacagctgcgtgaacaaggccaaggtggaggagagcgagcagaaggccgccgagttcagcaagaagttcgacgaggagttcaccgccagacaggaggcccaggccgagctgcagaagagagacgagaagatcaaggagctggaggccgagatccagcagctgagaacccaggcccaggtgctgagcagcagcagcggcatccccggcccccccgccgccccccccctgcccggcgtgggcccccccccccccccccccgccccccccctgcccggcggcgcccccctgccccccccccccccccccctgcccggcatgatgggcatccccccccccccccccccccccctgctgttcggcggcccccccccccccccccccctgggcggcgtgccccccccccccggcatcagcctgaacctgccctacggcatgaagcagaagaagatgtacaagcccgaggtgagcatgaagagaatcaactggagcaagatcgagcccaccgagctgagcgagaactgcttctggctgagagtgaaggaggacaagttcgagaaccccgacctgttcgccaagctggccctgaacttcgccacccagatcaaggtgcagaagaacgccgaggccctggaggagaagaagaccggccccaccaagaagaaggtgaaggagctgagaatcctggaccccaagaccgcccagaacctgagcatcttcctgggcagctacagaatgccctacgaggacatcagaaacgtgatcctggaggtgaacgaggacatgctgagcgaggccctgatccagaacctggtgaagcacctgcccgagcagaagatcctgaacgagctggccgagctgaagaacgagtacgacgacctgtgcgagcccgagcagttcggcgtggtgatgagcagcgtgaagatgctgcagcccagactgagcagcatcctgttcaagctgaccttcgaggagcacatcaacaacatcaagcccagcatcatcgccgtgaccctggcctgcgaggagctgaagaagagcgagagcttcaacagactgctggagctggtgctgctggtgggcaactacatgaacagcggcagcagaaacgcccagagcctgggcttcaagatcaacttcctgtgcaagatcagagacaccaagagcgccgaccagaagaccaccctgctgcacttcatcgccgacatctgcgaggagaagtacagagacatcctgaagttccccgaggagctggagcacgtggagagcgccagcaaggtgagcgcccagatcctgaagagcaacctggccagcatggagcagcagatcgtgcacctggagagagacatcaagaagttcccccaggccgagaaccagcacgacaagttcgtggagaagatgaccatcttcaccaagaccgccagagagcagtacgagaagctgagcaccatgcacaacaacatgatgaagctgtacgagaacctgggcgagtacttcatcttcgacagcaagaccgtgagcatcgaggagttcttcggcgacctgaacaacttcagaaccctgttcctggaggccgtgagagagaacaacaagagaagagagatggaggagaagaccagaagagccaagctggccaaggagaaggccgagcaggagaagctggagagacagaagaagaagaagcagctgatcgacatcaacaaggagggcgacgagaccggcgtgatggacaacctgctggaggccctgcagagcggcgccgccttcagagacagaagaaagagaatccccagaaaccccgtggtgaaccacccctgcgccaccagagccaaccccagaagcgccacctag

SEQ ID NO: 79130 - DNA, 735 bp, Artificial Sequence
  Description of Artificial Sequence: Synthetic coding sequence
atggagctgttcctggccggcagaagagtgctggtgaccggcgccggcaagggcatcggcagaggcaccgtgcaggccctgcacgccaccggcgccagagtggtggccgtgagcagaacccaggccgacctggacagcctggtgagagagtgccccggcatcgagcccgtgtgcgtggacctgggcgactgggaggccaccgagagagccctgggcagcgtgggccccgtggacctgctggtgaacaacgccgccgtggccctgctgcagcccttcctggaggtgaccaaggaggccttcgacagaagcttcgaggtgaacctgagagccgtgatccaggtgagccagatcgtggccagaggcctgatcgccagaggcgtgcccggcgccatcgtgaacgtgagcagccagtgcagccagagagccgtgaccaaccacagcgtgtactgcagcaccaagggcgccctggacatgctgaccaaggtgatggccctggagctgggcccccacaagatcagagtgaacgccgtgaaccccaccgtggtgatgaccagcatgggccaggccacctggagcgacccccacaaggccaagaccatgctgaacagaatccccctgggcaagttcgccgaggtggagcacgtggtgaacgccatcctgttcctgctgagcgacagaagcggcatgaccaccggcagcaccctgcccgtggagggcggcttctgggcctgctag

SEQ ID NO: 79131 - DNA, 5769 bp, Artificial Sequence
  Description of Artificial Sequence: Synthetic coding sequence
atgaagagccccgccctgcagcccctgagcatggccggcctgcagctgatgacccccgccagcagccccatgggccccttcttcggcctgccctggcagcaggaggccatccacgacaacatctacacccccagaaagtaccaggtggagctgctggaggccgccctggaccacaacaccatcgtgtgcctgaacaccggcagcggcaagaccttcatcgccgtgctgctgaccaaggagctgagctaccagatcagaggcgacttcagcagaaacggcaagagaaccgtgttcctggtgaacagcgccaaccaggtggcccagcaggtgagcgccgtgagaacccacagcgacctgaaggtgggcgagtacagcaacctggaggtgaacgccagctggaccaaggagagatggaaccaggagttcaccaagcaccaggtgctgatcatgacctgctacgtggccctgaacgtgctgaagaacggctacctgagcctgagcgacatcaacctgctggtgttcgacgagtgccacctggccatcctggaccacccctacagagagatcatgaagctgtgcgagaactgccccagctgccccagaatcctgggcctgaccgccagcatcctgaacggcaagtgcgaccccgaggagctggaggagaagatccagaagctggagaagatcctgaagagcaacgccgagaccgccaccgacctggtggtgctggacagatacaccagccagccctgcgagatcgtggtggactgcggccccttcaccgacagaagcggcctgtacgagagactgctgatggagctggaggaggccctgaacttcatcaacgactgcaacatcagcgtgcacagcaaggagagagacagcaccctgatcagcaagcagatcctgagcgactgcagagccgtgctggtggtgctgggcccctggtgcgccgacaaggtggccggcatgatggtgagagagctgcagaagtacatcaagcacgagcaggaggagctgcacagaaagttcctgctgttcaccgacaccttcctgagaaagatccacgccctgtgcgaggagcacttcagccccgccagcctggacctgaagttcgtgacccccaaggtgatcaagctgctggagatcctgagaaagtacaagccctacgagagacagcagttcgagagcgtggagtggtacaacaacagaaaccaggacaactacgtgagctggagcgacagcgaggacgacgacgaggacgaggagatcgaggagaaggagaagcccgagaccaacttccccagccccttcaccaacatcctgtgcggcatcatcttcgtggagagaagatacaccgccgtggtgctgaacagactgatcaaggaggccggcaagcaggaccccgagctggcctacatcagcagcaacttcatcaccggccacggcatcggcaagaaccagcccagaaacaagcagatggaggccgagttcagaaagcaggaggaggtgctgagaaagttcagagcccacgagaccaacctgctgatcgccaccagcatcgtggaggagggcgtggacatccccaagtgcaacctggtggtgagattcgacctgcccaccgagtacagaagctacgtgcagagcaagggcagagccagagcccccatcagcaactacatcatgctggccgacaccgacaagatcaagagcttcgaggaggacctgaagacctacaaggccatcgagaagatcctgagaaacaagtgcagcaagagcgtggacaccggcgagaccgacatcgaccccgtgatggacgacgacgacgtgttccccccctacgtgctgagacccgacgacggcggccccagagtgaccatcaacaccgccatcggccacatcaacagatactgcgccagactgcccagcgaccccttcacccacctggcccccaagtgcagaaccagagagctgcccgacggcaccttctacagcaccctgtacctgcccatcaacagccccctgagagccagcatcgtgggcccccccatgagctgcgtgagactggccgagagagtggtggccctgatctgctgcgagaagctgcacaagatcggcgagctggacgaccacctgatgcccgtgggcaaggagaccgtgaagtacgaggaggagctggacctgcacgacgaggaggagaccagcgtgcccggcagacccggcagcaccaagagaagacagtgctaccccaaggccatccccgagtgcctgagagacagctaccccagacccgaccagccctgctacctgtacgtgatcggcatggtgctgaccacccccctgcccgacgagctgaacttcagaagaagaaagctgtacccccccgaggacaccaccagatgcttcggcatcctgaccgccaagcccatcccccagatcccccacttccccgtgtacaccagaagcggcgaggtgaccatcagcatcgagctgaagaagagcggcttcatgctgagcctgcagatgctggagctgatcaccagactgcaccagtacatcttcagccacatcctgagactggagaagcccgccctggagttcaagcccaccgacgccgacagcgcctactgcgtgctgcccctgaacgtggtgaacgacagcagcaccctggacatcgacttcaagttcatggaggacatcgagaagagcgaggccagaatcggcatccccagcaccaagtacaccaaggagacccccttcgtgttcaagctggaggactaccaggacgccgtgatcatccccagatacagaaacttcgaccagccccacagattctacgtggccgacgtgtacaccgacctgacccccctgagcaagttccccagccccgagtacgagaccttcgccgagtactacaagaccaagtacaacctggacctgaccaacctgaaccagcccctgctggacgtggaccacaccagcagcagactgaacctgctgacccccagacacctgaaccagaagggcaaggccctgcccctgagcagcgccgagaagagaaaggccaagtgggagagcctgcagaacaagcagatcctggtgcccgagctgtgcgccatccaccccatccccgccagcctgtggagaaaggccgtgtgcctgcccagcatcctgtacagactgcactgcctgctgaccgccgaggagctgagagcccagaccgccagcgacgccggcgtgggcgtgagaagcctgcccgccgacttcagataccccaacctggacttcggctggaagaagagcatcgacagcaagagcttcatcagcatcagcaacagcagcagcgccgagaacgacaactactgcaagcacagcaccatcgtgcccgagaacgccgcccaccagggcgccaacagaaccagcagcctggagaaccacgaccagatgagcgtgaactgcagaaccctgctgagcgagagccccggcaagctgcacgtggaggtgagcgccgacctgaccgccatcaacggcctgagctacaaccagaacctggccaacggcagctacgacctggccaacagagacttctgccagggcaaccagctgaactactacaagcaggagatccccgtgcagcccaccaccagctacagcatccagaacctgtacagctacgagaaccagccccagcccagcgacgagtgcaccctgctgagcaacaagtacctggacggcaacgccaacaagagcaccagcgacggcagccccgtgatggccgtgatgcccggcaccaccgacaccatccaggtgctgaagggcagaatggacagcgagcagagccccagcatcggctacagcagcagaaccctgggccccaaccccggcctgatcctgcaggccctgaccctgagcaacgccagcgacggcttcaacctggagagactggagatgctgggcgacagcttcctgaagcacgccatcaccacctacctgttctgcacctaccccgacgcccacgagggcagactgagctacatgagaagcaagaaggtgagcaactgcaacctgtacagactgggcaagaagaagggcctgcccagcagaatggtggtgagcatcttcgacccccccgtgaactggctgccccccggctacgtggtgaaccaggacaagagcaacaccgacaagtgggagaaggacgagatgaccaaggactgcatgctggccaacggcaagctggacgaggactacgaggaggaggacgaggaggaggagagcctgatgtggagagcccccaaggaggaggccgactacgaggacgacttcctggagtacgaccaggagcacatcagattcatcgacaacatgctgatgggcagcggcgccttcgtgaagaagatcagcctgagccccttcagcaccaccgacagcgcctacgagtggaagatgcccaagaagagcagcctgggcagcatgcccttcagcagcgacttcgaggacttcgactacagcagctgggacgccatgtgctacctggaccccagcaaggccgtggaggaggacgacttcgtggtgggcttctggaaccccagcgaggagaactgcggcgtggacaccggcaagcagagcatcagctacgacctgcacaccgagcagtgcatcgccgacaagagcatcgccgactgcgtggaggccctgctgggctgctacctgaccagctgcggcgagagagccgcccagctgttcctgtgcagcctgggcctgaaggtgctgcccgtgatcaagagaaccgacagagagaaggccctgtgccccaccagagagaacttcaacagccagcagaagaacctgagcgtgagctgcgccgccgccagcgtggccagcagcagaagcagcgtgctgaaggacagcgagtacggctgcctgaagatcccccccagatgcatgttcgaccaccccgacgccgacaagaccctgaaccacctgatcagcggcttcgagaacttcgagaagaagatcaactacagattcaagaacaaggcctacctgctgcaggccttcacccacgccagctaccactacaacaccatcaccgactgctaccagagactggagttcctgggcgacgccatcctggactacctgatcaccaagcacctgtacgaggaccccagacagcacagccccggcgtgctgaccgacctgagaagcgccctggtgaacaacaccatcttcgccagcctggccgtgaagtacgactaccacaagtacttcaaggccgtgagccccgagctgttccacgtgatcgacgacttcgtgcagttccagctggagaagaacgagatgcagggcatggacagcgagctgagaagaagcgaggaggacgaggagaaggaggaggacatcgaggtgcccaaggccatgggcgacatcttcgagagcctggccggcgccatctacatggacagcggcatgagcctggagaccgtgtggcaggtgtactaccccatgatgagacccctgatcgagaagttcagcgccaacgtgcccagaagccccgtgagagagctgctggagatggagcccgagaccgccaagttcagccccgccgagagaacctacgacggcaaggtgagagtgaccgtggaggtggtgggcaagggcaagttcaagggcgtgggcagaagctacagaatcgccaagagcgccgccgccagaagagccctgagaagcctgaaggccaaccagccccaggtgcccaacagctag

SEQ ID NO: 79132 - DNA, 5769 bp, Artificial Sequence; identical to SEQ ID NO: 79131
  Description of Artificial Sequence: Synthetic coding sequence

SEQ ID NO: 79133 - DNA, 5769 bp, Artificial Sequence; identical to SEQ ID NO: 79131
  Description of Artificial Sequence: Synthetic coding sequence

SEQ ID NO: 79134 - DNA, 5769 bp, Artificial Sequence; identical to SEQ ID NO: 79131
  Description of Artificial Sequence: Synthetic coding sequence

SEQ ID NO: 79135 - DNA, 213 bp, Artificial Sequence
  Description of Artificial Sequence: Synthetic coding sequence
atgaagagccccgccctgcagcccctgagcatggccggcctgcagctgatgacccccgccagcagccccatgggccccttcttcggcctgccctggcagcaggaggccatccacgacaacatctacacccccagaaagtaccaggtggagctgctggaggccgccctggaccacaacaccatcgtgtgcctgaacaccggcagcggcaagtag

SEQ ID NO: 79136 - DNA, 213 bp, Artificial Sequence; identical to SEQ ID NO: 79135
  Description of Artificial Sequence: Synthetic coding sequence

SEQ ID NO: 79137 - DNA, 5490 bp, Artificial Sequence
  Description of Artificial Sequence: Synthetic coding sequence
atgaagagccccgccctgcagcccctgagcatggccggcctgcagctgatgacccccgccagcagccccatgggccccttcttcggcctgccctggcagcaggaggccatccacgacaacatctacacccccagaaagtaccaggtggagctgctggaggccgccctggaccacaacaccatcgtgtgcctgaacaccggcagcggcaagaccttcatcgccgtgctgctgaccaaggagctgagctaccagatcagaggcgacttcagcagaaacggcaagagaaccgtgttcctggtgaacagcgccaaccaggtggcccagcaggtgagcgccgtgagaacccacagcgacctgaaggtgggcgagtacagcaacctggaggtgaacgccagctggaccaaggagagatggaaccaggagttcaccaagcaccaggtgctgatcatgacctgctacgtggccctgaacgtgctgaagaacggctacctgagcctgagcgacatcaacctgctggtgttcgacgagtgccacctggccatcctggaccacccctacagagagatcatgaagctgtgcgagaactgccccagctgccccagaatcctgggcctgaccgccagcatcctgaacggcaagtgcgaccccgaggagctggaggagaagatccagaagctggagaagatcctgaagagcaacgccgagaccgccaccgacctggtggtgctggacagatacaccagccagccctgcgagatcgtggtggactgcggccccttcaccgacagaagcggcctgtacgagagactgctgatggagctggaggaggccctgaacttcatcaacgactgcaacatcagcgtgcacagcaaggagagagacagcaccctgatcagcaagcagatcctgagcgactgcagagccgtgctggtggtgctgggcccctggtgcgccgacaaggtggccggcatgatggtgagagagctgcagaagtacatcaagcacgagcaggaggagctgcacagaaagttcctgctgttcaccgacaccttcctgagaaagatccacgccctgtgcgaggagcacttcagccccgccagcctggacctgaagttcgtgacccccaaggtgatcaagctgctggagatcctgagaaagtacaagccctacgagagacagcagttcgagagcgtggagtggtacaacaacagaaaccaggacaactacgtgagctggagcgacagcgaggacgacgacgaggacgaggagatcgaggagaaggagaagcccgagaccaacttccccagccccttcaccaacatcctgtgcggcatcatcttcgtggagagaagatacaccgccgtggtgctgaacagactgatcaaggaggccggcaagcaggaccccgagctggcctacatcagcagcaacttcatcaccggccacggcatcggcaagaaccagcccagaaacaagcagatggaggccgagttcagaaagcaggaggaggtgctgagaaagttcagagcccacgagaccaacctgctgatcgccaccagcatcgtggaggagggcgtggacatccccaagtgcaacctggtggtgagattcgacctgcccaccgagtacagaagctacgtgcagagcaagggcagagccagagcccccatcagcaactacatcatgctggccgacaccgacaagatcaagagcttcgaggaggacctgaagacctacaaggccatcgagaagatcctgagaaacaagtgcagcaagagcgtggacaccggcgagaccgacatcgaccccgtgatggacgacgacgacgtgttccccccctacgtgctgagacccgacgacggcggccccagagtgaccatcaacaccgccatcggccacatcaacagatactgcgccagactgcccagcgaccccttcacccacctggcccccaagtgcagaaccagagagctgcccgacggcaccttctacagcaccctgtacctgcccatcaacagccccctgagagccagcatcgtgggcccccccatgagctgcgtgagactggccgagagagtggtggccctgatctgctgcgagaagctgcacaagatcggcgagctggacgaccacctgatgcccgtgggcaaggagaccgtgaagtacgaggaggagctggacctgcacgacgaggaggagaccagcgtgcccggcagacccggcagcaccaagagaagacagtgctaccccaaggccatccccgagtgcctgagagacagctaccccagacccgaccagccctgctacctgtacgtgatcggcatggtgctgaccacccccctgcccgacgagctgaacttcagaagaagaaagctgtacccccccgaggacaccaccagatgcttcggcatcctgaccgccaagcccatcccccagatcccccacttccccgtgtacaccagaagcggcgaggtgaccatcagcatcgagctgaagaagagcggcttcatgctgagcctgcagatgctggagctgatcaccagactgcaccagtacatcttcagccacatcctgagactggagaagcccgccctggagttcaagcccaccgacgccgacagcgcctactgcgtgctgcccctgaacgtggtgaacgacagcagcaccctggacatcgacttcaagttcatggaggacatcgagaagagcgaggccagaatcggcatccccagcaccaagtacaccaaggagacccccttcgtgttcaagctggaggactaccaggacgccgtgatcatccccagatacagaaacttcgaccagccccacagattctacgtggccgacgtgtacaccgacctgacccccctgagcaagttccccagccccgagtacgagaccttcgccgagtactacaagaccaagtacaacctggacctgaccaacctgaaccagcccctgctggacgtggaccacaccagcagcagactgaacctgctgacccccagacacctgaaccagaagggcaaggccctgcccctgagcagcgccgagaagagaaaggccaagtgggagagcctgcagaacaagcagatcctggtgcccgagctgtgcgccatccaccccatccccgccagcctgtggagaaaggccgtgtgcctgcccagcatcctgtacagactgcactgcctgctgaccgccgaggagctgagagcccagaccgccagcgacgccggcgtgggcgtgagaagcctgcccgccgacttcagataccccaacctggacttcggctggaagaagagcatcgacagcaagagcttcatcagcatcagcaacagcagcagcgccgagaacgacaactactgcaagcacagcaccatcgtgcccgagaacgccgcccaccagggcgccaacagaaccagcagcctggagaaccacgaccagatgagcgtgaactgcagaaccctgctgagcgagagccccggcaagctgcacgtggaggtgagcgccgacctgaccgccatcaacggcctgagctacaaccagaacctggccaacggcagctacgacctggccaacagagacttctgccagggcaaccagctgaactactacaagcaggagatccccgtgcagcccaccaccagctacagcatccagaacctgtacagctacgagaaccagccccagcccagcgacgagtgcaccctgctgagcaacaagtacctggacggcaacgccaacaagagcaccagcgacggcagccccgtgatggccgtgatgcccggcaccaccgacaccatccaggtgctgaagggcagaatggacagcgagcagagccccagcatcggctacagcagcagaaccctgggccccaaccccggcctgatcctgcaggccctgaccctgagcaacgccagcgacggcttcaacctggagagactggagatgctgggcgacagcttcctgaagcacgccatcaccacctacctgttctgcacctaccccgacgcccacgagggcagactgagctacatgagaagcaagaaggtgagcaactgcaacctgtacagactgggcaagaagaagggcctgcccagcagaatggtggtgagcatcttcgacccccccgtgaactggctgccccccggctacgtggtgaaccaggacaagagcaacaccgacaagtgggagaaggacgagatgaccaaggactgcatgctggccaacggcaagctggacgaggactacgaggaggaggacgaggaggaggagagcctgatgtggagagcccccaaggaggaggccgactacgaggacgacttcctggagtacgaccaggagcacatcagattcatcgacaacatgctgatgggcagcggcgccttcgtgaagaagatcagcctgagccccttcagcaccaccgacagcgcctacgagtggaagatgcccaagaagagcagcctgggcagcatgcccttcagcagcgacttcgaggacttcgactacagcagctgggacgccatgtgctacctggaccccagcaaggccgtggaggaggacgacttcgtggtgggcttctggaaccccagcgaggagaactgcggcgtggacaccggcaagcagagcatcagctacgacctgcacaccgagcagtgcatcgccgacaagagcatcgccgactgcgtggaggccctgctgggctgctacctgaccagctgcggcgagagagccgcccagctgttcctgtgcagcctgggcctgaaggtgctgcccgtgatcaagagaaccgacagagagaaggccctgtgccccaccagagagaacttcaacagccagcagaagaacctgagcgtgagctgcgccgccgccagcgtggccagcagcagaagcagcgtgctgaaggacagcgagtacggctgcctgaagatcccccccagatgcatgttcgaccaccccgacgccgacaagaccctgaaccacctgatcagcggcttcgagaacttcgagaagaagatcaactacagattcaagaacaaggcctacctgctgcaggccttcacccacgccagctaccactacaacaccatcaccgactgctaccagagactggagttcctgggcgacgccatcctggactacctgatcaccaagcacctgtacgaggaccccagacagcacagccccggcgtgctgaccgacctgagaagcgccctggtgaacaacaccatcttcgccagcctggccgtgaagtacgactaccacaagtacttcaaggccgtgagccccgagctgttccacgtgatcgacgacttcgtgcagttccagctggagaagaacgagatgcagggcatggacagcgagaagagcttcctgcagatgtaccccgtgcccctgtgcgagaactgcctgaagtggaaccagaagctgcccaacctggccagactgagagagctgaccaccggcagaagcgagagcctgtggaagtag

SEQ ID NO: 79138 - DNA, 2463 bp, Artificial Sequence
  Description of Artificial Sequence: Synthetic coding sequence
atgctggcctgggagagcgaccacttcctgagaatcctggccgagaacgacaactactgcaagcacagcaccatcgtgcccgagaacgccgcccaccagggcgccaacagaaccagcagcctggagaaccacgaccagatgagcgtgaactgcagaaccctgctgagcgagagccccggcaagctgcacgtggaggtgagcgccgacctgaccgccatcaacggcctgagctacaaccagaacctggccaacggcagctacgacctggccaacagagacttctgccagggcaaccagctgaactactacaagcaggagatccccgtgcagcccaccaccagctacagcatccagaacctgtacagctacgagaaccagccccagcccagcgacgagtgcaccctgctgagcaacaagtacctggacggcaacgccaacaagagcaccagcgacggcagccccgtgatggccgtgatgcccggcaccaccgacaccatccaggtgctgaagggcagaatggacagcgagcagagccccagcatcggctacagcagcagaaccctgggccccaaccccggcctgatcctgcaggccctgaccctgagcaacgccagcgacggcttcaacctggagagactggagatgctgggcgacagcttcctgaagcacgccatcaccacctacctgttctgcacctaccccgacgcccacgagggcagactgagctacatgagaagcaagaaggtgagcaactgcaacctgtacagactgggcaagaagaagggcctgcccagcagaatggtggtgagcatcttcgacccccccgtgaactggctgccccccggctacgtggtgaaccaggacaagagcaacaccgacaagtgggagaaggacgagatgaccaaggactgcatgctggccaacggcaagctggacgaggactacgaggaggaggacgaggaggaggagagcctgatgtggagagcccccaaggaggaggccgactacgaggacgacttcctggagtacgaccaggagcacatcagattcatcgacaacatgctgatgggcagcggcgccttcgtgaagaagatcagcctgagccccttcagcaccaccgacagcgcctacgagtggaagatgcccaagaagagcagcctgggcagcatgcccttcagcagcgacttcgaggacttcgactacagcagctgggacgccatgtgctacctggaccccagcaaggccgtggaggaggacgacttcgtggtgggcttctggaaccccagcgaggagaactgcggcgtggacaccggcaagcagagcatcagctacgacctgcacaccgagcagtgcatcgccgacaagagcatcgccgactgcgtggaggccctgctgggctgctacctgaccagctgcggcgagagagccgcccagctgttcctgtgcagcctgggcctgaaggtgctgcccgtgatcaagagaaccgacagagagaaggccctgtgccccaccagagagaacttcaacagccagcagaagaacctgagcgtgagctgcgccgccgccagcgtggccagcagcagaagcagcgtgctgaaggacagcgagtacggctgcctgaagatcccccccagatgcatgttcgaccaccccgacgccgacaagaccctgaaccacctgatcagcggcttcgagaacttcgagaagaagatcaactacagattcaagaacaaggcctacctgctgcaggccttcacccacgccagctaccactacaacaccatcaccgactgctaccagagactggagttcctgggcgacgccatcctggactacctgatcaccaagcacctgtacgaggaccccagacagcacagccccggcgtgctgaccgacctgagaagcgccctggtgaacaacaccatcttcgccagcctggccgtgaagtacgactaccacaagtacttcaaggccgtgagccccgagctgttccacgtgatcgacgacttcgtgcagttccagctggagaagaacgagatgcagggcatggacagcgagctgagaagaagcgaggaggacgaggagaaggaggaggacatcgaggtgcccaaggccatgggcgacatcttcgagagcctggccggcgccatctacatggacagcggcatgagcctggagaccgtgtggcaggtgtactaccccatgatgagacccctgatcgagaagttcagcgccaacgtgcccagaagccccgtgagagagctgctggagatggagcccgagaccgccaagttcagccccgccgagagaacctacgacggcaaggtgagagtgaccgtggaggtggtgggcaagggcaagttcaagggcgtgggcagaagctacagaatcgccaagagcgccgccgccagaagagccctgagaagcctgaaggccaaccagccccaggtgcccaacagctag

SEQ ID NO: 79139 - DNA, 801 bp, Artificial Sequence
  Description of Artificial Sequence: Synthetic coding sequence
atgatggccctgggcgccgccggcgccaccagagtgttcgtggccatggtggccgccgccctgggcggccaccccctgctgggcgtgagcgccaccctgaacagcgtgctgaacagcaacgccatcaagaacctgcccccccccctgggcggcgccgccggccaccccggcagcgccgtgagcgccgcccccggcatcctgtaccccggcggcaacaagtaccagaccatcgacaactaccagccctacccctgcgccgaggacgaggagtgcggcaccgacgagtactgcgccagccccaccagaggcggcgacgccggcgtgcagatctgcctggcctgcagaaagagaagaaagagatgcatgagacacgccatgtgctgccccggcaactactgcaagaacggcatctgcgtgagcagcgaccagaaccacttcagaggcgagatcgaggagaccatcaccgagagcttcggcaacgaccacagcaccctggacggctacagcagaagaaccaccctgagcagcaagatgtaccacaccaagggccaggagggcagcgtgtgcctgagaagcagcgactgcgccagcggcctgtgctgcgccagacacttctggagcaagatctgcaagcccgtgctgaaggagggccaggtgtgcaccaagcacagaagaaagggcagccacggcctggagatcttccagagatgctactgcggcgagggcctgagctgcagaatccagaaggaccaccaccaggccagcaacagcagcagactgcacacctgccagagacactag

SEQ ID NO: 79140 - DNA, 1689 bp, Artificial Sequence
  Description of Artificial Sequence: Synthetic coding sequence
atggacgccatgaagagaggcctgtgctgcgtgctgctgctgtgcggcgccgtgttcgtgagccccagccaggagatccacgccagattcagaagaggcgccagaagctaccaggtgatctgcagagacgagaagacccagatgatctaccagcagcaccagagctggctgagacccgtgctgagaagcaacagagtggagtactgctggtgcaacagcggcagagcccagtgccacagcgtgcccgtgaagagctgcagcgagcccagatgcttcaacggcggcacctgccagcaggccctgtacttcagcgacttcgtgtgccagtgccccgagggcttcgccggcaagtgctgcgagatcgacaccagagccacctgctacgaggaccagggcatcagctacagaggcacctggagcaccgccgagagcggcgccgagtgcaccaactggaacagcagcgccctggcccagaagccctacagcggcagaagacccgacgccatcagactgggcctgggcaaccacaactactgcagaaaccccgacagagacagcaagccctggtgctacgtgttcaaggccggcaagtacagcagcgagttctgcagcacccccgcctgcagcgagggcaacagcgactgctacttcggcaacggcagcgcctacagaggcacccacagcctgaccgagagcggcgccagctgcctgccctggaacagcatgatcctgatcggcaaggtgtacaccgcccagaaccccagcgcccaggccctgggcctgggcaagcacaactactgcagaaaccccgacggcgacgccaagccctggtgccacgtgctgaagaacagaagactgacctgggagtactgcgacgtgcccagctgcagcacctgcggcctgagacagtacagccagccccagttcagaatcaagggcggcctgttcgccgacatcgccagccacccctggcaggccgccatcttcgccaagcacagaagaagccccggcgagagattcctgtgcggcggcatcctgatcagcagctgctggatcctgagcgccgcccactgcttccaggagagattccccccccaccacctgaccgtgatcctgggcagaacctacagagtggtgcccggcgaggaggagcagaagttcgaggtggagaagtacatcgtgcacaaggagttcgacgacgacacctacgacaacgacatcgccctgctgcagctgaagagcgacagcagcagatgcgcccaggagagcagcgtggtgagaaccgtgtgcctgccccccgccgacctgcagctgcccgactggaccgagtgcgagctgagcggctacggcaagcacgaggccctgagccccttctacagcgagagactgaaggaggcccacgtgagactgtaccccagcagcagatgcaccagccagcacctgctgaacagaaccgtgaccgacaacatgctgtgcgccggcgacaccagaagcggcggcccccaggccaacctgcacgacgcctgccagggcgacagcggcggccccctggtgtgcctgaacgacggcagaatgaccctggtgggcatcatcagctggggcctgggctgcggccagaaggacgtgcccggcgtgtacaccaaggtgaccaactacctggactggatcagagacaacatgagaccctag

SEQ ID NO: 79141 - DNA, 420 bp, Artificial Sequence
  Description of Artificial Sequence: Synthetic coding sequence
atggtggccgccgtgctgctgggcctgagctggctgtgcagccccctgggcgccctggtgctggacttcaacaacatcagaagcagcgccgacctgcacggcgccagaaagggcagccagtgcctgagcgacaccgactgcaacaccagaaagttctgcctgcagcccagagacgagaagcccttctgcgccacctgcagaggcctgagaagaagatgccagagagacgccatgtgctgccccggcaccctgtgcgtgaacgacgtgtgcaccaccatggaggacgccacccccatcctggagagacagctggacgagcaggacggcacccacgccgagggcaccaccggccaccccgtgcaggagaaccagcccaagagaaagcccagcatcaagaagagcagcagcatgctggactag

SEQ ID NO: 79142 - DNA, 1683 bp, Artificial Sequence
  Description of Artificial Sequence: Synthetic coding sequence
atgagagacctgcccctgaccagcctggccctggtgctgagcgccctgggcgccctgctgggcaccgaggccctgagagccgaggagcccgccgtgggcaccagcggcctgatcttcagagaggacctggactggccccccggcagcccccaggagcccctgtgcctggtggccctgggcggcgacagcaacggcagcagcagccccctgagagtggtgggcgccctgagcgcctacgagcaggccttcctgggcgccgtgcagagagccagatggggccccagagacctggccaccttcggcgtgtgcaacaccggcgacagacaggccgccctgcccagcctgagaagactgggcgcctggctgagagaccccggcggccagagactggtggtgctgcacctggaggaggtgacctgggagcccacccccagcctgagattccaggagcccccccccggcggcgccggcccccccgagctggccctgctggtgctgtaccccggccccggccccgaggtgaccgtgaccagagccggcctgcccggcgcccagagcctgtgccccagcagagacaccagatacctggtgctggccgtggacagacccgccggcgcctggagaggcagcggcctggccctgaccctgcagcccagaggcgaggacagcagactgagcaccgccagactgcaggccctgctgttcggcgacgaccacagatgcttcaccagaatgacccccgccctgctgctgctgcccagaagcgagcccgcccccctgcccgcccacggccagctggacaccgtgcccttccccccccccagacccagcgccgagctggaggagagcccccccagcgccgaccccttcctggagaccctgaccagactggtgagagccctgagagtgccccccgccagagccagcgcccccagactggccctggaccccgacgccctggccggcttcccccagggcctggtgaacctgagcgaccccgccgccctggagagactgctggacggcgaggagcccctgctgctgctgctgagacccaccgccgccaccaccggcgaccccgcccccctgcacgaccccaccagcgccccctgggccaccgccctggccagaagagtggccgccgagctgcaggccgccgccgccgagctgagaagcctgcccggcctgccccccgccaccgcccccctgctggccagactgctggccctgtgccccggcggccccggcggcctgggcgaccccctgagagccctgctgctgctgaaggccctgcagggcctgagagtggagtggagaggcagagaccccagaggccccggcagagcccagagaagcgccggcgccaccgccgccgacggcccctgcgccctgagagagctgagcgtggacctgagagccgagagaagcgtgctgatccccgagacctaccaggccaacaactgccagggcgtgtgcggctggccccagagcgacagaaaccccagatacggcaaccacgtggtgctgctgctgaagatgcaggtgagaggcgccgccctggccagacccccctgctgcgtgcccaccgcctacgccggcaagctgctgatcagcctgagcgaggagagaatcagcgcccaccacgtgcccaacatggtggccaccgagtgcggctgcagatag

SEQ ID NO: 79143 - DNA, 600 bp, Artificial Sequence
  Description of Artificial Sequence: Synthetic coding sequence
atgggcgaggccagcccccccgcccccgccagaagacacctgctggtgctgctgctgctgctgagcaccctggtgatccccagcgccgccgcccccatccacgacgccgacgcccaggagagcagcctgggcctgaccggcctgcagagcctgctgcagggcttcagcagactgttcctgaagggcaacctgctgagaggcatcgacagcctgttcagcgcccccatggacttcagaggcctgcccggcaactaccacaaggaggagaaccaggagcaccagctgggcaacaacaccctgagcagccacctgcagatcgacaaggtgcccagaatggaggagaaggaggccctggtgcccatccagaaggccaccgacagcttccacaccgagctgcaccccagagtggccttctggatcatcaagctgcccagaagaagaagccaccaggacgccctggagggcggccactggctgagcgagaagagacacagactgcaggccatcagagacggcctgagaaagggcacccacaaggacgtgctggaggagggcaccgagagcagcagccacagcagactgagccccagaaagacctag

SEQ ID NO: 79144 - DNA, 1896 bp, Artificial Sequence
  Description of Artificial Sequence: Synthetic coding sequence
atggccctgagaaaggagctgctgaagagcatctggtacgccttcaccgccctggacgtggagaagagcggcaaggtgagcaagagccagctgaaggtgctgagccacaacctgtacaccgtgctgcacatcccccacgaccccgtggccctggaggagcacttcagagacgacgacgacggccccgtgagcagccagggctacatgccctacctgaacaagtacatcctggacaaggtggaggagggcgccttcgtgaaggagcacttcgacgagctgtgctggaccctgaccgccaagaagaactacagagccgacagcaacggcaacagcatgctgagcaaccaggacgccttcagactgtggtgcctgttcaacttcctgagcgaggacaagtaccccctgatcatggtgcccgacgaggtggagtacctgctgaagaaggtgctgagcagcatgagcctggaggtgagcctgggcgagctggaggagctgctggcccaggaggcccaggtggcccagaccaccggcggcctgagcgtgtggcagttcctggagctgttcaacagcggcagatgcctgagaggcgtgggcagagacaccctgagcatggccatccacgaggtgtaccaggagctgatccaggacgtgctgaagcagggctacctgtggaagagaggccacctgagaagaaactgggccgagagatggttccagctgcagcccagctgcctgtgctacttcggcagcgaggagtgcaaggagaagagaggcatcatccccctggacgcccactgctgcgtggaggtgctgcccgacagagacggcaagagatgcatgttctgcgtgaagaccgccaacagaacctacgagatgagcgccagcgacaccagacagagacaggagtggaccgccgccatccagatggccatcagactgcaggccgagggcaagaccagcctgcacaaggacctgaagcagaagagaagagagcagagagagcagagagagagaagaagagccgccaaggaggaggagctgctgagactgcagcagctgcaggaggagaaggagagaaagctgcaggagctggagctgctgcaggaggcccagagacaggccgagagactgctgcaggaggaggaggagagaagaagaagccagcacagagagctgcagcaggccctggagggccagctgagagaggccgagcaggccagagccagcatgcaggccgagatggagctgaaggaggaggaggccgccagacagagacagagaatcaaggagctggaggagatgcagcagagactgcaggaggccctgcagctggaggtgaaggccagaagagacgaggagagcgtgagaatcgcccagaccagactgctggaggaggaggaggagaagctgaagcagctgatgcagctgaaggaggagcaggagagatacatcgagagagcccagcaggagaaggaggagctgcagcaggagatggcccagcagagcagaagcctgcagcaggcccagcagcagctggaggaggtgagacagaacagacagagagccgacgaggacgtggaggccgcccagagaaagctgagacaggccagcaccaacgtgaagcactggaacgtgcagatgaacagactgatgcaccccatcgagcccggcgacaagagacccgtgaccagcagcagcttcagcggcttccagccccccctgctggcccacagagacagcagcctgaagagactgaccagatggggcagccagggcaacagaacccccagccccaacagcaacgagcagcagaagagcctgaacggcggcgacgaggcccccgcccccgccagcaccccccaggaggacaagctggaccccgcccccgagaactag

SEQ ID NO: 79145 - DNA, 555 bp, Artificial Sequence
  Description of Artificial Sequence: Synthetic coding sequence
atggccctgagaaaggagctgctgaagagcatctggtacgccttcaccgccctggacgtggagaagagcggcaaggtgagcaagagccagctgaaggtgctgagccacaacctgtacaccgtgctgcacatcccccacgaccccgtggccctggaggagcacttcagagacgacgacgacggccccgtgagcagccagggctacatgccctacctgaacaagtacatcctggacaaggacgccttcagactgtggtgcctgttcaacttcctgagcgaggacaagtaccccctgatcatggtgcccgacgaggtggagtacctgctgaagaaggtgctgagcagcatgagcctggaggtgagcctgggcgagctggaggagctgctggcccaggaggcccaggtggcccagaccaccggcggcctgagcgtgtggcagttcctggagctgttcaacagcggcagatgcctgagaggcgtgggcagagacaccctgagcatggccatccacgaggtgtaccaggagctgatccaggacgtgctgaagcagggctag

SEQ ID NO: 79146 - DNA, 393 bp, Artificial Sequence
  Description of Artificial Sequence: Synthetic coding sequence
tgaagagacgacgacgacggccccgtgagcagccagggctacatgccctacctgaacaagtacatcctggacaaggacgccttcagactgtggtgcctgttcaacttcctgagcgaggacaagtaccccctgatcatggtgcccgacgaggtggagtacctgctgaagaaggtgctgagcagcatgagcctggaggtgagcctgggcgagctggaggagctgctggcccaggaggcccaggtggcccagaccaccggcggcctgagcgtgtggcagttcctggagctgttcaacagcggcagatgcctgagaggcgtgggcagagacaccctgagcatggccatccacgaggtgtaccaggagctgatccaggacgtgctgaagcagggctag

SEQ ID NO: 79147 - DNA, 1131 bp, Artificial Sequence
  Description of Artificial Sequence: Synthetic coding sequence
atgatctgcccccccagaccccccaaggtgctgggcctgcaggtgctgcccgacagagacggcaagagatgcatgttctgcgtgaagaccgccaacagaacctacgagatgagcgccagcgacaccagacagagacaggagtggaccgccgccatccagatggccatcagactgcaggccgagggcaagaccagcctgcacaaggacctgaagcagaagagaagagagcagagagagcagagagagagaagaagagccgccaaggaggaggagctgctgagactgcagcagctgcaggaggagaaggagagaaagctgcaggagctggagctgctgcaggaggcccagagacaggccgagagactgctgcaggaggaggaggagagaagaagaagccagcacagagagctgcagcaggccctggagggccagctgagagaggccgagcaggccagagccagcatgcaggccgagatggagctgaaggaggaggaggccgccagacagagacagagaatcaaggagctggaggagatgcagcagagactgcaggaggccctgcagctggaggtgaaggccagaagagacgaggagagcgtgagaatcgcccagaccagactgctggaggaggaggaggagaagctgaagcagctgatgcagctgaaggaggagcaggagagatacatcgagagagcccagcaggagaaggaggagctgcagcaggagatggcccagcagagcagaagcctgcagcaggcccagcagcagctggaggaggtgagacagaacagacagagagccgacgaggacgtggaggccgcccagagaaagctgagacaggccagcaccaacgtgaagcactggaacgtgcagatgaacagactgatgcaccccatcgagcccggcgacaagagacccgtgaccagcagcagcttcagcggcttccagccccccctgctggcccacagagacagcagcctgaagagactgaccagatggggcagccagggcaacagaacccccagccccaacagcaacgagcagcagaagagcctgaacggcggcgacgaggcccccgcccccgccagcaccccccaggaggacaagctggaccccgcccccgagaactag

SEQ ID NO: 79148 - DNA, 708 bp, Artificial Sequence
  Description of Artificial Sequence: Synthetic coding sequence
atgacccaggtgaccgagaagagcaccgagcaccccgagaagaccaccagcaccaccgagaagaccaccagaacccccgagaagcccaccctgtacagcgagaagaccatctgcaccaagggcaagaacacccccgtgcccgagaagcccaccgagaacctgggcaacaccaccctgaccaccgagaccatcaaggcccccgtgaagagcaccgagaaccccgagaagaccgccgccgtgaccaagaccatcaagcccagcgtgaaggtgaccggcgacaagagcctgaccaccaccagcagccacctgaacaagaccgaggtgacccaccaggtgcccaccggcagcttcaccctgatcaccagcagaaccaagctgagcagcatcaccagcgaggccaccggcaacgagagccacccctacctgaacaaggacggcagccagaagggcatccacgccggccagatgggcgagaacgacagcttccccgcctgggccatcgtgatcgtggtgctggtggccgtgatcctgctgctggtgttcctgggcctgatcttcctggtgagctacatgatgagaaccagaagaaccctgacccagaacacccagtacaacgacgccgaggacgagggcggccccaacagctaccccgtgtacctgatggagcagcagaacctgggcatgggccagatccccagccccagatag

SEQ ID NO: 79149 - DNA, 1524 bp, Artificial Sequence
  Description of Artificial Sequence: Synthetic coding sequence
cccctggccaacgagaagaccaccctgagccccgccgagcccaccgagaacggcgagagaacccccttcaccaacgagaagaccacccccagcagcgccgagcccaccgagcacggcgagagaacccccctggccaacgagatcaccacccccagcagagccgagcccaccgagcacggcgagagaatcgccaacgagaaggccacccccagccccgccaagcccaccgagcacggcgagaccaccgtgaacgaggacaccacccccagcagcgccgagcccaccgagaacggcgagagaacccccctggccaacgagaacaccaccaccagccccaccgagagcaccgagcacggcgagagaaccgccaacgagaagaccacccccagccccgccgagcccaccgagcacggcgagagaacccccagcgccaacgagaagaccatccccagccccgccaagcccaccgagcacgaggagatgacccccagcgccaacgagaacaccacccccagccccgtgaagcccaccgagcacggcgagaagaccaccctggccaacgagaagatcaccctgagccccgagggccccaccgagcacggcgccaagaccaccagcgccaacgagaagatcacccccagcctggccaagcccaccgagcacggcgagagaaccaccagccccaacgacaagatcaccagcagcgccgccgagagcaccgagcacagagacagagccaccagcgccaacgtgatcacccccgcccccgccgagcccatcaagcacgccaagagaaccaccctggcccacgagaagatgacccaggtgaccgagaagagcaccgagcaccccgagaagaccaccagcaccaccgagaagaccaccagaacccccgagaagcccaccctgtacagcgagaagaccatctgcaccaagggcaagaacacccccgtgcccgagaagcccaccgagaacctgggcaacaccaccctgaccaccgagaccatcaaggcccccgtgaagagcaccgagaaccccgagaagaccgccgccgtgaccaagaccatcaagcccagcgtgaaggtgaccggcgacaagagcctgaccaccaccagcagccacctgaacaagaccgaggtgacccaccaggtgcccaccggcagcttcaccctgatcaccagcagaaccaagctgagcagcatcaccagcgaggccaccggcaacgagagccacccctacctgaacaaggacggcagccagaagggcatccacgccggccagatgggcgagaacgacagcttccccgcctgggccatcgtgatcgtggtgctggtggccgtgatcctgctgctggtgttcctgggcctgatcttcctggtgagctacatgatgagaaccagaagaaccctgacccagaacacccagtacaacgacgccgaggacgagggcggccccaacagctaccccgtgtacctgatggagcagcagaacctgggcatgggccagatccccagccccagatag

SEQ ID NO: 79150 - DNA, 1524 bp, Artificial Sequence
  Description of Artificial Sequence: Synthetic coding sequence
cccctggccaacgagaagaccaccctgagccccgccgagcccaccgagaacggcgagagaacccccttcaccaacgagaagaccacccccagcagcgccgagcccaccgagcacggcgagagaacccccctggccaacgagatcaccacccccagcagagccgagcccaccgagcacggcgagagaatcgccaacgagaaggccacccccagccccgccaagcccaccgagcacggcgagaccaccgtgaacgaggacaccacccccagcagcgccgagcccaccgagaacggcgagagaacccccctggccaacgagaacaccaccaccagccccaccgagagcaccgagcacggcgagagaaccgccaacgagaagaccacccccagccccgccgagcccaccgagcacggcgagagaacccccagcgccaacgagaagaccatccccagccccgccaagcccaccgagcacgaggagatgacccccagcgccaacgagaacaccacccccagccccgtgaagcccaccgagcacggcgagaagaccaccctggccaacgagaagatcaccctgagccccgagggccccaccgagcacggcgccaagaccaccagcgccaacgagaagatcacccccagcctggccaagcccaccgagcacggcgagagaaccaccagccccaacgacaagatcaccagcagcgccgccgagagcaccgagcacagagacagagccaccagcgccaacgtgatcacccccgcccccgccgagcccatcaagcacgccaagagaaccaccctggcccacgagaagatgacccaggtgaccgagaagagcaccgagcaccccgagaagaccaccagcaccaccgagaagaccaccagaacccccgagaagcccaccctgtacagcgagaagaccatctgcaccaagggcaagaacacccccgtgcccgagaagcccaccgagaacctgggcaacaccaccctgaccaccgagaccatcaaggcccccgtgaagagcaccgagaaccccgagaagaccgccgccgtgaccaagaccatcaagcccagcgtgaaggtgaccggcgacaagagcctgaccaccaccagcagccacctgaacaagaccgaggtgacccaccaggtgcccaccggcagcttcaccctgatcaccagcagaaccaagctgagcagcatcaccagcgaggccaccggcaacaagagccacccctacctgaacaaggacggcagccagaagggcatccacgccggccagatgggcgagaacgacagcttccccgcctgggccatcgtgatcgtggtgctggtggccgtgatcctgctgctggtgttcctgggcctgatcttcctggtgagctacatgatgagaaccagaagaaccctgacccagaacacccagtacaacgacgccgaggacgagggcggccccaacagctaccccgtgtacctgatggagcagcagaacctgggcatgggccagatccccagccccagatag

SEQ ID NO: 79151 - DNA, 1524 bp, Artificial Sequence; identical to SEQ ID NO: 79149
  Description of Artificial Sequence: Synthetic coding sequence

SEQ ID NO: 79152 - DNA, 1554 bp, Artificial Sequence
  Description of Artificial Sequence: Synthetic coding sequence
atggcccagcccgtgcacagcctgtgcagcgccttcggcctgcagtgctgcctgctgttcctgctggccagctggggcgccggcgccaccaccttccaggagtaccagaagaccggcgagctgagcaccagcgaccacatcttccccctgacccccggcctggtgtacagcatccccttcgaccacatcgtgctgcacagcggccagagaccccccgagctgcccaagagcaccgagatccacgagcagaagagacactgcaacaccaccagacacagcaagcccaccgacaagcccaccggcaacagcaagaccatcgaccacaagagcagcaccgacaaccacgaggccccccccaccagcgaggagaacagcagcaaccagggcaaggaccccatgatcagaaaccagagaagcgtggaccccgccgacagcaccaccacccacaaggagagcgccggcaagaagcacatcacccccgcccccaagagcaagatcaactgcagaaagagcaccaccggcaagagcaccgtgaccagaaagagcgacaagaccggcagacccctggagaagagcatgagcaccctggacaagaccagcaccagcagccacaagaccaccaccagcttccacaacagcggcaacagccagaccaagcagaagagcaccagcttccccgagaagatcaccgccgccagcaagaccacctacaagaccaccggcacccccgaggagagcgagaagaccgaggacagcagaaccaccgtggccagcgacaagctgctgaccaagaccaccaagaacatccaggagaccatcagcgccaacgagctgacccagagcctggccgagcccaccgagcacggcggcagaaccgccaacgagaacaacacccccagccccgccgagcccaccgagaacagagagagaaccgccaacgagaacaagaagaccatctgcaccaagggcaagaacacccccgtgcccgagaagcccaccgagaacctgggcaacaccaccctgaccaccgagaccatcaaggcccccgtgaagagcaccgagaaccccgagaagaccgccgccgtgaccaagaccatcaagcccagcgtgaaggtgaccggcgacaagagcctgaccaccaccagcagccacctgaacaagaccgaggtgacccaccaggtgcccaccggcagcttcaccctgatcaccagcagaaccaagctgagcagcatcaccagcgaggccaccggcaacgagagccacccctacctgaacaaggacggcagccagaagggcatccacgccggccagatgggcgagaacgacagcttccccgcctgggccatcgtgatcgtggtgctggtggccgtgatcctgctgctggtgttcctgggcctgatcttcctggtgagctacatgatgagaaccagaagaaccctgacccagaacacccagtacaacgacgccgaggacgagggcggccccaacagctaccccgtgtacctgatggagcagcagaacctgggcatgggccagatccccagccccagatag

SEQ ID NO: 79153 - DNA, 1554 bp, Artificial Sequence; identical to SEQ ID NO: 79152
  Description of Artificial Sequence: Synthetic coding sequence

SEQ ID NO: 79154 - DNA, 1554 bp, Artificial Sequence; identical to SEQ ID NO: 79152
  Description of Artificial Sequence: Synthetic coding sequence

SEQ ID NO: 79155 - DNA, 4182 bp, Artificial Sequence
  Description of Artificial Sequence: Synthetic coding sequence
atggcccagcccgtgcacagcctgtgcagcgccttcggcctgcagtgctgcctgctgttcctgctggccagctggggcgccggcgccaccaccttccaggagtaccagaagaccggcgagctgagcaccagcgaccacatcttccccctgacccccggcctggtgtacagcatccccttcgaccacatcgtgctgcacagcggccagagaccccccgagctgcccaagagcaccgagatccacgagcagaagagacactgcaacaccaccagacacagcaagcccaccgacaagcccaccggcaacagcaagaccatcgaccacaagagcagcaccgacaaccacgaggccccccccaccagcgaggagaacagcagcaaccagggcaaggaccccatgatcagaaaccagagaagcgtggaccccgccgacagcaccaccacccacaaggagagcgccggcaagaagcacatcacccccgcccccaagagcaagatcaactgcagaaagagcaccaccggcaagagcaccgtgaccagaaagagcgacaagaccggcagacccctggagaagagcatgagcaccctggacaagaccagcaccagcagccacaagaccaccaccagcttccacaacagcggcaacagccagaccaagcagaagagcaccagcttccccgagaagatcaccgccgccagcaagaccacctacaagaccaccggcacccccgaggagagcgagaagaccgaggacagcagaaccaccgtggccagcgacaagctgctgaccaagaccaccaagaacatccaggagaccatcagcgccaacgagctgacccagagcctggccgagcccaccgagcacggcggcagaaccgccaacgagaacaacacccccagccccgccgagcccaccgagaacagagagagaaccgccaacgagaacaccaccctgagccccgccgagcccaccgagaacagagagagaaccgccaacgagaacaccgcccccttccccgccggccccaccgagaacagagagatgaccgccaacgagaacaccaccctgttccccgccgagcccaccgagcacggcgagagaaccgccaacgagaacaccacccccagccccgccgagcccaccgagcacggcgagagaaccgccaacgagaacaccacccccagccccgccgagcccaccgagcacggcgagagaacccccttcgccaacgacaagaccaccagcagcagcgccgagagcaccgagcacggcgagagaacccccctggccaacgagaacaccacccccagccccgccgagcccaccgagaacagagagagaaccgccaacgagaacaccacccccagccccgccggccccaccgagaacagagagaccaccgccaacgagaagaccaccctgagccccgtggagcccaccgagaacagagagaccaccgccaacgagaagaccacccccagccccgccgagcccaccgagaacggccagagaacccccttcgccaacgagaagaccaccagcagcagcgccgagcccaccgagcacggcgagagaacccccctggccaacgagaacaccacccccagccccgccgagcccaccgagaacagagagagaaccgccaacgagaagaccacccccagccccgccgagcccaccgagaacggcgacagaacccccctggccaacgagaagaccacccccagcctggccgagcccaccgagaacggccagagaacccccttcgccaacgagaagaccaccagcagcagcgccgagcccaccgagcacgaggagagaacccccctggccaacgagaacaccacccccagccccgccgagcccaccgagaacagagagagaaccgccaacgagaacaccacccccagccccgccggccccaccgagaacagagagatgaccgccaacgagaagaccaccctgttccccgccgagcccaccgagaacagagagagaaccgccaacgagaagaccaccagcagccccgccgagcccaccgagaacggccagagaacccccttcgccaacgagaagaccaccagcagcagcgccgagcccaccgagcacggcgagagaacccccctggccaacgagaacaccaccctgagccccgccgagcccaccgagaacagagagagaaccgccaacgagaagaccacccccttccccgccgagcccaccgagaacagagagagaaccgccaacgagaacaccacccccagccccgcccagcccaccgagaacggcgacagaacccccctggccaacgagaagaccacccccagcctggccgagcccaccgagaacggcaagagaacccccttcgccaacgagaagaccaccagcagcagcgccgagcccaccgagcacgccgagagaacccccctggccaacgagaacaccaccagcagccccgccgagcccaccgagaacagagagagaaccgccaacgagaagaccacccagttccccgccgagcccaccgagaacagagagagcaccgccaacgagaagaccacccccttccccgccgagcccaccgagaacagagagtggaccgccaacgagaacaccaccctgagccccgccgagcccaccgagcacgaggagatgacccccctggccaacgagaagaccaccctgagccccgccgagcccaccgagaacggcgagagaacccccttcaccaacgagaagaccacccccagcagcgccgagcccaccgagcacggcgagagaacccccctggccaacgagatcaccacccccagcagagccgagcccaccgagcacggcgagagaatcgccaacgagaaggccacccccagccccgccaagcccaccgagcacggcgagaccaccgtgaacgaggacaccacccccagcagcgccgagcccaccgagaacggcgagagaacccccctggccaacgagaacaccaccaccagccccaccgagagcaccgagcacggcgagagaaccgccaacgagaagaccacccccagccccgccgagcccaccgagcacggcgagagaacccccagcgccaacgagaagaccatccccagccccgccaagcccaccgagcacgaggagatgacccccagcgccaacgagaacaccacccccagccccgtgaagcccaccgagcacggcgagaagaccaccctggccaacgagaagatcaccctgagccccgagggccccaccgagcacggcgccaagaccaccagcgccaacgagaagatcacccccagcctggccaagcccaccgagcacggcgagagaaccaccagccccaacgacaagatcaccagcagcgccgccgagagcaccgagcacagagacagagccaccagcgccaacgtgatcacccccgcccccgccgagcccatcaagcacgccaagagaaccaccctggcccacgagaagatgacccaggtgaccgagaagagcaccgagcaccccgagaagaccaccagcaccaccgagaagaccaccagaacccccgagaagcccaccctgtacagcgagaagaccatctgcaccaagggcaagaacacccccgtgcccgagaagcccaccgagaacctgggcaacaccaccctgaccaccgagaccatcaaggcccccgtgaagagcaccgagaaccccgagaagaccgccgccgtgaccaagaccatcaagcccagcgtgaaggtgaccggcgacaagagcctgaccaccaccagcagccacctgaacaagaccgaggtgacccaccaggtgcccaccggcagcttcaccctgatcaccagcagaaccaagctgagcagcatcaccagcgaggccaccggcaacgagagccacccctacctgaacaaggacggcagccagaagggcatccacgccggccagatgggcgagaacgacagcttccccgcctgggccatcgtgatcgtggtgctggtggccgtgatcctgctgctggtgttcctgggcctgatcttcctggtgagctacatgatgagaaccagaagaaccctgacccagaacacccagtacaacgacgccgaggacgagggcggccccaacagctaccccgtgtacctgatggagcagcagaacctgggcatgggccagatccccagccccagatag

SEQ ID NO: 79156 - DNA, 2670 bp, Artificial Sequence
  Description of Artificial Sequence: Synthetic coding sequence
atggcccagcccgtgcacagcctgtgcagcgccttcggcctgcagtgctgcctgctgttcctgctggccagctggggcgccggcgccaccaccttccaggagtaccagaagaccggcgagctgagcaccagcgaccacatcttccccctgacccccggcctggtgtacagcatccccttcgaccacatcgtgctgcacagcggccagagaccccccgagctgcccaagagcaccgagatccacgagcagaagagacactgcaacaccaccagacacagcaagcccaccgacaagcccaccggcaacagcaagaccatcgaccacaagagcagcaccgacaaccacgaggccccccccaccagcgaggagaacagcagcaaccagggcaaggaccccatgatcagaaaccagagaagcgtggaccccgccgacagcaccaccacccacaaggagagcgccggcaagaagcacatcacccccgcccccaagagcaagatcaactgcagaaagagcaccaccggcaagagcaccgtgaccagaaagagcgacaagaccggcagacccctggagaagagcatgagcaccctggacaagaccagcaccagcagccacaagaccaccaccagcttccacaacagcggcaacagccagaccaagcagaagagcaccagcttccccgagaagatcaccgccgccagcaagaccacctacaagaccaccggcacccccgaggagagcgagaagaccgaggacagcagaaccaccgtggccagcgacaagctgctgaccaagaccaccaagaacatccaggagaccatcagcgccaacgagctgacccagagcctggccgagcccaccgagcacggcggcagaaccgccaacgagaacaacacccccagccccgccgagcccaccgagaacagagagagaaccgccaacgagaacaccaccctgagccccgccgagcccaccgagaacagagagagaaccgccaacgagaacaccgcccccttccccgccggccccaccgagaacagagagatgaccgccaacgagaacaccaccctgttccccgccgagcccaccgagcacggcgagagaaccgccaacgagaacaccacccccagccccgccgagcccaccgagcacggcgagagaaccgccaacgagaacaccacccccagccccgccgagcccaccgagcacggcgagagaacccccttcgccaacgacaagaccaccagcagcagcgccgagagcaccgagcacggcgagagaacccccctggccaacgagaacaccacccccagccccgccgagcccaccgagaacagagagagaaccgccaacgagaacaccacccccagccccgccggccccaccgagaacagagagaccaccgccaacgagaagaccaccctgagccccgtggagcccaccgagaacagagagaccaccgccaacgagaagaccacccccagccccgccgagcccaccgagaacggccagagaacccccttcgccaacgagaagaccaccagcagcagcgccgagcccaccgagcacggcgagagaacccccctggccaacgagaacaccacccccagccccgccgagcccaccgagaacagagagagaaccgccaacgagaagaccacccccagccccgccgagcccaccgagaacggcgacagaacccccctggccaacgagaagaccacccccagcctggccgagcccaccgagaacggccagagaacccccttcgccaacgagaagaccaccagcagcagcgccgagcccaccgagcacgaggagagaacccccctggccaacgagaacaccacccccagccccgccgagcccaccgagaacagagagagaaccgccaacgagaacaccacccccagccccgccggccccaccgagaacagagagatgaccgccaacgagaagaccaccctgttccccgccgagcccaccgagaacagagagagaaccgccaacgagaagaccaccagcagccccgccgagcccaccgagaacggccagagaacccccttcgccaacgagaagaccaccagcagcagcgccgagcccaccgagcacggcgagagaacccccctggccaacgagaacaccaccctgagccccgccggccccaccgagaacagagagagaaccgccaacgagaagaccacccccttccccgccgagcccaccgagaacagagagagaaccgccaacgagaacaccacccccagccccgcccagcccaccgagaacggcgacagaacccccctggccaacgagaagaccacccccagcctggccgagcccaccgagaacggcaagagaacccccttcgccaacgagaagaccaccagcagcagcgccgagcccaccgagcacgccgagagaacccccctggccaacgagaacaccaccagcagccccgccgagcccaccgagaacagagagagaaccgccaacgagaagaccacccagttccccgccgagcccaccgagaacagagagagcaccgccaacgagaagaccacccccttccccgccgagcccaccgagaacagagagtggaccgccaacgagaacaccaccctgagccccgccgagcccaccgagcacgaggagatgacccccctggcctag

SEQ ID NO: 79157 - DNA, 1653 bp, Artificial Sequence
  Description of Artificial Sequence: Synthetic coding sequence
atggtgcccaaggccgacagcggcgccttcctgctgctgttcctgctggtgctgaccgtgaccgagcccctgagacccgagctgagatgcaaccccggccagttcgcctgcagaagcggcaccatccagtgcatccccctgccctggcagtgcgacggctgggccacctgcgaggacgagagcgacgaggccaactgccccgaggtgaccggcgaggtgagaccccaccacggcaaggaggccgtggaccccagacagggcagagccagaggcggcgaccccagccacttccacgccgtgaacgtggcccagcccgtgagattcagcagcttcctgggcaagtgccccaccggctggcaccactacgagggcaccgccagctgctacagagtgtacctgagcggcgagaactactgggacgccgcccagacctgccagagactgaacggcagcctggccaccttcagcaccgaccaggagctgagattcgtgctggcccaggagtgggaccagcccgagagaagcttcggctggaaggaccagagaaagctgtgggtgggctaccagtacgtgatcaccggcagaaacagaagcctggagggcagatgggaggtggccttcaagggcagcagcgaggtgttcctgccccccgaccccatcttcgccagcgccatgagcgagaacgacaacgtgttctgcgcccagctgcagtgcttccacttccccaccctgagacaccacgacctgcacagctggcacgccgagagctgctacgagaagagcagcttcctgtgcaagagaagccagacctgcgtggacatcaaggacaacgtggtggacgagggcttctacttcacccccaagggcgacgacccctgcctgagctgcacctgccacggcggcgagcccgagatgtgcgtggccgccctgtgcgagagaccccagggctgccagcagtacagaaaggaccccaaggagtgctgcaagttcatgtgcctggaccccgacggcaacagcctgttcgacagcatggccagcggcatgagactggtggtgagctgcatcagcagcttcctgatcctgagcctgctgctgttcatggtgcacagactgagacagagaagaagagagagaatcgagagcctgatcggcgccaacctgcaccacttcaacctgggcagaagaatccccggcttcgactacggccccgacggcttcggcaccggcctgacccccctgcacctgagcgacgacggcgagggcggcaccttccacttccacgaccccccccccccctacaccgcctacaagtaccccgacatcggccagcccgacgaccccccccccccctacgaggccagcatccaccccgacagcgtgttctacgaccccgccgacgacgacgccttcgagcccgtggaggtgagcctgcccgcccccggcgacggcggcagcgagggcgccctgctgagaagactggagcagcccctgcccaccgccggcgccagcctggccgacctggaggacagcgccgacagcagcagcgccctgctggtgccccccgaccccgcccagagcggcagcacccccgccgccgaggccctgcccggcggcggcagacacagcagaagcagcctgaacaccgtggtgtag

SEQ ID NO: 79158 - DNA, 984 bp, Artificial Sequence
  Description of Artificial Sequence: Synthetic coding sequence
atggtgcccaaggccgacagcggcgccttcctgctgctgttcctgctggtgctgaccgtgaccgagcccctgagacccgagctgagatgcaaccccggccagttcgcctgcagaagcggcaccatccagtgcatccccctgccctggcagtgcgacggctgggccacctgcgaggacgagagcgacgaggccaactgccccgaggtgaccggcgaggtgagaccccaccacggcaaggaggccgtggaccccagacagggcagagccagaggcggcgaccccagccacttccacgccgtgaacgtggcccagcccgtgagattcagcagcttcctgggcaagtgccccaccggctggcaccactacgagggcaccgccagctgctacagagtgtacctgagcggcgagaactactgggacgccgcccagacctgccagagactgaacggcagcctggccaccttcagcaccgaccaggagctgagattcgtgctggcccaggagtgggaccagcccgagagaagcttcggctggaaggaccagagaaagctgtgggtgggctaccagtacgtgatcaccggcagaaacagaagcctggagggcagatgggaggtggccttcaagggcagcagcgaggtgttcctgccccccgaccccatcttcgccagcgccatgagcgagaacgacaacgtgttctgcgcccagctgcagtgcttccacttccccaccctgagacaccacgacctgcacagctggcacgccgagagctgctacgagaagagcagcttcctgtgcaagagaagccagacctgcgtggacatcaaggacaacgtggtggacgagggcttctacttcacccccaagggcgacgacccctgcctgagctgcacctgccacggcggcgagcccgagatgtgcgtggccgccctgtgcgagagaccccagggctgcagccccctgagctgcaccgccagagccacctag

SEQ ID NO: 79159 - DNA, 1530 bp, Artificial Sequence
  Description of Artificial Sequence: Synthetic coding sequence
atggtgcccaaggccgacagcggcgccttcctgctgctgttcctgctggtgctgaccgtgaccgagcccctgagacccgaggtgaccggcgaggtgagaccccaccacggcaaggaggccgtggaccccagacagggcagagccagaggcggcgaccccagccacttccacgccgtgaacgtggcccagcccgtgagattcagcagcttcctgggcaagtgccccaccggctggcaccactacgagggcaccgccagctgctacagagtgtacctgagcggcgagaactactgggacgccgcccagacctgccagagactgaacggcagcctggccaccttcagcaccgaccaggagctgagattcgtgctggcccaggagtgggaccagcccgagagaagcttcggctggaaggaccagagaaagctgtgggtgggctaccagtacgtgatcaccggcagaaacagaagcctggagggcagatgggaggtggccttcaagggcagcagcgaggtgttcctgccccccgaccccatcttcgccagcgccatgagcgagaacgacaacgtgttctgcgcccagctgcagtgcttccacttccccaccctgagacaccacgacctgcacagctggcacgccgagagctgctacgagaagagcagcttcctgtgcaagagaagccagacctgcgtggacatcaaggacaacgtggtggacgagggcttctacttcacccccaagggcgacgacccctgcctgagctgcacctgccacggcggcgagcccgagatgtgcgtggccgccctgtgcgagagaccccagggctgccagcagtacagaaaggaccccaaggagtgctgcaagttcatgtgcctggaccccgacggcaacagcctgttcgacagcatggccagcggcatgagactggtggtgagctgcatcagcagcttcctgatcctgagcctgctgctgttcatggtgcacagactgagacagagaagaagagagagaatcgagagcctgatcggcgccaacctgcaccacttcaacctgggcagaagaatccccggcttcgactacggccccgacggcttcggcaccggcctgacccccctgcacctgagcgacgacggcgagggcggcaccttccacttccacgaccccccccccccctacaccgcctacaagtaccccgacatcggccagcccgacgaccccccccccccctacgaggccagcatccaccccgacagcgtgttctacgaccccgccgacgacgacgccttcgagcccgtggaggtgagcctgcccgcccccggcgacggcggcagcgagggcgccctgctgagaagactggagcagcccctgcccaccgccggcgccagcctggccgacctggaggacagcgccgacagcagcagcgccctgctggtgccccccgaccccgcccagagcggcagcacccccgccgccgaggccctgcccggcggcggcagacacagcagaagcagcctgaacaccgtggtgtag

SEQ ID NO: 79160 - DNA, 810 bp, Artificial Sequence
  Description of Artificial Sequence: Synthetic coding sequence
atggtgcccaaggccgacagcggcgccttcctgctgctgttcctgctggtgctgaccgtgaccgagcccctgagacccgagctgagatgcaaccccggccagttcgcctgcagaagcggcaccatccagtgcatccccctgccctggcagtgcgacggctgggccacctgcgaggacgagagcgacgaggccaactgccccgaggtgaccggcgaggtgagaccccaccacggcaaggaggccgtggaccccagacagggcagagccagaggcggcgaccccagccacttccacgccgtgaacgtggcccagcccgtgagattcagcagaaagtgccccaccggctggcaccactacgagggcaccgccagctgctacagagtgtacctgagcggcgagaactactgggacgccgcccagacctgccagagactgaacggcagcctggccaccttcagcaccgaccaggagctgagattcgtgctggcccaggagtgggaccagcccgagagaagcttcggctggaaggaccagagaaagctgtgggtgggctaccagtacgtgatcaccggcagaaacagaagcctggagggcagatgggaggtggccttcaaggactggggcgtgagcgacaccatggtgcacagaagactgctgtgcccctgcgtgggcaccctgcacacccacctgaagctgggcgccagattcagaagagtgcccgtgagactgggcggcgccctgagcagaagaagccccagacccacccccgcctgcgagcccagactgggcgccaagaccctgcaggtgtag

SEQ ID NO: 79161 - DNA, 663 bp, Artificial Sequence
  Description of Artificial Sequence: Synthetic coding sequence
atggagagatacgccggcgccctggaggaggtggccgacggcgccagacagcaggagagacactaccagctgctgagcgccctgcagagcctggtgaaggagctgcccagcagcttccagcagagactgagctacaccaccctgagcgacctggccctggccctgctggacggcaccgtgttcgagatcgtgcagggcctgctggagatccagcacctgaccgagaagagcctgtacaaccagagactgagactgcagaacgagcacagagtgctgagacaggccctgagacagaagcaccaggaggcccagcaggcctgcagaccccacaacctgcccgtgctgcaggccgcccagcagagagagctggaggccgtggagcacagaatcagagaggagcagagagccatggaccagaagatcgtgctggagctggacagaaaggtggccgaccagcagagcaccctggagaaggccggcgtggccggcttctacgtgaccaccaacccccaggagctgatgctgcagatgaacctgctggagctgatcagaaagctgcagcagagaggctgctgggccggcaaggccgccctgggcctgggcggcccctggcagctgcccgccgcccagtgcgaccagaagggcagccccgtgcccccctag

SEQ ID NO: 79162 - DNA, 663 bp, Artificial Sequence
  Description of Artificial Sequence: Synthetic coding sequence
atggagagatacgccgccgccctggaggaggtggccgacggcgccagacagcaggagagacactaccagctgctgagcgccctgcagagcctggtgaaggagctgcccagcagcttccagcagagactgagctacaccaccctgagcgacctggccctggccctgctggacggcaccgtgttcgagatcgtgcagggcctgctggagatccagcacctgaccgagaagagcctgtacaaccagagactgagactgcagaacgagcacagagtgctgagacaggccctgagacagaagcaccaggaggcccagcaggcctgcagaccccacaacctgcccgtggtgcaggccgcccagcagagagagctggaggccgtggagcacagaatcagagaggagcagagagccatggaccagaagatcatcctggagctggacagaaaggtggccgaccagcagagcaccctggagaaggccggcgtggccggcttctacgtgaccaccaacccccaggagctgatgctgcagatgaacctgctggagctgatcagaaagctgcagcagagaggctgcagagccggcaacgccgccctgggcctgggcggcccctggcagagccccgccgcccagtgcgaccagaagggcagccccgtgcccccctag

SEQ ID NO: 79163 - DNA, 2322 bp, Artificial Sequence
  Description of Artificial Sequence: Synthetic coding sequence
atggagaccgacgagagccccagccccctgccctgcggccccgccggcgaggccgtgatggagagcagagccagacccttccaggccctgcccagagagcagagcccccccccccccctgcagaccagcagcggcgccgaggtgatggacgtgggcagcggcggcgacggccagagcgagctgcccgccgaggaccccttcaacttctacggcgccagcctgctgagcaagggcagcttcagcaagggcagactgctgatcgaccccaactgcagcggccacagccccagaaccgccagacacgcccccgccgtgagaaagttcagccccgacctgaagctgctgaaggacgtgaagatcagcgtgagcttcaccgagagctgcagaagcaaggacagaaaggtgctgtacaccggcgccgagagagacgtgagagccgagtgcggcctgctgctgagccccgtgagcggcgacgtgcacgcctgccccttcggcggcagcgtgggcgacggcgtgggcatcggcggcgagagcgccgacaagaaggacgaggagaacgagctggaccaggagaagagagtggagtacgccgtgctggacgagctggaggacttcaccgacaacctggagctggacgaggagggcgccggcggcttcaccgccaaggccatcgtgcagagagacagagtggacgaggaggccctgaacttcccctacgaggacgacttcgacaacgacgtggacgccctgctggaggagggcctgtgcgcccccaagaagagaagaaccgaggagaagtacggcggcgacagcgaccaccccagcgacggcgagaccagcgtgcagcccatgatgaccaagatcaagaccgtgctgaagagcagaggcagaccccccaccgagcccctgcccgacggctggatcatgaccttccacaacagcggcgtgcccgtgtacctgcacagagagagcagagtggtgacctggagcagaccctacttcctgggcaccggcagcatcagaaagcacgacccccccctgagcagcatcccctgcctgcactacaagaagatgaaggacaacgaggagagagagcagagcagcgacctgacccccagcggcgacgtgagccccgtgaagcccctgagcagaagcgccgagctggagttccccctggacgagcccgacagcatgggcgccgaccccggcccccccgacgagaaggaccccctgggcgccgaggccgcccccggcgccctgggccaggtgaaggccaaggtggaggtgtgcaaggacgagagcgtggacctggaggagttcagaagctacctggagaagagattcgacttcgagcaggtgaccgtgaagaagttcagaacctgggccgagagaagacagttcaacagagagatgaagagaaagcaggccgagagcgagagacccatcctgcccgccaaccagaagctgatcaccctgagcgtgcaggacgcccccaccaagaaggagttcgtgatcaaccccaacggcaagagcgaggtgtgcatcctgcacgagtacatgcagagagtgctgaaggtgagacccgtgtacaacttcttcgagtgcgagaaccccagcgagcccttcggcgccagcgtgaccatcgacggcgtgacctacggcagcggcaccgccagcagcaagaagctggccaagaacaaggccgccagagccaccctggagatcctgatccccgacttcgtgaagcagaccagcgaggagaagcccaaggacagcgaggagctggagtacttcaaccacatcagcatcgaggacagcagagtgtacgagctgaccagcaaggccggcctgctgagcccctaccagatcctgcacgagtgcctgaagagaaaccacggcatgggcgacaccagcatcaagttcgaggtggtgcccggcaagaaccagaagagcgagtacgtgatggcctgcggcaagcacaccgtgagaggctggtgcaagaacaagagagtgggcaagcagctggccagccagaagatcctgcagctgctgcacccccacgtgaagaactggggcagcctgctgagaatgtacggcagagagagcagcaagatggtgaagcaggagaccagcgacaagagcgtgatcgagctgcagcagtacgccaagaagaacaagcccaacctgcacatcctgagcaagctgcaggaggagatgaagagactggccgaggagagagaggagaccagaaagaagcccaagatgagcatcgtggccagcgcccagcccggcggcgagcccctgtgcaccgtggacgtgtag

SEQ ID NO: 79164 - DNA, 2223 bp, Artificial Sequence
  Description of Artificial Sequence: Synthetic coding sequence
atggagaccgacgagagccccagccccctgccctgcggccccgccggcgaggccgtgatggagagcagagccagacccttccaggccctgcccagagagcagagcccccccccccccctgcagaccagcagcggcgccgaggtgatggacgtgggcagcggcggcgacggccagagcgagctgcccgccgaggaccccttcaacttctacggcgccagcctgctgagcaagggcagcttcagcaagggcagactgctgatcgaccccaactgcagcggccacagccccagaaccgccagacacgcccccgccgtgagaaagttcagccccgacctgaagctgctgaaggacgtgaagatcagcgtgagcttcaccgagagctgcagaagcaaggacagaaaggtgctgtacaccggcgccgagagagacgtgagagccgagtgcggcctgctgctgagccccgtgagcggcgacgtgcacgcctgccccttcggcggcagcgtgggcgacggcgtgggcatcggcggcgagagcgccgacaagaaggacgaggagaacgagctggaccaggagaagagagtggagtacgccgtgctggacgagctggaggacttcaccgacaacctggagctggacgaggagggcgccggcggcttcaccgccaaggccatcgtgcagagagacagagtggacgaggaggccctgaacttcccctacgaggacgacttcgacaacgacgtggacgccctgctggaggagggcctgtgcgcccccaagaagagaagaaccgaggagaagtacggcggcgacagcgaccaccccagcgacggcgagaccagcgtgcagcccatgatgaccaagatcaagaccgtgctgaagagcagaggcagaccccccaccgagcccctgcccgacggctggatcatgaccttccacaacagcggcgtgcccgtgtacctgcacagagagagcagagtggtgacctggagcagaccctacttcctgggcaccggcagcatcagaaagcacgacccccccctgagcagcatcccctgcctgcactacaagaagatgaaggacaacgaggagagagagcagagcagcgacctgacccccagcggcgacgtgagccccgtgaagcccctgagcagaagcgccgagctggagttccccctggacgagcccgacagcatgggcgccgaccccggcccccccgacgagaaggaccccctgggcgccgaggccgcccccggcgccctgggccaggtgaaggccaaggtggaggtgtgcaaggacgagagcgtggacctggaggagttcagaagctacctggagaagagattcgacttcgagcaggtgaccgtgaagaagttcagaacctgggccgagagaagacagttcaacagagagatgaagagaaagcaggccgagagcgagagacccatcctgcccgccaaccagaagctgatcaccctgagcgtgcaggacgcccccaccaagaaggagttcgtgatcaaccccaacggcaagagcgaggtgtgcatcctgcacgagtacatgcagagagtgctgaaggtgagacccgtgtacaacttcttcgagtgcgccagagccaccctggagatcctgatccccgacttcgtgaagcagaccagcgaggagaagcccaaggacagcgaggagctggagtacttcaaccacatcagcatcgaggacagcagagtgtacgagctgaccagcaaggccggcctgctgagcccctaccagatcctgcacgagtgcctgaagagaaaccacggcatgggcgacaccagcatcaagttcgaggtggtgcccggcaagaaccagaagagcgagtacgtgatggcctgcggcaagcacaccgtgagaggctggtgcaagaacaagagagtgggcaagcagctggccagccagaagatcctgcagctgctgcacccccacgtgaagaactggggcagcctgctgagaatgtacggcagagagagcagcaagatggtgaagcaggagaccagcgacaagagcgtgatcgagctgcagcagtacgccaagaagaacaagcccaacctgcacatcctgagcaagctgcaggaggagatgaagagactggccgaggagagagaggagaccagaaagaagcccaagatgagcatcgtggccagcgcccagcccggcggcgagcccctgtgcaccgtggacgtgtag

SEQ ID NO: 79165 - DNA, 2223 bp, Artificial Sequence; identical to SEQ ID NO: 79164
  Description of Artificial Sequence: Synthetic coding sequence

SEQ ID NO: 79166 - DNA, 378 bp, Artificial Sequence
  Description of Artificial Sequence: Synthetic coding sequence
atggagaccgacgagagccccagccccctgccctgcggccccgccggcgaggccgtgatggagagcagagccagacccttccaggccctgcccagagagcagagcccccccccccccctgcagaccagcagcggcgccgaggtgatggacgtgggcagcggcggcgacggccagagcgagctgcccgccgaggaccccttcaacttctacggcgccagcctgctgagcaagggcagcttcagcaagggcagactgctgatcgaccccaactgcagcggccacagccccagaaccgccagacacgcccccgccgtgagaaagttcagccccgacctgaagctgctgaaggacgtgaagatcagcgtgagcttcacctag

SEQ ID NO: 79167 - DNA, 564 bp, Artificial Sequence
  Description of Artificial Sequence: Synthetic coding sequence
atggtgggcagcctgaactgcatcgtggccgtgagccagaacatgggcatcggcaagaacggcgacctgccctggccccccctgagaaacgagttcagatacttccagagaatgaccaccaccagcagcgtggagggcaagcagaacctggtgatcatgggcaagaagacctggttcagcatccccgagaagaacagacccctgaagggcagaatcaacctggtgctgagcagagagctgaaggagcccccccagggcgcccacttcctgagcagaagcctggacgacgccctgaagctgaccgagcagcccgagctggccaacaaggtggacatggtgtggatcgtgggcggcagcagcgtgtacaaggaggccatgaaccaccccggccacctgaagctgttcgtgaccagaatcatgcaggacttcgagagcgacaccttcttccccgagatcgacctggagaagtacaagctgctgcccgagtaccccggcgtgctgagcgacgtgcaggaggagaagggcatcaagtacaagttcgaggtgtacgagaagaacgactag

SEQ ID NO: 79168 - DNA, 564 bp, Artificial Sequence; identical to SEQ ID NO: 79167
  Description of Artificial Sequence: Synthetic coding sequence

SEQ ID NO: 79169 - DNA, 963 bp, Artificial Sequence
  Description of Artificial Sequence: Synthetic coding sequence
atggccgccgtgagaatgctgagaacctggagcagaaacgccggcaagctgatctgcgtgagatacttccagacctgcggcaacgtgcacgtgctgaagcccaactacgtgtgcttcttcggctaccccagcttcaagtacagccacccccaccacttcctgaagaccaccgccgccctgagaggccaggtggtgcagttcaagctgagcgacatcggcgagggcatcagagaggtgaccgtgaaggagtggtacgtgaaggagggcgacaccgtgagccagttcgacagcatctgcgaggtgcagagcgacaaggccagcgtgaccatcaccagcagatacgacggcgtgatcaagaagctgtactacaacctggacgacatcgcctacgtgggcaagcccctggtggacatcgagaccgaggccctgaaggacagcgaggaggacgtggtggagacccccgccgtgagccacgacgagcacacccaccaggagatcaagggcagaaagaccctggccacccccgccgtgagaagactggccatggagaacaacatcaagctgagcgaggtggtgggcagcggcaaggacggcagaatcctgaaggaggacatcctgaactacctggagaagcagaccggcgccatcctgccccccagccccaaggtggagatcatgccccccccccccaagcccaaggacatgaccgtgcccatcctggtgagcaagccccccgtgttcaccggcaaggacaagaccgagcccatcaagggcttccagaaggccatggtgaagaccatgagcgccgccctgaagatcccccacttcggctactgcgacgagatcgacctgaccgagctggtgaagctgagagaggagctgaagcccatcgccttcgccagaggcatcaagctgagcttcatgcccttcttcctgaagtactacttcagctggaagagctag

SEQ ID NO: 79170 - DNA, 1449 bp, Artificial Sequence
  Description of Artificial Sequence: Synthetic coding sequence
atggccgccgtgagaatgctgagaacctggagcagaaacgccggcaagctgatctgcgtgagatacttccagacctgcggcaacgtgcacgtgctgaagcccaactacgtgtgcttcttcggctaccccagcttcaagtacagccacccccaccacttcctgaagaccaccgccgccctgagaggccaggtggtgcagttcaagctgagcgacatcggcgagggcatcagagaggtgaccgtgaaggagtggtacgtgaaggagggcgacaccgtgagccagttcgacagcatctgcgaggtgcagagcgacaaggccagcgtgaccatcaccagcagatacgacggcgtgatcaagaagctgtactacaacctggacgacatcgcctacgtgggcaagcccctggtggacatcgagaccgaggccctgaaggacagcgaggaggacgtggtggagacccccgccgtgagccacgacgagcacacccaccaggagatcaagggcagaaagaccctggccacccccgccgtgagaagactggccatggagaacaacatcaagctgagcgaggtggtgggcagcggcaaggacggcagaatcctgaaggaggacatcctgaactacctggagaagcagaccggcgccatcctgccccccagccccaaggtggagatcatgccccccccccccaagcccaaggacatgaccgtgcccatcctggtgagcaagccccccgtgttcaccggcaaggacaagaccgagcccatcaagggcttccagaaggccatggtgaagaccatgagcgccgccctgaagatcccccacttcggctactgcgacgagatcgacctgaccgagctggtgaagctgagagaggagctgaagcccatcgccttcgccagaggcatcaagctgagcttcatgcccttcttcctgaaggccgccagcctgggcctgctgcagttccccatcctgaacgccagcgtggacgagaactgccagaacatcacctacaaggccagccacaacatcggcatcgccatggacaccgagcagggcctgatcgtgcccaacgtgaagaacgtgcagatctgcagcatcttcgacatcgccaccgagctgaacagactgcagaagctgggcagcgtgagccagctgagcaccaccgacctgaccggcggcaccttcaccctgagcaacatcggcagcatcggcggcaccttcgccaagcccgtgatcatgccccccgaggtggccatcggcgccctgggcagcatcaaggccatccccagattcaaccagaagggcgaggtgtacaaggcccagatcatgaacgtgagctggagcgccgaccacagagtgatcgacggcgccaccatgagcagattcagcaacctgtggaagagctacctggagaaccccgccttcatgctgctggacctgaagtag

SEQ ID NO: 79171 - DNA, 906 bp, Artificial Sequence
  Description of Artificial Sequence: Synthetic coding sequence
atggagaacaacatcaagctgagcgaggtggtgggcagcggcaaggacggcagaatcctgaaggaggacatcctgaactacctggagaagcagaccggcgccatcctgccccccagccccaaggtggagatcatgccccccccccccaagcccaaggacatgaccgtgcccatcctggtgagcaagccccccgtgttcaccggcaaggacaagaccgagcccatcaagggcttccagaaggccatggtgaagaccatgagcgccgccctgaagatcccccacttcggctactgcgacgagatcgacctgaccgagctggtgaagctgagagaggagctgaagcccatcgccttcgccagaggcatcaagctgagcttcatgcccttcttcctgaaggccgccagcctgggcctgctgcagttccccatcctgaacgccagcgtggacgagaactgccagaacatcacctacaaggccagccacaacatcggcatcgccatggacaccgagcagggcctgatcgtgcccaacgtgaagaacgtgcagatctgcagcatcttcgacatcgccaccgagctgaacagactgcagaagctgggcagcgtgagccagctgagcaccaccgacctgaccggcggcaccttcaccctgagcaacatcggcagcatcggcggcaccttcgccaagcccgtgatcatgccccccgaggtggccatcggcgccctgggcagcatcaaggccatccccagattcaaccagaagggcgaggtgtacaaggcccagatcatgaacgtgagctggagcgccgaccacagagtgatcgacggcgccaccatgagcagattcagcaacctgtggaagagctacctggagaaccccgccttcatgctgctggacctgaagtag

SEQ ID NO: 79172 - DNA, 5286 bp, Artificial Sequence
  Description of Artificial Sequence: Synthetic coding sequence
atgcagttccagctgaccctgttcctgcacctgggctggctgagctacagcaaggcccaggacgactgcaacagaggcgcctgccaccccaccaccggcgacctgctggtgggcagaaacacccagctgatggccagcagcacctgcggcctgagcagagcccagaagtactgcatcctgagctacctggagggcgagcagaagtgcttcatctgcgacagcagattcccctacgacccctacgaccagcccaacagccacaccatcgagaacgtgatcgtgagcttcgagcccgacagagagaagaagtggtggcagagcgagaacggcctggaccacgtgagcatcagactggacctggaggccctgttcagattcagccacctgatcctgaccttcaagaccttcagacccgccgccatgctggtggagagaagcaccgactacggccacaactggaaggtgttcaagtacttcgccaaggactgcgccaccagcttccccaacatcaccagcggccaggcccagggcgtgggcgacatcgtgtgcgacagcaagtacagcgacatcgagcccagcaccggcggcgaggtggtgctgaaggtgctggaccccagcttcgagatcgagaacccctacagcccctacatccaggacctggtgaccctgaccaacctgagaatcaacttcaccaagctgcacaccctgggcgacgccctgctgggcagaagacagaacgacagcctggacaagtactactacgccctgtacgagatgatcgtgagaggcagctgcttctgcaacggccacgccagcgagtgcagacccatgcagaagatgagaggcgacgtgttcagcccccccggcatggtgcacggccagtgcgtgtgccagcacaacaccgacggccccaactgcgagagatgcaaggacttcttccaggacgccccctggagacccgccgccgacctgcaggacaacgcctgcagaagctgcagctgcaacagccacagcagcagatgccacttcgacatgaccacctacctggccagcggcggcctgagcggcggcgtgtgcgaggactgccagcacaacaccgagggccagcactgcgacagatgcagacccctgttctacagagaccccctgaagaccatcagcgacccctacgcctgcatcccctgcgagtgcgaccccgacggcaccatcagcggcggcatctgcgtgagccacagcgaccccgccctgggcagcgtggccggccagtgcctgtgcaaggagaacgtggagggcgccaagtgcgaccagtgcaagcccaaccactacggcctgagcgccaccgaccccctgggctgccagccctgcgactgcaaccccctgggcagcctgcccttcctgacctgcgacgtggacaccggccagtgcctgtgcctgagctacgtgaccggcgcccactgcgaggagtgcaccgtgggctactggggcctgggcaaccacctgcacggctgcagcccctgcgactgcgacatcggcggcgcctacagcaacgtgtgcagccccaagaacggccagtgcgagtgcagaccccacgtgaccggcagaagctgcagcgagcccgcccccggctacttcttcgcccccctgaacttctacctgtacgaggccgaggaggccaccaccctgcagggcctggcccccctgggcagcgagaccttcggccagagccccgccgtgcacgtggtgctgggcgagcccgtgcccggcaaccccgtgacctggaccggccccggcttcgccagagtgctgcccggcgccggcctgagattcgccgtgaacaacatccccttccccgtggacttcaccatcgccatccactacgagacccagagcgccgccgactggaccgtgcagatcgtggtgaacccccccggcggcagcgagcactgcatccccaagaccctgcagagcaagccccagagcttcgccctgcccgccgccaccagaatcatgctgctgcccacccccatctgcctggagcccgacgtgcagtacagcatcgacgtgtacttcagccagcccctgcagggcgagagccacgcccacagccacgtgctggtggacagcctgggcctgatcccccagatcaacagcctggagaacttctgcagcaagcaggacctggacgagtaccagctgcacaactgcgtggagatcgccagcgccatgggcccccaggtgctgcccggcgcctgcgagagactgatcatcagcatgagcgccaagctgcacgacggcgccgtggcctgcaagtgccacccccagggcagcgtgggcagcagctgcagcagactgggcggccagtgccagtgcaagcccctggtggtgggcagatgctgcgacagatgcagcaccggcagctacgacctgggccaccacggctgccacccctgccactgccacccccagggcagcaaggacaccgtgtgcgaccaggtgaccggccagtgcccctgccacggcgaggtgagcggcagaagatgcgacagatgcctggccggctacttcggcttccccagctgccacccctgcccctgcaacagattcgccgagctgtgcgaccccgagaccggcagctgcttcaactgcggcggcttcaccaccggcagaaactgcgagagatgcatcgacggctactacggcaaccccagcagcggccagccctgcagaccctgcctgtgccccgacgaccccagcagcaaccagtacttcgcccacagctgctaccagaacctgtggagcagcgacgtgatctgcaactgcctgcagggctacaccggcacccagtgcggcgagtgcagcaccggcttctacggcaaccccagaatcagcggcgccccctgccagccctgcgcctgcaacaacaacatcgacgtgaccgaccccgagagctgcagcagagtgaccggcgagtgcctgagatgcctgcacaacacccagggcgccaactgccagctgtgcaagcccggccactacggcagcgccctgaaccagacctgcagaagatgcagctgccacgccagcggcgtgagccccatggagtgcccccccggcggcggcgcctgcctgtgcgaccccgtgaccggcgcctgcccctgcctgcccaacgtgaccggcctggcctgcgacagatgcgccgacggctactggaacctggtgcccggcagaggctgccagagctgcgactgcgaccccagaaccagccagagcagccactgcgaccagctgaccggccagtgcccctgcaagctgggctacggcggcaagagatgcagcgagtgccaggagaactactacggcgacccccccggcagatgcatcccctgcgactgcaacagagccggcacccagaagcccatctgcgaccccgacaccggcatgtgcagatgcagagagggcgtgagcggccagagatgcgacagatgcgccagaggccacagccaggagttccccacctgcctgcagtgccacctgtgcttcgaccagtgggaccacaccatcagcagcctgagcaaggccgtgcagggcctgatgagactggccgccaacatggaggacaagagagagaccctgcccgtgtgcgaggccgacttcaaggacctgagaggcaacgtgagcgagatcgagagaatcctgaagcaccccgtgttccccagcggcaagttcctgaaggtgaaggactaccacgacagcgtgagaagacagatcatgcagctgaacgagcagctgaaggccgtgtacgagttccaggacctgaaggacaccatcgagagagccaagaacgaggccgacctgctgctggaggacctgcaggaggagatcgacctgcagagcagcgtgctgaacgccagcatcgccgacagcagcgagaacatcaagaagtactaccacatcagcagcagcgccgagaagaagatcaacgagaccagcagcaccatcaacaccagcgccaacaccagaaacgacctgctgaccatcctggacaccctgaccagcaagggcaacctgagcctggagagactgaagcagatcaagatccccgacatccagatcctgaacgagaaggtgtgcggcgaccccggcaacgtgccctgcgtgcccctgccctgcggcggcgccctgtgcaccggcagaaagggccacagaaagtgcagaggccccggctgccacggcagcctgaccctgagcaccaacgccctgcagaaggcccaggaggccaagagcatcatcagaaacctggacaagcaggtgagaggcctgaagaaccagatcgagagcatcagcgagcaggccgaggtgagcaagaacaacgccctgcagctgagagagaagctgggcaacatcagaaaccagagcgacagcgaggaggagaacatcaacctgttcatcaagaaggtgaagaacttcctgctggaggagaacgtgccccccgaggacatcgagaaggtggccaacggcgtgctggacatccacctgcccatccccagccagaacctgaccgacgagctggtgaagatccagaagcacatgcagctgtgcgaggactacagaaccgacgagaacagactgaacgaggaggccgacggcgcccagaagctgctggtgaaggccaaggccgccgagaaggccgccaacatcctgctgaacctggacaagaccctgaaccagctgcagcaggcccagatcacccagggcagagccaacagcaccatcacccagctgaccgccaacatcaccaagatcaagaagaacgtgctgcaggccgagaaccagaccagagagatgaagagcgagctggagctggccaagcagagaagcggcctggaggacggcctgagcctgctgcagaccaagctgcagagacaccaggaccacgccgtgaacgccaaggtgcaggccgagagcgcccagcaccaggccggcagcctggagaaggagttcgtggagctgaagaagcagtacgccatcctgcagagaaagaccagcaccaccggcctgaccaaggagaccctgggcaaggtgaagcagctgaaggacgccgccgagaagctggccggcgacaccgaggccaagatcagaagaatcaccgacctggagagaaagatccaggacctgaacctgagcagacaggccaaggccgaccagctgagaatcctggaggaccaggtggtggccatcaagaacgagatcgtggagcaggagaagaagtacgccagatgctacagctag

SEQ ID NO: 79173 - DNA, 1530 bp, Artificial Sequence; identical to SEQ ID NO: 73834
  Description of Artificial Sequence: Synthetic coding sequence

SEQ ID NO: 79174 - DNA, 1386 bp, Artificial Sequence
  Description of Artificial Sequence: Synthetic coding sequence
atgcagagctggagcagagtgtactgcagcctggccaagagaggccacttcaacagaatcagccacggcctgcagggcctgagcgccgtgcccctgagaacctacgccgaccagcccatcgacgccgacgtgaccgtgatcggcagcggccccggcggctacgtggccgccatcaaggccgcccagctgggcttcaagaccgtgtgcatcgagaagaacgagaccctgggcggcacctgcctgaacgtgggctgcatccccagcaaggccctgctgaacaacagccactactaccacatggcccacggcaaggacttcgccagcagaggcatcgagatgagcgaggtgagactgaacctggacaagatgatggagcagaagagcaccgccgtgaaggccctgaccggcggcatcgcccacctgttcaagcagaacaagatcgacgaggacaccatcgtgagcagcaccggcgccctgagcctgaagaaggtgcccgagaagatggtggtgatcggcgccggcgtgatcggcgtggagctgggcagcgtgtggcagagactgggcgccgacgtgaccgccgtggagttcctgggccacgtgggcggcgtgggcatcgacatggagatcagcaagaacttccagagaatcctgcagaagcagggcttcaagttcaagctgaacaccaaggtgaccggcgccaccaagaagagcgacggcaagatcgacgtgagcatcgaggccgccagcggcggcaaggccgaggtgatcacctgcgacgtgctgctggtgtgcatcggcagaagacccttcaccaagaacctgggcctggaggagctgggcatcgagctggaccccagaggcagaatccccgtgaacaccagattccagaccaagatccccaacatctacgccatcggcgacgtggtggccggccccatgctggcccacaaggccgaggacgagggcatcatctgcgtggagggcatggccggcggcgccgtgcacatcgactacaactgcgtgcccagcgtgatctacacccaccccgaggtggcctgggtgggcaagagcgaggagcagctgaaggaggagggcatcgagtacaaggtgggcaagttccccttcgccgccaacagcagagccaagaccaacgccgacaccgacggcatggtgaagatcctgggccagaagagcaccgacagagtgctgggcgcccacatcctgggccccggcgccggcgagatggtgaacgaggccgccctggccctggagtacggcgccagctgcgaggacatcgccagagtgtgccacgcccaccccaccctgagcgaggccttcagagaggccaacctggccgccagcttcggcaagagcatcaacttctag

SEQ ID NO: 79175 - DNA, 1461 bp, Artificial Sequence
  Description of Artificial Sequence: Synthetic coding sequence
atgcagagctggagcagagtgtactgcagcctggccaagagaggccacttcaacagaatcagccacggcctgcagggcctgagcgccgtgcccctgagaacctacgccgaccagcccatcgacgccgacgtgaccgtgatcggcagcggccccggcggctacgtggccgccatcaaggccgcccagctgggcttcaaggccctgctgaacaacagccactactaccacatggcccacggcaaggacttcgccagcagaggcatcgagatgagcgaggtgagactgaacctggacaagatgatggagcagaagagcaccgccgtgaaggccctgaccggcggcatcgcccacctgttcaagcagaacaaggtggtgcacgtgaacggctacggcaagatcaccggcaagaaccaggtgaccgccaccaaggccgacggcggcacccaggtgatcgacaccaagaacatcctgatcgccaccggcagcgaggtgacccccttccccggcatcaccatcgacgaggacaccatcgtgagcagcaccggcgccctgagcctgaagaaggtgcccgagaagatggtggtgatcggcgccggcgtgatcggcgtggagctgggcagcgtgtggcagagactgggcgccgacgtgaccgccgtggagttcctgggccacgtgggcggcgtgggcatcgacatggagatcagcaagaacttccagagaatcctgcagaagcagggcttcaagttcaagctgaacaccaaggtgaccggcgccaccaagaagagcgacggcaagatcgacgtgagcatcgaggccgccagcggcggcaaggccgaggtgatcacctgcgacgtgctgctggtgtgcatcggcagaagacccttcaccaagaacctgggcctggaggagctgggcatcgagctggaccccagaggcagaatccccgtgaacaccagattccagaccaagatccccaacatctacgccatcggcgacgtggtggccggccccatgctggcccacaaggccgaggacgagggcatcatctgcgtggagggcatggccggcggcgccgtgcacatcgactacaactgcgtgcccagcgtgatctacacccaccccgaggtggcctgggtgggcaagagcgaggagcagctgaaggaggagggcatcgagtacaaggtgggcaagttccccttcgccgccaacagcagagccaagaccaacgccgacaccgacggcatggtgaagatcctgggccagaagagcaccgacagagtgctgggcgcccacatcctgggccccggcgccggcgagatggtgaacgaggccgccctggccctggagtacggcgccagctgcgaggacatcgccagagtgtgccacgcccaccccaccctgagcgaggccttcagagaggccaacctggccgccagcttcggcaagagcatcaacttctag

SEQ ID NO: 79176 - DNA, 1233 bp, Artificial Sequence
  Description of Artificial Sequence: Synthetic coding sequence
atggcccacggcaaggacttcgccagcagaggcatcgagatgagcgaggtgagactgaacctggacaagatgatggagcagaagagcaccgccgtgaaggccctgaccggcggcatcgcccacctgttcaagcagaacaaggtggtgcacgtgaacggctacggcaagatcaccggcaagaaccaggtgaccgccaccaaggccgacggcggcacccaggtgatcgacaccaagaacatcctgatcgccaccggcagcgaggtgacccccttccccggcatcaccatcgacgaggacaccatcgtgagcagcaccggcgccctgagcctgaagaaggtgcccgagaagatggtggtgatcggcgccggcgtgatcggcgtggagctgggcagcgtgtggcagagactgggcgccgacgtgaccgccgtggagttcctgggccacgtgggcggcgtgggcatcgacatggagatcagcaagaacttccagagaatcctgcagaagcagggcttcaagttcaagctgaacaccaaggtgaccggcgccaccaagaagagcgacggcaagatcgacgtgagcatcgaggccgccagcggcggcaaggccgaggtgatcacctgcgacgtgctgctggtgtgcatcggcagaagacccttcaccaagaacctgggcctggaggagctgggcatcgagctggaccccagaggcagaatccccgtgaacaccagattccagaccaagatccccaacatctacgccatcggcgacgtggtggccggccccatgctggcccacaaggccgaggacgagggcatcatctgcgtggagggcatggccggcggcgccgtgcacatcgactacaactgcgtgcccagcgtgatctacacccaccccgaggtggcctgggtgggcaagagcgaggagcagctgaaggaggagggcatcgagtacaaggtgggcaagttccccttcgccgccaacagcagagccaagaccaacgccgacaccgacggcatggtgaagatcctgggccagaagagcaccgacagagtgctgggcgcccacatcctgggccccggcgccggcgagatggtgaacgaggccgccctggccctggagtacggcgccagctgcgaggacatcgccagagtgtgccacgcccaccccaccctgagcgaggccttcagagaggccaacctggccgccagcttcggcaagagcatcaacttctag

SEQ ID NO: 79177 - DNA, 1380 bp, Artificial Sequence
  Description of Artificial Sequence: Synthetic coding sequence
atgctgatctacgtggccgccatcaaggccgcccagctgggcttcaagaccgtgtgcatcgagaagaacgagaccctgggcggcacctgcctgaacgtgggctgcatccccagcaaggccctgctgaacaacagccactactaccacatggcccacggcaaggacttcgccagcagaggcatcgagatgagcgaggtgagactgaacctggacaagatgatggagcagaagagcaccgccgtgaaggccctgaccggcggcatcgcccacctgttcaagcagaacaaggtggtgcacgtgaacggctacggcaagatcaccggcaagaaccaggtgaccgccaccaaggccgacggcggcacccaggtgatcgacaccaagaacatcctgatcgccaccggcagcgaggtgacccccttccccggcatcaccatcgacgaggacaccatcgtgagcagcaccggcgccctgagcctgaagaaggtgcccgagaagatggtggtgatcggcgccggcgtgatcggcgtggagctgggcagcgtgtggcagagactgggcgccgacgtgaccgccgtggagttcctgggccacgtgggcggcgtgggcatcgacatggagatcagcaagaacttccagagaatcctgcagaagcagggcttcaagttcaagctgaacaccaaggtgaccggcgccaccaagaagagcgacggcaagatcgacgtgagcatcgaggccgccagcggcggcaaggccgaggtgatcacctgcgacgtgctgctggtgtgcatcggcagaagacccttcaccaagaacctgggcctggaggagctgggcatcgagctggaccccagaggcagaatccccgtgaacaccagattccagaccaagatccccaacatctacgccatcggcgacgtggtggccggccccatgctggcccacaaggccgaggacgagggcatcatctgcgtggagggcatggccggcggcgccgtgcacatcgactacaactgcgtgcccagcgtgatctacacccaccccgaggtggcctgggtgggcaagagcgaggagcagctgaaggaggagggcatcgagtacaaggtgggcaagttccccttcgccgccaacagcagagccaagaccaacgccgacaccgacggcatggtgaagatcctgggccagaagagcaccgacagagtgctgggcgcccacatcctgggccccggcgccggcgagatggtgaacgaggccgccctggccctggagtacggcgccagctgcgaggacatcgccagagtgtgccacgcccaccccaccctgagcgaggccttcagagaggccaacctggccgccagcttcggcaagagcatcaacttctag

SEQ ID NO: 79178 - DNA, 1944 bp, Artificial Sequence
  Description of Artificial Sequence: Synthetic coding sequence
atgtggagagtgtgcgccagaagagcccagaacgtggccccctgggccggcctggaggccagatggaccgccctgcaggaggtgcccggcacccccagagtgaccagcagaagcggccccgcccccgccagaagaaacagcgtgaccaccggctacggcggcgtgagagccctgtgcggctggacccccagcagcggcgccacccccagaaacagactgctgctgcagctgctgggcagccccggcagaagatactacagcctgcccccccaccagaaggtgcccctgcccagcctgagccccaccatgcaggccggcaccatcgccagatgggagaagaaggagggcgacaagatcaacgagggcgacctgatcgccgaggtggagaccgacaaggccaccgtgggcttcgagagcctggaggagtgctacatggccaagatcctggtggccgagggcaccagagacgtgcccatcggcgccatcatctgcatcaccgtgggcaagcccgaggacatcgaggccttcaagaactacaccctggacagcagcgccgcccccaccccccaggccgcccccgcccccacccccgccgccaccgccagcccccccacccccagcgcccaggcccccggcagcagctaccccccccacatgcaggtgctgctgcccgccctgagccccaccatgaccatgggcaccgtgcagagatgggagaagaaggtgggcgagaagctgagcgagggcgacctgctggccgagatcgagaccgacaaggccaccatcggcttcgaggtgcaggaggagggctacctggccaagatcctggtgcccgagggcaccagagacgtgcccctgggcacccccctgtgcatcatcgtggagaaggaggccgacatcagcgccttcgccgactacagacccaccgaggtgaccgacctgaagccccaggtgcccccccccacccccccccccgtggccgccgtgccccccaccccccagcccctggcccccacccccagcgccccctgccccgccacccccgccggccccaagggcagagtgttcgtgagccccctggccaagaagctggccgtggagaagggcatcgacctgacccaggtgaagggcaccggccccgacggcagaatcaccaagaaggacatcgacagcttcgtgcccagcaaggtggcccccgcccccgccgccgtggtgccccccaccggccccggcatggcccccgtgcccaccggcgtgttcaccgacatccccatcagcaacatcagaagagtgatcgcccagagactgatgcagagcaagcagaccatcccccactactacctgagcatcgacgtgaacatgggcgaggtgctgctggtgagaaaggagctgaacaagatcctggagggcagaagcaagatcagcgtgaacgacttcatcatcaaggccagcgccctggcctgcctgaaggtgcccgaggccaacagcagctggatggacaccgtgatcagacagaaccacgtggtggacgtgagcgtggccgtgagcacccccgccggcctgatcacccccatcgtgttcaacgcccacatcaagggcgtggagaccatcgccaacgacgtggtgagcctggccaccaaggccagagagggcaagctgcagccccacgagttccagggcggcaccttcaccatcagcaacctgggcatgttcggcatcaagaacttcagcgccatcatcaaccccccccaggcctgcatcctggccatcggcgccagcgaggacaagctggtgcccgccgacaacgagaagggcttcgacgtggccagcatgatgagcgtgaccctgagctgcgaccacagagtggtggacggcgccgtgggcgcccagtggctggccgagttcagaaagtacctggagaagcccatcaccatgctgctgtag

SEQ ID NO: 79179 - DNA, 678 bp, Artificial Sequence
  Description of Artificial Sequence: Synthetic coding sequence
atgtggagagtgtgcgccagaagagcccagaacgtggccccctgggccggcctggaggccagatggaccgccctgcaggaggtgcccggcacccccagagtgaccagcagaagcggccccgcccccgccagaagaaacagcgtgaccaccggctacggcggcgtgagagccctgtgcggctggacccccagcagcggcgccacccccagaaacagactgctgctgcagctgctgggcagccccggcagaagatactacagcctgcccccccaccagaaggtgcccctgcccagcctgagccccaccatgcaggccggcaccatcgccagatgggagaagaaggagggcgacaagatcaacgagggcgacctgatcgccgaggtggagaccgacaaggccaccgtgggcaagcccgaggacatcgaggccttcaagaactacaccctggacagcagcgccgcccccaccccccaggccgcccccgcccccacccccgccgccaccgccagcccccccacccccagcgcccaggcccccggcagcagctaccccccccacatgcaggtgctgctgcccgccctgagccccaccatgaccatgggcaccgtgcagagatgggagaagaaggtgggcgagaagctgagcgagggcgacctgctggccgagatgagcctgtag

SEQ ID NO: 79180 - DNA, 1257 bp, Artificial Sequence
  Description of Artificial Sequence: Synthetic coding sequence
atgcaggccggcaccatcgccagatgggagaagaaggagggcgacaagatcaacgagggcgacctgctggccgagatcgagaccgacaaggccaccatcggcttcgaggtgcaggaggagggctacctggccaagatcctggtgcccgagggcaccagagacgtgcccctgggcacccccctgtgcatcatcgtggagaaggaggccgacatcagcgccttcgccgactacagacccaccgaggtgaccgacctgaagccccaggtgcccccccccacccccccccccgtggccgccgtgccccccaccccccagcccctggcccccacccccagcgccccctgccccgccacccccgccggccccaagggcagagtgttcgtgagccccctggccaagaagctggccgtggagaagggcatcgacctgacccaggtgaagggcaccggccccgacggcagaatcaccaagaaggacatcgacagcttcgtgcccagcaaggtggcccccgcccccgccgccgtggtgccccccaccggccccggcatggcccccgtgcccaccggcgtgttcaccgacatccccatcagcaacatcagaagagtgatcgcccagagactgatgcagagcaagcagaccatcccccactactacctgagcatcgacgtgaacatgggcgaggtgctgctggtgagaaaggagctgaacaagatcctggagggcagaagcaagatcagcgtgaacgacttcatcatcaaggccagcgccctggcctgcctgaaggtgcccgaggccaacagcagctggatggacaccgtgatcagacagaaccacgtggtggacgtgagcgtggccgtgagcacccccgccggcctgatcacccccatcgtgttcaacgcccacatcaagggcgtggagaccatcgccaacgacgtggtgagcctggccaccaaggccagagagggcaagctgcagccccacgagttccagggcggcaccttcaccatcagcaacctgggcatgttcggcatcaagaacttcagcgccatcatcaaccccccccaggcctgcatcctggccatcggcgccagcgaggacaagctggtgcccgccgacaacgagaagggcttcgacgtggccagcatgatgagcgtgaccctgagctgcgaccacagagtggtggacggcgccgtgggcgcccagtggctggccgagttcagaaagtacctggagaagcccatcaccatgctgctgtag

SEQ ID NO: 79181 - DNA, 1104 bp, Artificial Sequence
  Description of Artificial Sequence: Synthetic coding sequence
atgacctggctgcagagcaagccccagagactgcagaacctgagccagagagagatgagcggcggcagaaagaccagcgtgcaggtgcccagccccgccaacggcgtgatcgaggccctgctggtgcccgacggcggcaaggtggagggcggcacccccctgttcaccctgagaaagaccggcgccgcccccgccaaggccaagcccgccgaggcccccgccgccgccgcccccaaggccgagcccaccgccgccgccgtgcccccccccgccgcccccatccccacccagatgccccccgtgcccagccccagccagccccccagcggcaagcccgtgagcgccgtgaagcccaccgtggccccccccctggccgagcccggcgccggcaagggcctgagaagcgagcacagagagaagatgaacagaatgagacagagaatcgcccagagactgaaggaggcccagaacacctgcgccatgctgaccaccttcaacgagatcgacatgagcaacatccaggagatgagagccagacacaaggaggccttcctgaagaagcacaacctgaagctgggcttcatgagcgccttcgtgaaggccagcgccttcgccctgcaggagcagcccgtggtgaacgccgtgatcgacgacaccaccaaggaggtggtgtacagagactacatcgacatcagcgtggccgtggccacccccagaggcctggtggtgcccgtgatcagaaacgtggaggccatgaacttcgccgacatcgagagaaccatcaccgagctgggcgagaaggccagaaagaacgagctggccatcgaggacatggacggcggcaccttcaccatcagcaacggcggcgtgttcggcagcctgttcggcacccccatcatcaaccccccccagagcgccatcctgggcatgcacggcatcttcgacagacccgtggccatcggcggcaaggtggaggtgagacccatgatgtacgtggccctgacctacgaccacagactgatcgacggcagagaggccgtgaccttcctgagaaagatcaaggccgccgtggaggaccccagagtgctgctgctggacctgtag

SEQ ID NO: 79182 - DNA, 1362 bp, Artificial Sequence
  Description of Artificial Sequence: Synthetic coding sequence
atgctgagcagaagcagatgcgtgagcagagccttcagcagaagcctgagcgccttccagaagggcaactgccccctgggcagaagaagcctgcccggcgtgagcctgtgccagggccccggctaccccaacagcagaaaggtggtgatcaacaacagcgtgttcagcgtgagattcttcagaaccaccgccgtgtgcaaggacgacctggtgaccgtgaagacccccgccttcgccgagagcgtgaccgagggcgacgtgagatgggagaaggccgtgggcgacaccgtggccgaggacgaggtggtgtgcgagatcgagaccgacaagaccagcgtgcaggtgcccagccccgccaacggcgtgatcgaggccctgctggtgcccgacggcggcaaggtggagggcggcacccccctgttcaccctgagaaagaccggcgccgcccccgccaaggccaagcccgccgaggcccccgccgccgccgcccccaaggccgagcccaccgccgccgccgtgcccccccccgccgcccccatccccacccagatgccccccgtgcccagccccagccagccccccagcggcaagcccgtgagcgccgtgaagcccaccgtggccccccccctggccgagcccggcgccggcaagggcctgagaagcgagcacagagagaagatgaacagaatgagacagagaatcgcccagagactgaaggaggcccagaacacctgcgccatgctgaccaccttcaacgagatcgacatgagcaacatccaggagatgagagccagacacaaggaggccttcctgaagaagcacaacctgaagctgggcttcatgagcgccttcgtgaaggccagcgccttcgccctgcaggagcagcccgtggtgaacgccgtgatcgacgacaccaccaaggaggtggtgtacagagactacatcgacatcagcgtggccgtggccacccccagaggcctggtggtgcccgtgatcagaaacgtggaggccatgaacttcgccgacatcgagagaaccatcaccgagctgggcgagaaggccagaaagaacgagctggccatcgaggacatggacggcggcaccttcaccatcagcaacggcggcgtgttcggcagcctgttcggcacccccatcatcaaccccccccagagcgccatcctgggcatgcacggcatcttcgacagacccgtggccatcggcggcaaggtggaggtgagacccatgatgtacgtggccctgacctacgaccacagactgatcgacggcagagaggccgtgaccttcctgagaaagatcaaggccgccgtggaggaccccagagtgctgctgctggacctgtag

SEQ ID NO: 79183 - DNA, 282 bp, Artificial Sequence
  Description of Artificial Sequence: Synthetic coding sequence
atggacagactgcagaccgccctgctggtggtgctggtgctgctggccgtggccctgcaggccaccgaggccggcccctacggcgccaacatggaggacagcgtgtgctgcagagactacgtgagatacagactgcccctgagagtggtgaagcacttctactggaccagcgacagctgccccagacccggcgtggtgctgctgaccttcagagacaaggagatctgcgccgaccccagagtgccctgggtgaagatgatcctgaacaagctgagccagtag

SEQ ID NO: 79184 - DNA, 1560 bp, Artificial Sequence
  Description of Artificial Sequence: Synthetic coding sequence
atggccgcccccagcagactgctgatcagaggcggcagagtggtgaacgacgacttcagcgaggtggccgacgtgctggtggaggacggcgtggtgagagccctgggccacgacctgctgccccccggcggcgcccccgccggcctgagagtgctggacgccgccggcaagctggtgctgcccggcggcatcgacacccacacccacatgcagttccccttcatgggcagcagaagcatcgacgacttccaccagggcaccaaggccgccctgagcggcggcaccaccatgatcatcgacttcgccatcccccagaagggcggcagcctgatcgaggccttcgagacctggagaagctgggccgaccccaaggtgtgctgcgactacagcctgcacgtggccgtgacctggtggagcgaccaggtgaaggaggagatgaagatcctggtgcaggacaagggcgtgaacagcttcaagatgttcatggcctacaaggacctgtacatggtgaccgacctggagctgtacgaggccttcagcagatgcaaggagatcggcgccatcgcccaggtgcacgccgagaacggcgacctgatcgccgagggcgccaagaagatgctggccctgggcatcaccggccccgagggccacgagctgtgcagacccgaggccgtggaggccgaggccaccctgagagccatcaccatcgccagcgccgtgaactgccccctgtacatcgtgcacgtgatgagcaagagcgccgccaaggtgatcgccgacgccagaagagacggcaaggtggtgtacggcgagcccatcgccgccagcctgggcaccgacggcacccactactggaacaaggagtggcaccacgccgcccaccacgtgatgggcccccccctgagacccgaccccagcacccccgacttcctgatgaacctgctggccaacgacgacctgaccaccaccggcaccgacaactgcaccttcaacacctgccagaaggccctgggcaaggacgacttcaccaagatccccaacggcgtgaacggcgtggaggacagaatgagcgtgatctgggagaagggcgtgcacagcggcaagatggacgagaacagattcgtggccgtgaccagcaccaacgccgccaagatcttcaacctgtaccccagaaagggcagaatcgccgtgggcagcgacgccgacatcgtgatctgggaccccaagggcaccagaaccatcagcgccaagacccaccaccaggccgtgaacttcaacatcttcgagggcatggtgtgccacggcgtgcccctggtgaccatcagcagaggcaaggtggtgtacgaggccggcgtgttcagcgtgaccgccggcgacggcaagttcatccccagaaagcccttcgccgagtacatctacaagagaatcaagcagagagacagaacctgcacccccacccccgtggagagagccccctacaagggcgaggtggccaccctgaagagcagagtgaccaaggaggacgccaccgccggcaccagaaagcaggcccacccctag

SEQ ID NO: 79185 - DNA, 1719 bp, Artificial Sequence
  Description of Artificial Sequence: Synthetic coding sequence
atgagctaccagggcaagaagaacatccccagaatcaccagcgacagactgctgatcaagggcggcaagatcgtgaacgacgaccagagcttctacgccgacatctacatggaggacggcctgatcaagcagatcggcgagaacctgatcgtgcccggcggcgtgaagaccatcgaggcccacagcagaatggtgatccccggcggcatcgacgtgcacaccagattccagatgcccgaccagggcatgaccagcgccgacgacttcttccagggcaccaaggccgccctggccggcggcaccaccatgatcatcgaccacgtggtgcccgagcccggcaccagcctgctggccgccttcgaccagtggagagagtgggccgacagcaagagctgctgcgactacagcctgcacgtggacatcagcgagtggcacaagggcatccaggaggagatggaggccctggtgaaggaccacggcgtgaacagcttcctggtgtacatggccttcaaggacagattccagctgaccgactgccagatctacgaggtgctgagcgtgatcagagacatcggcgccatcgcccaggtgcacgccgagaacggcgacatcatcgccgaggagcagcagagaatcctggacctgggcatcaccggccccgagggccacgtgctgagcagacccgaggaggtggaggccgaggccgtgaacagagccatcaccatcgccaaccagaccaactgccccctgtacatcaccaaggtgatgagcaagagcagcgccgaggtgatcgcccaggccagaaagaagggcaccgtggtgtacggcgagcccatcaccgccagcctgggcaccgacggcagccactactggagcaagaactgggccaaggccgccgccttcgtgaccagcccccccctgagccccgaccccaccacccccgacttcctgaacagcctgctgagctgcggcgacctgcaggtgaccggcagcgcccactgcaccttcaacaccgcccagaaggccgtgggcaaggacaacttcaccctgatccccgagggcaccaacggcaccgaggagagaatgagcgtgatctgggacaaggccgtggtgaccggcaagatggacgagaaccagttcgtggccgtgaccagcaccaacgccgccaaggtgttcaacctgtaccccagaaagggcagaatcgccgtgggcagcgacgccgacctggtgatctgggaccccgacagcgtgaagaccatcagcgccaagacccacaacagcagcctggagtacaacatcttcgagggcatggagtgcagaggcagccccctggtggtgatcagccagggcaagatcgtgctggaggacggcaccctgcacgtgaccgagggcagcggcagatacatccccagaaagcccttccccgacttcgtgtacaagagaatcaaggccagaagcagactggccgagctgagaggcgtgcccagaggcctgtacgacggccccgtgtgcgaggtgagcgtgacccccaagaccgtgacccccgccagcagcgccaagaccagccccgccaagcagcaggccccccccgtgagaaacctgcaccagagcggcttcagcctgagcggcgcccagatcgacgacaacatccccagaagaaccacccagagaatcgtggccccccccggcggcagagccaacatcaccagcctgggctag

SEQ ID NO: 79186 - DNA, 1611 bp, Artificial Sequence
  Description of Artificial Sequence: Synthetic coding sequence
atggaggacggcctgatcaagcagatcggcgagaacctgatcgtgcccggcggcgtgaagaccatcgaggcccacagcagaatggtgatccccggcggcatcgacgtgcacaccagattccagatgcccgaccagggcatgaccagcgccgacgacttcttccagggcaccaaggccgccctggccggcggcaccaccatgatcatcgaccacgtggtgcccgagcccggcaccagcctgctggccgccttcgaccagtggagagagtgggccgacagcaagagctgctgcgactacagcctgcacgtggacatcagcgagtggcacaagggcatccaggaggagatggaggccctggtgaaggaccacggcgtgaacagcttcctggtgtacatggccttcaaggacagattccagctgaccgactgccagatctacgaggtgctgagcgtgatcagagacatcggcgccatcgcccaggtgcacgccgagaacggcgacatcatcgccgaggagcagcagagaatcctggacctgggcatcaccggccccgagggccacgtgctgagcagacccgaggaggtggaggccgaggccgtgaacagagccatcaccatcgccaaccagaccaactgccccctgtacatcaccaaggtgatgagcaagagcagcgccgaggtgatcgcccaggccagaaagaagggcaccgtggtgtacggcgagcccatcaccgccagcctgggcaccgacggcagccactactggagcaagaactgggccaaggccgccgccttcgtgaccagcccccccctgagccccgaccccaccacccccgacttcctgaacagcctgctgagctgcggcgacctgcaggtgaccggcagcgcccactgcaccttcaacaccgcccagaaggccgtgggcaaggacaacttcaccctgatccccgagggcaccaacggcaccgaggagagaatgagcgtgatctgggacaaggccgtggtgaccggcaagatggacgagaaccagttcgtggccgtgaccagcaccaacgccgccaaggtgttcaacctgtaccccagaaagggcagaatcgccgtgggcagcgacgccgacctggtgatctgggaccccgacagcgtgaagaccatcagcgccaagacccacaacagcagcctggagtacaacatcttcgagggcatggagtgcagaggcagccccctggtggtgatcagccagggcaagatcgtgctggaggacggcaccctgcacgtgaccgagggcagcggcagatacatccccagaaagcccttccccgacttcgtgtacaagagaatcaaggccagaagcagactggccgagctgagaggcgtgcccagaggcctgtacgacggccccgtgtgcgaggtgagcgtgacccccaagaccgtgacccccgccagcagcgccaagaccagccccgccaagcagcaggccccccccgtgagaaacctgcaccagagcggcttcagcctgagcggcgcccagatcgacgacaacatccccagaagaaccacccagagaatcgtggccccccccggcggcagagccaacatcaccagcctgggctag

SEQ ID NO: 79187 - DNA, 1719 bp, Artificial Sequence; identical to SEQ ID NO: 79185
  Description of Artificial Sequence: Synthetic coding sequence

SEQ ID NO: 79188 - DNA, 1611 bp, Artificial Sequence; identical to SEQ ID NO: 79186
  Description of Artificial Sequence: Synthetic coding sequence

SEQ ID NO: 79189 - DNA, 597 bp, Artificial Sequence
  Description of Artificial Sequence: Synthetic coding sequence
atgagcgtgatctgggacaaggccgtggtgaccggcaagatggacgagaaccagttcgtggccgtgaccagcaccaacgccgccaaggtgttcaacctgtaccccagaaagggcagaatcgccgtgggcagcgacgccgacctggtgatctgggaccccgacagcgtgaagaccatcttcgagggcatggagtgcagaggcagccccctggtggtgatcagccagggcaagatcgtgctggaggacggcaccctgcacgtgaccgagggcagcggcagatacatccccagaaagcccttccccgacttcgtgtacaagagaatcaaggccagaagcagactggccgagctgagaggcgtgcccagaggcctgtacgacggccccgtgtgcgaggtgagcgtgacccccaagaccgtgacccccgccagcagcgccaagaccagccccgccaagcagcaggccccccccgtgagaaacctgcaccagagcggcttcagcctgagcggcgcccagatcgacgacaacatccccagaagaaccacccagagaatcgtggccccccccggcggcagagccaacatcaccagcctgggctag
